United States Patent 12,415,844 (BCMA SPECIFIC VCAR COMPOSITIONS AND METHODS FOR USE) - sequence listing, part 2

SEQ ID NO: 4111 - protein, 434 aa, Homo Sapiens
MEYDEKLARFRQAHLNPFNKQSGPRQHEQGPGEEVPDVTPEEALPELPPGEPEFRCPERVMDLGLSEDHFSRPVGLFLASDVQQLRQAIEECKQVILELPEQSEKQKDAVVRLIHLRLKLQELKDPNEDEPNIRVLLEHRFYKEKSKSVKQTCDKCNTIIWGLIQTWYTCTGCYYRCHSKCLNLISKPCVSSKVSHQAEYELNICPETGLDSQDYRCAECRAPISLRGVPSEARQCDYTGQYYCSHCHWNDLAVIPARVVHNWDFEPRKVSRCSMRYLALMVSRPVLRLREINPLLFSYVEELVEIRKLRQDILLMKPYFITCREAMEARLLLQDLLDVHAGRLGCSLTEIHTLFAKHIKLDCERCQAKGFVCELCREGDVLFPFDSHTSVCADCSAVFHRDCYYDNSTTCPKCARLSLRKQSLFQEPGPDVEA

SEQ ID NO: 4112 - protein, 451 aa, Homo Sapiens; identical to SEQ ID NO: 4109

SEQ ID NO: 4113 - protein, 197 aa, Homo Sapiens
MEYDEKLARFRQAHLNPFNKQSGPRQHEQGPGEEVPDVTPEEALPELPPGEPEFRCPERVMDLGLSEDHFSRPVGLFLASDVQQLRQAIEECKQVILELPEQSEKQKDAVVRLIHLRLKLQELKDPNEDEPNIRVLLEHRFYKEKSKSVKQTCDKCNTIIWGLIQTWYTCTGGPRPRRGVRNERDQSSCLRWAHIQM

SEQ ID NO: 4114 - protein, 197 aa, Homo Sapiens; identical to SEQ ID NO: 4113

SEQ ID NO: 4115 - protein, 176 aa, Homo Sapiens
MEYDEKLARFRQAHLNPFNKQSGPRQHEQGPGEEVPDVTPEEALPELPPGEPEFRCPERVMDLGLSEDHFSRPVGLFLASDVQQLRQAIEECKQVILELPEQSEKQKDAVVRLIHLRLKLQELKRCQAKGFVCELCREGDVLFPFDSHTSVCADCSAVFHRDCYYDNSTTCPKCAR

SEQ ID NO: 4116 - protein, 441 aa, Homo Sapiens
MEYDEKLARFRQAHLNPFNKQSGPRQHEQGPGEEVPDVTPEEALPELPPGEPEFRCPERVMDLGLSEDHFSRPVLRQAIEECKQVILELPEQSEKQKDAVVRLIHLRLKLQELKDPNEDEPNIRVLLEHRFYKEKSKSVKQTCDKCNTIIWGLIQTWYTCTGCYYRCHSKCLNLISKPCVSSKVSHQAEYELNICPETGLDSQDYRCAECRAPISLRGVPSEARQCDYTGQYYCSHCHWNDLAVIPARVVHNWDFEPRKVSRCSMRYLALMVSRPVLRLREINPLLFSYVEELVEIRKLRQDILLMKPYFITCREAMEARLLLQLQDRQHFVENDEMYSVQDLLDVHAGRLGCSLTEIHTLFAKHIKLDCERCQAKGFVCELCREGDVLFPFDSHTSVCADCSAVFHRDCYYDNSTTCPKCARLSLRKQSLFQEPGPDVEA

SEQ ID NO: 4117 - protein, 127 aa, Homo Sapiens
MEYDEKLARFRQAHLNPFNKQSGPRQHEQGPGEEVPDVTPEEALPELPPGEPEFRCPERVMDLGLSEDHFSRPVQLRQAIEECKQVILELPEQSEKQKDAVVRLIHLRLKLQELKDPNEDEPNIRVL

SEQ ID NO: 4118 - protein, 177 aa, Homo Sapiens
MRGGGQAHLNPFNKQSGPRQHEQGPGEEVPDVTPEEALPELPPGEPEFRCPERVMDLGLSEDHFSRPVGLFLASDVQQLRQAIEECKQVILELPEQSEKQKDAVVRLIHLRLKLQELKDPNEDEPNIRVLLEHRFYKEKSKSVKQTCDKCNTIIWGLIQTWYTCTGCYYRCHSKCLN

SEQ ID NO: 4119 - protein, 186 aa, Homo Sapiens
MRGGGQVLGVAAAVMTPLPGGHAAGRTREARWDAMEYDEKLARFRQAHLNPFNKQSGPRQHEQGPGEEVPDVTPEEALPELPPGEPEFRCPERVMDLGLSEDHFSRPVGLFLASDVQQLRQAIEECKQVILELPEQSEKQKDAVVRLIHLRLKLQELKDPNEDEPNIRVLLEHRFYKEKSKSVKQT

SEQ ID NO: 4120 - protein, 94 aa, Homo Sapiens
MRTLAILAAILLVALQAQAEPLQARADEVAAAPEQIAADIPEVVVSLAWDESLAPKHPGSRKNMACYCRIPACIAGERRYGTCIYQGRLWAFCC

SEQ ID NO: 4121 - protein, 94 aa, Homo Sapiens; identical to SEQ ID NO: 4120

SEQ ID NO: 4122 - protein, 94 aa, Homo Sapiens; identical to SEQ ID NO: 4120

SEQ ID NO: 4123 - protein, 94 aa, Homo Sapiens
MRTLAILAAILLVALQAQAEPLQARADEVAAAPEQIAADIPEVVVSLAWDESLAPKHPGSRKNMDCYCRIPACIAGERRYGTCIYQGRLWAFCC

SEQ ID NO: 4124 - protein, 97 aa, Homo Sapiens
MRIIALLAAILLVALQVRAGPLQARGDEAPGQEQRGPEDQDISISFAWDKSSALQVSGSTRGMVCSCRLVFCRRTELRVGNCLIGGVSFTYCCTRVD

SEQ ID NO: 4125 - protein, 94 aa, Homo Sapiens
MRTIAILAAILLVALQAQAESLQERADEATTQKQSGEDNQDLAISFAGNGLSALRTSGSQARATCYCRTGRCATRESLSGVCEISGRLYRLCCR

SEQ ID NO: 4126 - protein, 100 aa, Homo Sapiens
MRTLTILTAVLLVALQAKAEPLQAEDDPLQAKAYEADAQEQRGANDQDFAVSFAEDASSSLRALGSTRAFTCHCRRSCYSTEYSYGTCTVMGINHRFCCL

SEQ ID NO: 4127 - protein, 68 aa, Homo Sapiens
MRTSYLLLFTLCLLLSEMASGGNFLTGLGHRSDHYNCVSSGGQCLYSACPIFTKIQGTCYRGKAKCCK

SEQ ID NO: 4128 - protein, 67 aa, Homo Sapiens
MRIHYLLFALLFLFLVPVPGHGGIINTLQKYYCRVRGGRCAVLSCLPKEEQIGKCSTRGRKCCRRKK

SEQ ID NO: 4129 - protein, 67 aa, Homo Sapiens; identical to SEQ ID NO: 4128

SEQ ID NO: 4130 - protein, 72 aa, Homo Sapiens
MQRLVLLLAISLLLYQDLPVRSEFELDRICGYGTARCRKKCRSQEYRIGRCPNTYACCLRKWDESLLNRTKP

SEQ ID NO: 4131 - protein, 72 aa, Homo Sapiens; identical to SEQ ID NO: 4130

SEQ ID NO: 4132 - protein, 78 aa, Homo Sapiens
MALIRKTFYFLFAMFFILVQLPSGCQAGLDFSQPFPSGEFAVCESCKLGRGKCRKECLENEKPDGNCRLNFLCCRQRI

SEQ ID NO: 4133 - protein, 78 aa, Homo Sapiens; identical to SEQ ID NO: 4132

SEQ ID NO: 4134 - protein, 65 aa, Homo Sapiens
MRTFLFLFAVLFFLTPAKNAFFDEKCNKLKGTCKNNCGKNEELIALCQKSLKCCRTIQPCGSIID

SEQ ID NO: 4135 - protein, 65 aa, Homo Sapiens; identical to SEQ ID NO: 4134

SEQ ID NO: 4136 - protein, 70 aa, Homo Sapiens
MPGAMKIFVFILAALILLAQIFQARTAIHRALISKRMEGHCEAECLTFEVKIGGCRAELAPFCCKNRKKH

SEQ ID NO: 4137 - protein, 70 aa, Homo Sapiens; identical to SEQ ID NO: 4136

SEQ ID NO: 4138 - protein, 73 aa, Homo Sapiens
MRIAVLLFAIFFFMSQVLPARGKFKEICERPNGSCRDFCLETEIHVGRCLNSQPCCLPLGHQPRIESTTPKKD

SEQ ID NO: 4139 - protein, 67 aa, Homo Sapiens
MKIQLFFFILHFWVTILPAKKKYPEYGSLDLRRECRIGNGQCKNQCHENEIRIAYCIRPGTHCCLQQ

SEQ ID NO: 4140 - protein, 62 aa, Homo Sapiens
MKIQLFFFILHFWVTILPARSNFEPKYRFERCEKVRGICKTFCDDVEYDYGYCIKWRSQCCV

SEQ ID NO: 4141 - protein, 82 aa, Homo Sapiens
MKILCIFLTFVFTVSCGPSVPQKKTREVAERKRECQLVRGACKPECNSWEYVYYYCNVNPCCAVWEYQKPIINKITSKLHQK

SEQ ID NO: 4142 - protein, 69 aa, Homo Sapiens
MRIFYYLHFLCYVTFILPATCTLVNADRCTKRYGRCKRDCLESEKQIDICSLPRKICCTEKLYEEDDMF

SEQ ID NO: 4143 - protein, 88 aa, Homo Sapiens
MLPDHFSPLSGDIKLSVLALVVLVVLAQTAPDGWIRRCYYGTGRCRKSCKEIERKKEKCGEKHICCVPKEKDKLSHIHDQKETSELYI

SEQ ID NO: 4144 - protein, 102 aa, Homo Sapiens
MSVMKPCLMTIAILMILAQKTPGGLFRSHNGKSREPWNPCELYQGMCRNACREYEIQYLTCPNDQKCCLKLSVKITSSKNVKEDYDSNSNLSVTNSSSYSHI

SEQ ID NO: 4145 - protein, 123 aa, Homo Sapiens
MKLLLLALPMLVLLPQVIPAYSGEKKCWNRSGHCRKQCKDGEAVKDTCKNLRACCIPSNEDHRRVPATSPTPLSDSTPGIIDDILTVRFTTDYFEVSSKKDMVEESEAGRGTETSLPNVHHSS

SEQ ID NO: 4146 - protein, 43 aa, Homo Sapiens
MKLLYLFLAILLAIEEPVISALVRTVGCCLDTARQTPHPSMHG

SEQ ID NO: 4147 - protein, 84 aa, Homo Sapiens
MKLLYLFLAILLAIEEPVISGKRHILRCMGNSGICRASCKKNEQPYLYCRNCQSCCLQSYMRISISGKEENTDWSYEKQWPRLP

SEQ ID NO: 4148 - protein, 88 aa, Homo Sapiens
MKLLYLFLAILLAIEEPVISVECWMDGHCRLLCKDGEDSIIRCRNRKRCCVPSRYLTIQPVTIHGILGWTTPQMSTTAPKMKTNITNR

SEQ ID NO: 4149 - protein, 76 aa, Homo Sapiens
MKLLLLLLTVTLLLAQVTPVMKCWGKSGRCRTTCKESEVYYILCKTEAKCCVDPKYVPVKPKLTDTNTSLESTSAV

SEQ ID NO: 4150 - protein, 67 aa, Homo Sapiens
MKLLLLTLTVLLLLSQLTPGGTQRCWNLYGKCRYRCSKKERVYVYCINNKMCCVKPKYQPKERWWPF

SEQ ID NO: 4151 - protein, 71 aa, Homo Sapiens
MTQLLLFLVALLVLGHVPSGRSEFKRCWKGQGACQTYCTRQETYMHLCPDASLCCLSYALKPPPVPKHEYE

SEQ ID NO: 4152 - protein, 156 aa, Homo Sapiens
MNILMLTFIICGLLTRVTKGSFEPQKCWKNNVGHCRRRCLDTERYILLCRNKLSCCISIISHEYTRRPAFPVIHLEDITLDYSDVDSFTGSPVSMLNDLITFDTTKFGETMTPETNTPETTMPPSEATTPETTMPPSETATSETMPPPSQTALTHN

SEQ ID NO: 4153 - protein, 111 aa, Homo Sapiens
MKSLLFTLAVFMLLAQLVSGNWYVKKCLNDVGICKKKCKPEEMHVKNGWAMCGKQRDCCVPADRRANYPVFCVQTKTTRISTVTATTATTTLMMTTASMSSMAPTPVSPTG

SEQ ID NO: 4154 - protein, 99 aa, Homo Sapiens
MGLFMIIAILLFQKPTVTEQLKKCWNNYVQGHCRKICRVNEVPEALCENGRYCCLNIKELEACKKITKPPRPKPATLALTLQDYVTIIENFPSLKTQST

SEQ ID NO: 4155 - protein, 93 aa, Homo Sapiens
MKLFLVLIILLFEVLTDGARLKKCFNKVTGYCRKKCKVGERYEIGCLSGKLCCANDEEEKKHVSFKKPHQHSGEKLSVLQDYIILPTITIFTV

SEQ ID NO: 4156 - protein, 183 aa, Homo Sapiens
MKLLFPIFASLMLQYQVNTEFIGLRRCLMGLGRCRDHCNVDEKEIQKCKMKKCCVGPKVVKLIKNYLQYGTPNVLNEDVQEMLKPAKNSSAVIQRKHILSVLPQIKSTSFFANTNFVIIPNATPMNSATISTMTPGQITYTATSTKSNTKESRDSATASPPPAPPPPNILPTPSLELEEAEEQ

SEQ ID NO: 4157 - protein, 79 aa, Homo Sapiens
MKLHSLISVLLLFVTLIPKGKTGVIPGQKQCIALKGVCRDKLCSTLDDTIGICNEGKKCCRRWWILEPYPTPVPKGKSP

SEQ ID NO: 4158 - protein, 79 aa, Homo Sapiens; identical to SEQ ID NO: 4157

SEQ ID NO: 4159 - protein, 70 aa, Homo Sapiens
MRVLFFVFGVLSLMFTVPPARSFISNDECPSEYYHCRLKCNADEHAIRYCADFSICCKLKIIEIDGQKKW

SEQ ID NO: 4160 - protein, 70 aa, Homo Sapiens
MRVLFFVFGVLSLMSTVPPTRSFTSNDECPSEYYHCRLKCNADEHAIRYCADFSICCKLKIIQIDGQKKW

SEQ ID NO: 4161 - protein, 95 aa, Homo Sapiens
MKFLLLVLAALGFLTQVIPASAGGSKCVSNTPGYCRTCCHWGETALFMCNASRKCCISYSFLPKPDLPQLIGNHWQSRRRNTQRKDKKQQTTVTS

SEQ ID NO: 4162 - protein, 61 aa, Homo Sapiens
MKIHVFLFVLFFFLVPIATRVKCAVKDTYSCFIMRGKCRHECHDFEKPIGFCTKLNANCYM

SEQ ID NO: 4163 - protein, 66 aa, Homo Sapiens
MKPLLVVFVFLFLWDPVLAGINSLSSEMHKKCYKNGICRLECYESEMLVAYCMFQLECCVKGNPAP

SEQ ID NO: 4164 - protein, 66 aa, Homo Sapiens; identical to SEQ ID NO: 4163

SEQ ID NO: 4165 - protein, 77 aa, Homo Sapiens
MATRSVLLALVVLNLLFYVPPGRSGPNVYIQKIFASCWRLQGTCRPKCLKNEQYRILCDTIHLCCVNPKYLPILTGK

SEQ ID NO: 4166 - protein, 78 aa, Homo Sapiens
MNLCLSALLFFLVILLPSGKGMFGNDGVKVRTCTSQKAVCFFGCPPGYRWIAFCHNILSCCKNMTRFQPPQAKDPWVH

SEQ ID NO: 4167 - protein, 64 aa, Homo Sapiens
MRVLYLLFSFLFIFLMPLPGVFGGIGDPVTCLKSGAICHPVFCPRRYKQIGTCGLPGTKCCKKP

SEQ ID NO: 4168 - protein, 64 aa, Homo Sapiens; identical to SEQ ID NO: 4167

SEQ ID NO: 4169 - protein, 84 aa, Homo Sapiens
MRSRLLLSVAHLPTIRETTEEMLLGGPGQEPPPSPSLDDYVRSISRLAQPTSVLDKATAQGQPRPPHRPAQACRKGRPAVSLRD

SEQ ID NO: 4170 - protein, 212 aa, Homo Sapiens
MRSRLLLSVAHLPTIRETTEEMLLGGPGQEPPPSPSLDDYVRSISRLAQPTSVLDKATAQGQPRPPHRPAQACRKGRPAVSLRDITARFSGQQPTLPMADTVDPLDWLFGESQEKQPSQRDLPRRTGPSAGLWGPHRQMDSSKPMGAPRGRLCEARMPGHSLARPPQDGQQSSDLRSWTFGQSAQAMASRHRPRPSSVLRTLYSHLPVIHEL

SEQ ID NO: 4171 - protein, 326 aa, Homo Sapiens
MSENDNVFCAQLQCFHFPTLRHHDLHSWHAESCYEKSSFLCKRSQTCVDIKDNVVDEGFYFTPKGDDPCLSCTCHGGEPEMCVAALCERPQGCQQYRKDPKECCKFMCLDPDGNSLFDSMASGMRLVVSCISSFLILSLLLFMVHRLRQRRRERIESLIGANLHHFNLGRRIPGFDYGPDGFGTGLTPLHLSDDGEGGTFHFHDPPPPYTAYKYPDIGQPDDPPPPYEASIHPDSVFYDPADDDAFEPVEVSLPAPGDGGSEGALLRRLEQPLPTAGASLADLEDSADSSSALLVPPDPAQSGSTPAAEALPGGGRHSRSSLNTVV

SEQ ID NO: 4172 - protein, 550 aa, Homo Sapiens
MVPKADSGAFLLLFLLVLTVTEPLRPELRCNPGQFACRSGTIQCIPLPWQCDGWATCEDESDEANCPEVTGEVRPHHGKEAVDPRQGRARGGDPSHFHAVNVAQPVRFSSFLGKCPTGWHHYEGTASCYRVYLSGENYWDAAQTCQRLNGSLATFSTDQELRFVLAQEWDQPERSFGWKDQRKLWVGYQYVITGRNRSLEGRWEVAFKGSSEVFLPPDPIFASAMSENDNVFCAQLQCFHFPTLRHHDLHSWHAESCYEKSSFLCKRSQTCVDIKDNVVDEGFYFTPKGDDPCLSCTCHGGEPEMCVAALCERPQGCQQYRKDPKECCKFMCLDPDGNSLFDSMASGMRLVVSCISSFLILSLLLFMVHRLRQRRRERIESLIGANLHHFNLGRRIPGFDYGPDGFGTGLTPLHLSDDGEGGTFHFHDPPPPYTAYKYPDIGQPDDPPPPYEASIHPDSVFYDPADDDAFEPVEVSLPAPGDGGSEGALLRRLEQPLPTAGASLADLEDSADSSSALLVPPDPAQSGSTPAAEALPGGGRHSRSSLNTVV

SEQ ID NO: 4173 - protein, 550 aa, Homo Sapiens [sequence omitted]

SEQ ID NO: 4174 - protein, 509 aa, Homo Sapiens
MVPKADSGAFLLLFLLVLTVTEPLRPEVTGEVRPHHGKEAVDPRQGRARGGDPSHFHAVNVAQPVRFSSFLGKCPTGWHHYEGTASCYRVYLSGENYWDAAQTCQRLNGSLATFSTDQELRFVLAQEWDQPERSFGWKDQRKLWVGYQYVITGRNRSLEGRWEVAFKGSSEVFLPPDPIFASAMSENDNVFCAQLQCFHFPTLRHHDLHSWHAESCYEKSSFLCKRSQTCVDIKDNVVDEGFYFTPKGDDPCLSCTCHGGEPEMCVAALCERPQGCQQYRKDPKECCKFMCLDPDGNSLFDSMASGMRLVVSCISSFLILSLLLFMVHRLRQRRRERIESLIGANLHHFNLGRRIPGFDYGPDGFGTGLTPLHLSDDGEGGTFHFHDPPPPYTAYKYPDIGQPDDPPPPYEASIHPDSVFYDPADDDAFEPVEVSLPAPGDGGSEGALLRRLEQPLPTAGASLADLEDSADSSSALLVPPDPAQSGSTPAAEALPGGGRHSRSSLNTVV

SEQ ID NO: 4175 - protein, 396 aa, Homo Sapiens
MALLTNLLPLCCLALLALPAQSCGPGRGPVGRRRYARKQLVPLLYKQFVPGVPERTLGASGPAEGRVARGSERFRDLVPNYNPDIIFKDEENSGADRLMTERCKERVNALAIAVMNMWPGVRLRVTEGWDEDGHHAQDSLHYEGRALDITTSDRDRNKYGLLARLAVEAGFDWVYYESRNHVHVSVKADNSLAVRAGGCFPGNATVRLWSGERKGLRELHRGDWVLAADASGRVVPTPVLLFLDRDLQRRASFVAVETEWPPRKLLLTPWHLVFAARGPAPAPGDFAPVFARRLRAGDSVLAPGGDALRPARVARVAREEAVGVFAPLTAHGTLLVNDVLASCYAVLESHQWAHRAFAPLRLLHALGALLPGGAVQPTGMHWYSRLLYRLAEELLG

SEQ ID NO: 4176 - protein, 155 aa, Homo Sapiens
MHKAGLLGLCARAWNSVRMASSGMTRRDPLANKVALVTASTDGIGFAIARRLAQDGAHVVVSSRKQQNVDQAVATLQGEGLSVTGTVCHVGKAEDRERLVATAVKLHGGIDILVSNAAVNPFFGSIMDVTEEVWDKLWMDKEKEESMKETLRIRR

SEQ ID NO: 4177 - protein, 192 aa, Homo Sapiens
MHKAGLLGLCARAWNSVRMASSGMTRRDPLANKVALVTASTDGIGFAIARRLAQDGAHVVVSSRKQQNVDQAVATLQGEGLSVTGTVCHVGKAEDRERLVATAVKLHGGIDILVSNAAVNPFFGSIMDVTEEVWDKLWMDKEKEESMKETLRIRRLGEPEDCAGIVSFLCSEDASYITGETVVVGGGTPSRL

SEQ ID NO: 4178 - protein, 188 aa, Homo Sapiens
MHKAGLLGLCARAWNSVRMASSGMTRRDPLANKVALVTASTDGIGFAIARRLAQDGAHVVVSSRKQQNVDQAVATLQGEGLSVTGTVCHVGKAEDRERLVATAVKLHGGIDILVSNAAVNPFFGSIMDVTEEVWDKRRLSGDRVFHSSLQSISSLDGQGKRGKHERNPADKKVRRARGLCWHRVFPVL

SEQ ID NO: 4179 - protein, 278 aa, Homo Sapiens
MHKAGLLGLCARAWNSVRMASSGMTRRDPLANKVALVTASTDGIGFAIARRLAQDGAHVVVSSRKQQNVDQAVATLQGEGLSVTGTVCHVGKAEDRERLVATAVKLHGGIDILVSNAAVNPFFGSIMDVTEEVWDKTLDINVKAPALMTKAVVPEMEKRGGGSVVIVSSIAAFSPSPGFSPYNVSKTALLGLTKTLAIELAPRNIRVNCLAPGLIKTSFSRMLWMDKEKEESMKETLRIRRLGEPEDCAGIVSFLCSEDASYITGETVVVGGGTPSRL

SEQ ID NO: 4180 - protein, 158 aa, Homo Sapiens
MHKAGLLGLCARAWNSVRMASSGMTRRDPLANKVALVTASTDGIGFAIARRLAQDGAHVVVSSRKQQNVDQAVATLQGEGLSVTGTVCHVGKAEDRERLVATLWMDKEKEESMKETLRIRRLGEPEDCAGIVSFLCSEDASYITGETVVVGGGTPSRL

SEQ ID NO: 4181 - protein, 244 aa, Homo Sapiens
MHKAGLLGLCARAWNSVRMASSGMTRRDPLANKVALVTASTDGIGFAIARRLAQDGAHVVVSSRKQQNVDQAVATLQGEGLSVTGTVCHVGKAEDRERLVATTLDINVKAPALMTKAVVPEMEKRGGGSVVIVSSIAAFSPSPGFSPYNVSKTALLGLTKTLAIELAPRNIRVNCLAPGLIKTSFSRMLWMDKEKEESMKETLRIRRLGEPEDCAGIVSFLCSEDASYITGETVVVGGGTPSRL

SEQ ID NO: 4182 - protein, 199 aa, Homo Sapiens
MHKAGLLGLCARAWNSVRMASSGMTRRDPLANKVALVTASTDGIGFAIARRLAQDGAHVVVSSRKQQNVDQAVATLQGEGLSVTGTVCHVGKAEDRERLVATTLDINVKAPALMTKAVVPEMEKRGGGSVVIVSSIAAFSPSPLWMDKEKEESMKETLRIRRLGEPEDCAGIVSFLCSEDASYITGETVVVGGGTPSRL

SEQ ID NO: 4183 - protein, 61 aa, Homo Sapiens
RNIRVNCLAPGLIKTSFSRMLWMDKEKEESMKETLRIRRPRIHKHYHYSDLSKKSASLSKG

SEQ ID NO: 4184 - protein, 90 aa, Homo Sapiens
MAVKLHGGIDILVSNAAVNPFFGSLMDVTEEVWDKGFSPYNVSKTALLGLNNTLAIELAPRNIRVNCLHLDLSRLASAGCSGWTRKKRKA

SEQ ID NO: 4185 - protein, 131 aa, Homo Sapiens
MAVKLHGGIDILVSNAAVNPFFGSLMDVTEEVWDKTLDINVKAPALMTKAVVPEMEKRGGGSVVIVSSIAAFSPSPGFSPYNVSKTALLGLNNTLAIELAPRNIRVNCLHLDLSRLASAGCSGWTRKKRKA

SEQ ID NO: 4186 - protein, 49 aa, Homo Sapiens
MDVTEEVWDKTLDINVKAPALMTKAVVPEMEKRGGGSVVIVSSIAAFSP

SEQ ID NO: 4187 - protein, 215 aa, Homo Sapiens
MPFPCLSLPSSWDYRIGFAIARRLAQDRAHVVVSSRKQQNVDQAVATLQGEGLSVTGTVCHVGKAEDRERLVAMTLDINVKAPALMTKAVVPEMEKRGGGSVVIVSSIAAFSPSPGFSPYNVSKTALLGLNNTLAIELAPRNIRVNCLPGLIKTSFSRMLWMDKEKEESMKETLRIRRLGEPEDCAGIVSFLCSEDASYITGETVVVGGGTPSRL

SEQ ID NO: 4188 - protein, 192 aa, Homo Sapiens
MQMARLLGLCAWARKSVRMASSRMTRRDPLTNKVALVTASTDGIGFAIARRLAQDRAHVVVSSRKQQNVDQAVATLQGEGLSVTGTVCHVGKAEDRERLVAMAVKLHGGIDILVSNAAVNPFFGSLMDVTEEVWDKLWMDKEKEESMKETLRIRRLGEPEDCAGIVSFLCSEDASYITGETVVVGGGTPSRL

SEQ ID NO: 4189 - protein, 232 aa, Homo Sapiens
MQMARLLGLCAWARKSVRMASSRMTRRDPLTNKVALVTASTDGIGFAIARRLAQDRAHVVVSSRKQQNVDQAVATLQGEGLSVTGTVCHVGKAEDRERLVAMAVKLHGGIDILVSNAAVNPFFGSLMDVTEEVWDKTLDINVKAPALMTKAVVPEMEKRGGGSVVIVSSIAAFSPSPGFSPYNVSKTALLGLNNTLAIELAPRNIRVNCLHLDLSRLASAGCSGWTRKKRKA

SEQ ID NO: 4190 - protein, 242 aa, Homo Sapiens
MQMARLLGLCAWARKSVRMASSRMTRRDPLTNKVALVTASTDGIGFAIARRLAQDRAHVVVSSRKQQNVDQAVATLQGEGLSVTGTVCHVGKAEDRERLVAMAVKLHGGIDILVSNAAVNPFFGSLMDVTEEVWDKTLDINVKAPALMTKAVVPEMEKRGGGSVVIVSSIAAFSPSPGFSPYNVSKTALLGLNNTLAIELAPRNIRVNCLHLDLSRLASAGWLGEPEDCAGIVSFLCSEDAS

SEQ ID NO: 4191 - protein, 157 aa, Homo Sapiens
MQMARLLGLCAWARKSVRMASSRMTRRDPLTNKVALVTASTDGIGFAIARRLAQDRAHVVVSSRKQQNVDQAVATLQGEGLSVTGTVCHVGKAEDRERLVAMGFSPYNVSKTALLGLNNTLAIELAPRNIRVNCLHLDLSRLASAGCSGWTRKKRKA

SEQ ID NO: 4192 - protein, 157 aa, Homo Sapiens; identical to SEQ ID NO: 4191

SEQ ID NO: 4193 - protein, 109 aa, Homo Sapiens
  misc_feature (1)..(1): Xaa can be any naturally occurring amino acid
XSLMDVTEEVWDKTLDINVKAPALMTKAVVPEMEKRGGGSVVIVSSIAAFSPSPGFSPYNVSKTALLGLNNTLAIELAPRNIRVNCLHLDLSRLASAGCSGWTRKKRKA

SEQ ID NO: 4194 - protein, 61 aa, Homo Sapiens
MNWELLLWLLVLCALLLLLVQLLRFLRADGDLTLLWAEWQGRRPEWELTDMVVWVTGASSG

SEQ ID NO: 4195 - protein, 339 aa, Homo Sapiens
MNWELLLWLLVLCALLLLLVQLLRFLRADGDLTLLWAEWQGRRPEWELTDMVVWVTGASSGIGEELAYQLSKLGVSLVLSARRVHELERVKRRCLENGNLKEKDILVLPLDLTDTGSHEAATKAVLQEFGRIDILVNNGGMSQRSLCMDTSLDVYRKLIELNYLGTVSLTKCVLPHMIERKQGKIVTVNSILGIISVPLSIGYCASKHALRGFFNGLRTELATYPGIIVSNICPGPVQSNIVENSLAGEVTKTIGNNGDQSHKMTTSRCVRLMLISMANDLKEVWISEQPFLLVTYLWQYMPTWAWWITNKMGKKRIENFKSGVDADSSYFKIFKTKHD

SEQ ID NO: 4196 - protein, 339 aa, Homo Sapiens; identical to SEQ ID NO: 4195

SEQ ID NO: 4197 - protein, 376 aa, Homo Sapiens
MNWELLLWLLVLCALLLLLVQLLRFLRADGDLTLLWAEWQGRRPEWELTDMVVWVTGASSGIGEELAYQLSKLGVSLVLSARRVHELERVKRRCLENGNLKEKDILVLPLDLTDTGSHEAATKAVLQEFGRIDILVNNGGMSQRSLCMDTSLDVYRKLIELNYLGTVSLTKCVLPHMIERKQGKIVTVNSILGIISVPLSIGYCASKHALRGFFNGLRTELATYPGIIVSNICPGPVQSNIVENSLAGEVTKTIGNNGDQSHKMTTSRCVRLMLISMANDLKEVWISEQPFLLVTYLWQYMPTWAWWITTRWGRKGLRTLRVVWMQTLLILKSLRQNMTEKSTCTFQATGGRNGKHENSNLLMLLNNQRLICDFTF

SEQ ID NO: 4198 - protein, 289 aa, Homo Sapiens
MVVWVTGASSGIGEELAYQLSKLGVSLVLSARRVHELERVKRRCLENGNLKEKDILVLPLDLTDTGSHEAATKAVLQEFGRIDILVNNGGMSQRSLCMDTSLDVYRKLIELNYLGTVSLTKCVLPHMIERKQGKIVTVNSILGIISVPLSIGYCASKHALRGFFNGLRTELATYPGIIVSNICPGPVQSNIVENSLAGEVTKTIGNNGDQSHKMTTSRCVRLMLISMANDLKEVWISEQPFLLVTYLWQYMPTWAWWITNKMGKKRIENFKSGVDADSSYFKIFKTKHD

SEQ ID NO: 4199 - protein, 212 aa, Homo Sapiens
  misc_feature (1)..(1): Xaa can be any naturally occurring amino acid
XILVNNGGMSQRSLCMDTSLDVYRKLIELNYLGTVSLTKCVLPHMIERKQGKIVTVNSILGIISVPLSIGYCASKHALRGFFNGLRTELATYPGIIVSNICPGPVQSNIVENSLAGEVTKTIGNNGDQSHKMTTSRCVRLMLISMANDLKEVWISEQPFLMQTLLILKSLRQNMTEKSTCTFQATGGRNGKHENSNLLMLLNNQRLICDFTF

SEQ ID NO: 4200 - protein, 399 aa, Homo Sapiens
  misc_feature (1)..(1): Xaa can be any naturally occurring amino acid
XLWLLVLCALLLLLVQLLRFLRADGDLTLLWAEWQGRRPEWELTDMVVWVTGASSGIGEELAYQLSKLGVSLVLSARRVHELERVKRRCLENGNLKEKDILVLPLDLTDTGSHEAATKAVLQEFGRIDILVNNGGMSQRSLCMDTSLDVYRKLIELNYLGTVSLTKCVLPHMIERKQGKIVTVNSILGIISVPLSIGYCASKHALRGFFNGLRTELATYPGIIVSNICPGPVQSNIVENSLAGEVTKTIGNNGDQSHKMTTSRCVRLMLISMANDLKEVWISEQPFLLVTYLWQYMPTWAWWITNKMGKKRIENFKSGVVRPISKFLNSMYQSCRKVQNFPVFKKLSGWVQWLMSVIPALWEAKADHLRPGVQDQPGQHSETPSLLKIQKVAGHGGACL

SEQ ID NO: 4201 - protein, 160 aa, Homo Sapiens
  misc_feature (1)..(1): Xaa can be any naturally occurring amino acid
XNWELLLWLLVLCALLLLLVQLLRFLRADGDLTLLWAEWQGRRPEWELTDMVVWVTGASSGIGEELAYQLSKLGVSLVLSARRVHELERVKRRCLENGNLKEKDILVLPLDLTDTGSHEAATKAVLQEFGRGFFNGLRTELATYPGIIVSNICPGPVQSN

SEQ ID NO: 4202 - protein, 312 aa, Homo Sapiens
MGVMAMLMLPLLLLGISGLLFIYQEVSRLWSKSAVQNKVVVITDAISGLGKECARVFHTGGARLVLCGKNWERLENLYDALISVADPSKQTFTPKLVLLDLSDISCVPDVAKEVLDCYGCVDILINNASVKVKGPAHKISLELDKKIMDANYFGPITLTKALLPNMISRRTGQIVLVNNIQGKFGIPFRTTYAASKHAALGFFDCLRAEVEEYDVVISTVSPTFIRSYHVYPEQGNWEASIWKFFFRKLTYGVHPVEVAEEVMRTVRRKKQEVFMANPIPKAAVYVRTFFPEFFFAVVACGVKEKLNVPEEG

SEQ ID NO: 4203 - protein, 311 aa, Homo Sapiens
MGVMAMLMLPLLLLGISGLLFIYQEVSRLWSKSAVQNKVVVITDAISGLGKECARVFHTGGARLVLCGKNWERLENLYDALISVADPSKTFTPKLVLLDLSDISCVPDVAKEVLDCYGCVDILINNASVKVKGPAHKISLELDKKIMDANYFGPITLTKALLPNMISRRTGQIVLVNNIQGKFGIPFRTTYAASKHAALGFFDCLRAEVEEYDVVISTVSPTFIRSYHVYPEQGNWEASIWKFFFRKLTYGVHPVEVAEEVMRTVRRKKQEVFMANPIPKAAVYVRTFFPEFFFAVVACGVKEKLNVPEEG

SEQ ID NO: 4204 - protein, 132 aa, Homo Sapiens
SVKVKGPAHKISLELDKKIMDANYFGPITLTKALLPNMISRRTGQIVLVNNIQGKFGIPFRTTFFFRKLTYGVHPVEVAEEVMRTVRRKKQEVFMANPIPKAAVYVRTFFPEFFFAVVACGVKEKLNVPEEG

SEQ ID NO: 4205 - protein, 66 aa, Homo Sapiens
MLFWVLGLLILCGFLWTRKGKLKIEDITDKYIFITGCDSGFGNLAARTFDKKGFHVIAACLTESGS

SEQ ID NO: 4206 - protein, 319 aa, Homo Sapiens
MLFWVLGLLILCGFLWTRKGKLKIEDITDKYIFITGCDSGFGNLAARTFDKKGFHVIAACLTESGSTALKAETSERLRTVLLDVTDPENVKRTAQWVKNQVGEKGLWGLINNAGVPGVLAPTDWLTLEDYREPIEVNLFGLISVTLNMLPLVKKAQGRVINVSSVGGRLAIVGGGYTPSKYAVEGFNDSLRRDMKAFGVHVSCIEPGLFKTNLADPVKVIEKKLAIWEQLSPDIKQQYGEGYIEKSLDKLKGNKSYVNMDLSPVVECMDHALTSLFPKTHYAAGKDAKIFWIPLSHMPAALQDFLLLKQKAELANPKAV

SEQ ID NO: 4207 - protein, 319 aa, Homo Sapiens; identical to SEQ ID NO: 4206

SEQ ID NO: 4208 - protein, 319 aa, Homo Sapiens; identical to SEQ ID NO: 4206

SEQ ID NO: 4209 - protein, 319 aa, Homo Sapiens; identical to SEQ ID NO: 4206

SEQ ID NO: 4210 - protein, 319 aa, Homo Sapiens; identical to SEQ ID NO: 4206

SEQ ID NO: 4211 - protein, 172 aa, Homo Sapiens
MLPLVKKAQGRVINVSSVGGRLAIVGGGYTPSKYAVEGFNDSLRRDMKAFGVHVSCIEPGLFKTNLADPVKVIEKKLAIWEQLSPDIKQQYGEGYIEKSLDKLKGNKSYVNMDLSPVVECMDHALTSLFPKTHYAAGKDAKIFWIPLSHMPAALQDFLLLKQKAELANPKAV

SEQ ID NO: 4212 - protein, 379 aa, Homo Sapiens
MPEGRSHCACSITSLTLLVSLTRVTLDILQKLDPPQPAHWRHHLLVLYKKGVYLSHTGGKMLFWVLGLLILCGFLWTRKGKLKIEDITDKYIFITGCDSGFGNLAARTFDKKGFHVIAACLTESGSTALKAETSERLRTVLLDVTDPENVKRTAQWVKNQVGEKGLWGLINNAGVPGVLAPTDWLTLEDYREPIEVNLFGLISVTLNMLPLVKKAQGRVINVSSVGGRLAIVGGGYTPSKYAVEGFNDSLRRDMKAFGVHVSCIEPGLFKTNLADPVKVIEKKLAIWEQLSPDIKQQYGEGYIEKSLDKLKGNKSYVNMDLSPVVECMDHALTSLFPKTHYAAGKDAKIFWIPLSHMPAALQDFLLLKQKAELANPKAV

SEQ ID NO: 4213 - protein, 122 aa, Homo Sapiens
MHVIIAGNNDSKAKQVVSKIKEETLNDKVEFLYCDLASMTSIRQFVQKFKMKKIPLHVLINNAGVMMVPQRKTRDGFEEHFGLNYLGHFLLTNLLLDTLKESGSPGHSARVVTVSSATHYVA

SEQ ID NO: 4214 - protein, 63 aa, Homo Sapiens
MPVFPPRPDRVAIVTGGTDGIGYSTAKHLARLGMHVIIAGNNDSKAKQVVSKIKEETLNDKET

SEQ ID NO: 4215 - protein, 330 aa, Homo Sapiens
MSPLSAARAALRVYAVGAAVILAQLLRRCRGGFLEPVFPPRPDRVAIVTGGTDGIGYSTAKHLARLGMHVIIAGNNDSKAKQVVSKIKEETLNDKVEFLYCDLASMTSIRQFVQKFKMKKIPLHVLINNAGVMMVPQRKTRDGFEEHFGLNYLGHFLLTNLLLDTLKESGSPGHSARVVTVSSATHYVAELNMDDLQSSACYSPHAAYAQSKLALVLFTYHLQRLLAAEGSHVTANVVDPGVVNTDVYKHVFWATRLAKKLLGWLLFKTPDEGAWTSIYAAVTPELEGVGGHYLYNEKETKSLHVTYNQKLQQQLWSKSCEMTGVLDVTL

SEQ ID NO: 4216 - protein, 232 aa, Homo Sapiens
MSPLSAARAALRVYAVGAAVILAQLLRRCRGGFLEPVFPPRPDRVAIVTGGTDGIGYSTAKHLARLGMHVIIVEFLYCDLASMTSIRQFVQKFKMKKIPLHVLINNAGVMMVPQRKTRDGFEEHFGLNYLGHFLLTNLLLDTLKESGSPGHSARVVTVSSATHYVAELNMDDLQSSACYSPHAAYAQSKLALVLFTYHLQRLLAAEGSHVTANVVDPGVVNTDVYKHVFWAT

SEQ ID NO: 4217 - protein, 154 aa, Homo Sapiens
  misc_feature (1)..(1): Xaa can be any naturally occurring amino acid
XPARPGPTLPSPRVWPPRLSRVGLQPSSPRAAAPPRTLTPPGHGRGPGGSHAPRPRHQAALPAACGRPVTARPRQAPEGRSGRPRDLDPYPPQVFPPRPDRVAIVTGGTDGIGYSTAKHLARLGMHVIIAGNNDSKAKQVVSKIKEETLNDKET

SEQ ID NO: 4218 - protein, 1369 aa, Homo Sapiens
MGGKNKKHKAPAAAVVRAAVSASRAKSAEAGIAGEAQSKKPVSRPATAAAAAAGSREPRVKQGPKIYSFNSTNDSSGPANLDKSILKVVINNKLEQRIIGVINEHKKQNNDKGMISGRLTAKKLQDLYMALQAFSFKTKDIEDAMTNTLLYGGDLHSALDWLCLNLSDDALPEGFSQEFEEQQPKSRPKFQSPQIQATISPPLQPKTKTYEEDPKSKPKKEEKNMEVNMKEWILRYAEQQNEEEKNENSKSLEEEEKFDPNERYLHLAAKLLDAKEQAATFKLEKNKQGQKEAQEKIRKFQREMETLEDHPVFNPAMKISHQQNERKKPPVATEGESALNFNLFEKSAAATEEEKDKKKEPHDVRNFDYTARSWTGKSPKQFLIDWVRKNLPKSPNPSFEKVPVGRYWKCRVRVIKSEDDVLVVCPTILTEDGMQAQHLGATLALYRLVKGQSVHQLLPPTYRDVWLEWSDAEKKREELNKMETNKPRDLFIAKLLNKLKQQQQQQQQHSENKRENSEDPEESWENLVSDEDFSALSLESANVEDLEPVRNLFRKLQSTPKYQKLLKERQQLPVFKHRDSIVETLKRHRVVVVAGETGSGKSTQVPHFLLEDLLLNEWEASKCNIVCTQPRRISAVSLANRVCDELGCENGPGGRNSLCGYQIRMESRACESTRLLYCTTGVLLRKLQEDGLLSNVSHVIVDEVHERSVQSDFLLIILKEILQKRSDLHLILMSATVDSEKFSTYFTHCPILRISGRSYPVEVFHLEDIIEETGFVLEKDSEYCQKFLEEEEEVTINVTSKAGGIKKYQEYIPVQTGAHADLNPFYQKYSSRTQHAILYMNPHKINLDLILELLAYLDKSPQFRNIEGAVLIFLPGLAHIQQLYDLLSNDRRFYSERYKVIALHSILSTQDQAAAFTLPPPGVRKIVLATNIAETGITIPDVVFVIDTGRTKENKYHESSQMSSLVETFVSKASALQRQGRAGRVRDGFCFRMYTRERFEGFMDYSVPEILRVPLEELCLHIMKCNLGSPEDFLSKALDPPQLQVISNAMNLLRKIGACELNEPKLTPLGQHLAALPVNVKIGKMLIFGAIFGCLDPVATLAAVMTEKSPFTTPIGRKDEADLAKSALAMADSDHLTIYNAYLGWKKARQEGGYRSEITYCRRNFLNRTSLLTLEDVKQELIKLVKAAGFSSSTTSTSWEGNRASQTLSFQEIALLKAVLVAGLYDNVGKIIYTKSVDVTEKLACIVETAQGKAQVHPSSVNRDLQTHGWLLYQEKIRYARVYLRETTLITPFPVLLFGGDIEVQHRERLLSIDGWIYFQAPVKIAVIFKQLRVLIDSVLRKKLENPKMSLENDKILQIITELIKTENN

SEQ ID NO: 4219 - protein, 1370 aa, Homo Sapiens
MGGKNKKHKAPAAAVVRAAVSASRAKSAEAGIAGEAQSKKPVSRPATAAAAAAGSREPRVKQGPKIYSFNSTNDSSGPANLDKSILKVVINNKLEQRIIGVINEHKKQNNDKGMISGRLTAKKLQDLYMALQAFSFKTKDIEDAMTNTLLYGGDLHSALDWLCLNLSDDALPEGFSQEFEEQQPKSRPKFQSPQIQATISPPLQPKTKTYEEDPKSKPKKEEKNMEVNMKEWILRYAEQQNEEEKNENSKSLEEEEKFDPNERYLHLAAKLLDAKEQAATFKLEKNKQGQKEAQEKIRKFQREMETLEDHPVFNPAMKISHQQNERKKPPVATEGESALNFNLFEKSAAATEEEKGKKKEPHDVRNFDYTARSWTGKSPKQFLIDWVRKNLPKSPNPSFEKVPVGRYWKCRVRVIKSEDDVLVVCPTILTEDGMQAQHLGATLALYRLVKGQSVHQLLPPTYRDVWLEWSDAEKKREELNKMETNKPRDLFIAKLLNKLKQQQQQQQQHSENKRENSEDPEESWENLVSDEDFSALSLESANVEDLEPVRNLFRKLQSTPKYQKLLKERQQLPVFKHRDSIVETLKRHRVVVVAGETGSGKSTQVPHFLLEDLLLNEWEASKCNIVCTQPRRISAVSLANRVCDELGCENGPGGRNSLCGYQIRMESRACESTRLLYCTTGVLLRKLQEDGLLSNVSHVIVDEVHERSVQSDFLLIILKEILQKRSDLHLILMSATVDSEKFSTYFTHCPILRISGRSYPVEVFHLEDIIEETGFVLEKDSEYCQKFLEEEEEVTINVTSKAGGIKKYQEYIPVQTGAHADLNPFYQKYSSRTQHAILYMNPHKINLDLILELLAYLDKSPQFRNIEGAVLIFLPGLAHIQQLYDLLSNDRRFYSERYKVIALHSILSTQDQAAAFTLPPPGVRKIVLATNIAETGITIPDVVFVIDTGRTKENKYHESSQMSSLVETFVSKASALQRQGRAGRVRDGFCFRMYTRERFEGFMDYSVPEILRVPLEELCLHIMKCNLGSPEDFLSKALDPPQLQVISNAMNLLRKIGACELNEPKLTPLGQHLAALPVNVKIGKMLIFGAIFGCLDPVATLAAVMTEKSPFTTPIGRKDEADLAKSALAMADSDHLTIYNAYLGWKKARQEGGYRSEITYCRRNFLNRTSLLTLEDVKQELIKLVKAAGFSSSTTSTSWEGNRASQTLSFQEIALLKAVLVAGLYDNVGKIIYTKSVDVTEKLACIVETAQGKAQVHPSSVNRDLQTHGWLLYQEKIRYARVYLRETTLITPFPVLLFGGDIEVQHRERLLSIDGWIYFQAPVKIAVIFKQLRVLIDSVLRKKLENPKMSLENDKILQIITELIKTENNN

SEQ ID NO: 4220 - protein, 160 aa, Homo Sapiens
  misc_feature (1)..(1): Xaa can be any naturally occurring amino acid
XRPRWSGPPCLLPEPNLPRLELPGRPKARSQCPGRPPLPLPLPAPGSPVSSKVVINNKLEQRIIGVINEHKKQNNDKGMISGRLTAKKLQDLYMALQAFSFKTKDIEDAMTNTLLYGGDLHSALDWLCLNLSDDALPEGFSQEFEEQQPKSRPKFQSPQI

SEQ ID NO: 4221 - protein, 1222 aa, Homo Sapiens
MAAARRLMALAAGISPRLQPLGPRAAGRQGRSRGFSSSCAHPDHTKEAAEAESGMAPGGPGEGDGSLVNASRDLLKEFPQPKNLLNSVIGRALGISHAKDKLVYVHTNGPKKKKVTLHIKWPKSVEVEGYGSKKIDAERQAAAAACQLFKGWGLLGPRNELFDAAKYRVLADRFGSPADSWWRPEPTMPPTSWRQLNPESIRPGGPGGLSRSLGREEEEDEEEELEEGTIDVTDFLSMTQQDSHAPLRDSRGSSFEMTDDDSAIRALTQFPLPKNLLAKVIQIATSSSTAKNLMQFHTVGTKTKLSTLTLLWPCPMTFVAKGRRKAEAENKAAALACKKLKSLGLVDRNNEPLTHAMYNLASLRELGETQRRPCTIQVPEPILRKIETFLNHYPVESSWIAPELRLQSDDILPLGKDSGPLSDPITGKPYVPLLEAEEVRLSQSLLELWRRRGPVWQEAPQLPVDPHRDTILNAIEQHPVVVISGDTGCGKTTRIPQLLLERYVTEGRGARCNVIITQPRRISAVSVAQRVSHELGPSLRRNVGFQVRLESKPPSRGGALLFCTVGILLRKLQSNPSLEGVSHVIVDEVHERDVNTDFLLILLKGLQRLNPALRLVLMSATGDNERFSRYFGGCPVIKVPGFMYPVKEHYLEDILAKLGKHQYLHRHRHHESEDECALDLDLVTDLVLHIDARGEPGGILCFLPGWQEIKGVQQRLQEALGMHESKYLILPVHSNIPMMDQKAIFQQPPVGVRKIVLATNIAETSITINDIVHVVDSGLHKEERYDLKTKVSCLETVWVSRANVIQRRGRAGRCQSGFAYHLFPRSRLEKMVPFQVPEILRTPLENLVLQAKIHMPEKTAVEFLSKAVDSPNIKAVDEAVILLQEIGVLDQREYLTTLGQRLAHISTDPRLAKAIVLAAIFRCLHPLLVVVSCLTRDPFSSSLQNRAEVDKVKALLSHDSGSDHLAFVRAVAGWEEVLRWQDRSSRENYLEENLLYAPSLRFIHGLIKQFSENIYEAFLVGKPSDCTLASAQCNEYSEEEELVKGVLMAGLYPNLIQVRQGKVTRQGKFKPNSVTYRTKSGNILLHKSTINREATRLRSRWLTYFMAVKSNGSVFVRDSSQVHPLAVLLLTDGDVHIRDDGRRATISLSDSDLLRLEGDSRTVRLLKELRRALGRMVERSLRSELAALPPSVQEEHGQLLALLAELLRGPCGSFDVRKTADD

SEQ ID NO: 4222 - protein, 1155 aa, Homo Sapiens
MAASRDLLKEFPQPKNLLNSVIGRALGISHAKDKLVYVHTNGPKKKKVTLHIKWPKSVEVEGYGSKKIDAERQAAAAACQLFKGWGLLGPRNELFDAAKYRVLADRFGSPADSWWRPEPTMPPTSWRQLNPESIRPGGPGGLSRSLGREEEEDEEEELEEGTIDVTDFLSMTQQDSHAPLRDSRGSSFEMTDDDSAIRALTQFPLPKNLLAKVIQIATSSSTAKNLMQFHTVGTKTKLSTLTLLWPCPMTFVAKGRRKAEAENKAAALACKKLKSLGLVDRNNEPLTHAMYNLASLRELGETQRRPCTIQVPEPILRKIETFLNHYPVESSWIAPELRLQSDDILPLGKDSGPLSDPITGKPYVPLLEAEEVRLSQSLLELWRRRGPVWQEAPQLPVDPHRDTILNAIEQHPVVVISGDTGCGKTTRIPQLLLERYVTEGRGARCNVIITQPRRISAVSVAQRVSHELGPSLRRNVGFQVRLESKPPSRGGALLFCTVGILLRKLQSNPSLEGVSHVIVDEVHERDVNTDFLLILLKGLQRLNPALRLVLMSATGDNERFSRYFGGCPVIKVPGFMYPVKEHYLEDILAKLGKHQYLHRHRHHESEDECALDLDLVTDLVLHIDARGEPGGILCFLPGWQEIKGVQQRLQEALGMHESKYLILPVHSNIPMMDQKAIFQQPPVGVRKIVLATNIAETSITINDIVHVVDSGLHKEERYDLKTKVSCLETVWVSRANVIQRRGRAGRCQSGFAYHLFPRSRLEKMVPFQVPEILRTPLENLVLQAKIHMPEKTAVEFLSKAVDSPNIKAVDEAVILLQEIGVLDQREYLTTLGQRLAHISTDPRLAKAIVLAAIFRCLHPLLVVVSCLTRDPFSSSLQNRAEVDKVKALLSHDSGSDHLAFVRAVAGWEEVLRWQDRSSRENYLEENLLYAPSLRFIHGLIKQFSENIYEAFLVGKPSDCTLASAQCNEYSEEEELVKGVLMAGLYPNLIQVRQGKVTRQGKFKPNSVTYRTKSGNILLHKSTINREATRLRSRWLTYFMAVKSNGSVFVRDSSQVHPLAVLLLTDGDVHIRDDGRRATISLSDSDLLRLEGDSRTVRLLKELRRALGRMVERSLRSELAALPPSVQEEHGQLLALLAELLRGPCGSFDVRKTADD

SEQ ID NO: 4223 - protein, 1166 aa, Homo Sapiens
MCVNPTPGGTISRASRDLLKEFPQPKNLLNSVIGRALGISHAKDKLVYVHTNGPKKKKVTLHIKWPKSVEVEGYGSKKIDAERQAAAAACQLFKGWGLLGPRNELFDAAKYRVLADRFGSPADSWWRPEPTMPPTSWRQLNPESIRPGGPGGLSRSLGREEEEDEEEELEEGTIDVTDFLSMTQQDSHAPLRDSRGSSFEMTDDDSAIRALTQFPLPKNLLAKVIQIATSSSTAKNLMQFHTVGTKTKLSTLTLLWPCPMTFVAKGRRKAEAENKAAALACKKLKSLGLVDRNNEPLTHAMYNLASLRELGETQRRPCTIQVPEPILRKIETFLNHYPVESSWIAPELRLQSDDILPLGKDSGPLSDPITGKPYVPLLEAEEVRLSQSLLELWRRRGPVWQEAPQLPVDPHRDTILNAIEQHPVVVISGDTGCGKTTRIPQLLLERYVTEGRGARCNVIITQPRRISAVSVAQRVSHELGPSLRRNVGFQVRLESKPPSRGGALLFCTVGILLRKLQSNPSLEGVSHVIVDEVHERDVNTDFLLILLKGLQRLNPALRLVLMSATGDNERFSRYFGGCPVIKVPGFMYPVKEHYLEDILAKLGKHQYLHRHRHHESEDECALDLDLVTDLVLHIDARGEPGGILCFLPGWQEIKGVQQRLQEALGMHESKYLILPVHSNIPMMDQKAIFQQPPVGVRKIVLATNIAETSITINDIVHVVDSGLHKEERYDLKTKVSCLETVWVSRANVIQRRGRAGRCQSGFAYHLFPRSRLEKMVPFQVPEILRTPLENLVLQAKIHMPEKTAVEFLSKAVDSPNIKAVDEAVILLQEIGVLDQREYLTTLGQRLAHISTDPRLAKAIVLAAIFRCLHPLLVVVSCLTRDPFSSSLQNRAEVDKVKALLSHDSGSDHLAFVRAVAGWEEVLRWQDRSSRENYLEENLLYAPSLRFIHGLIKQFSENIYEAFLVGKPSDCTLASAQCNEYSEEEELVKGVLMAGLYPNLIQVRQGKVTRQGKFKPNSVTYRTKSGNILLHKSTINREATRLRSRWLTYFMAVKSNGSVFVRDSSQVHPLAVLLLTDGDVHIRDDGRRATISLSDSDLLRLEGDSRTVRLLKELRRALGRMVERSLRSELAALPPSVQEEHGQLLALLAELLRGPCGSFDVRKTADD

SEQ ID NO: 4224 - protein, 1194 aa, Homo Sapiens
MFSLDSFRKDRAQHRQRQCKLPPPRLPPMCVNPTPGGTISRASRDLLKEFPQPKNLLNSVIGRALGISHAKDKLVYVHTNGPKKKKVTLHIKWPKSVEVEGYGSKKIDAERQAAAAACQLFKGWGLLGPRNELFDAAKYRVLADRFGSPADSWWRPEPTMPPTSWRQLNPESIRPGGPGGLSRSLGREEEEDEEEELEEGTIDVTDFLSMTQQDSHAPLRDSRGSSFEMTDDDSAIRALTQFPLPKNLLAKVIQIATSSSTAKNLMQFHTVGTKTKLSTLTLLWPCPMTFVAKGRRKAEAENKAAALACKKLKSLGLVDRNNEPLTHAMYNLASLRELGETQRRPCTIQVPEPILRKIETFLNHYPVESSWIAPELRLQSDDILPLGKDSGPLSDPITGKPYVPLLEAEEVRLSQSLLELWRRRGPVWQEAPQLPVDPHRDTILNAIEQHPVVVISGDTGCGKTTRIPQLLLERYVTEGRGARCNVIITQPRRISAVSVAQRVSHELGPSLRRNVGFQVRLESKPPSRGGALLFCTVGILLRKLQSNPSLEGVSHVIVDEVHERDVNTDFLLILLKGLQRLNPALRLVLMSATGDNERFSRYFGGCPVIKVPGFMYPVKEHYLEDILAKLGKHQYLHRHRHHESEDECALDLDLVTDLVLHIDARGEPGGILCFLPGWQEIKGVQQRLQEALGMHESKYLILPVHSNIPMMDQKAIFQQPPVGVRKIVLATNIAETSITINDIVHVVDSGLHKEERYDLKTKVSCLETVWVSRANVIQRRGRAGRCQSGFAYHLFPRSRLEKMVPFQVPEILRTPLENLVLQAKIHMPEKTAVEFLSKAVDSPNIKAVDEAVILLQEIGVLDQREYLTTLGQRLAHISTDPRLAKAIVLAAIFRCLHPLLVVVSCLTRDPFSSSLQNRAEVDKVKALLSHDSGSDHLAFVRAVAGWEEVLRWQDRSSRENYLEENLLYAPSLRFIHGLIKQFSENIYEAFLVGKPSDCTLASAQCNEYSEEEELVKGVLMAGLYPNLIQVRQGKVTRQGKFKPNSVTYRTKSGNILLHKSTINREATRLRSRWLTYFMAVKSNGSVFVRDSSQVHPLAVLLLTDGDVHIRDDGRRATISLSDSDLLRLEGDSRTVRLLKELRRALGRMVERSLRSELAALPPSVQEEHGQLLALLAELLRGPCGSFDVRKTADD

SEQ ID NO: 4225 - protein, 1194 aa, Homo Sapiens; identical to SEQ ID NO: 4224

SEQ ID NO: 4226 - protein, 42 aa, Homo Sapiens
MFSLDSFRKDRAQHRQRQCKLPPPRLPPMCVNPTPGGTISRG

SEQ ID NO: 4227 - protein, 42 aa, Homo Sapiens; identical to SEQ ID NO: 4226

SEQ ID NO: 4228 - protein, 42 aa, Homo Sapiens; identical to SEQ ID NO: 4226

SEQ ID NO: 4229 - protein, 138 aa, Homo Sapiens
KAKFHQTEGDHLTLLAVYNSWKNNKFSNPWCYENFIQARSLRRAQDIRKQMLGIMDRHKLDVVSCGKSTVRVQKAICSGFFRNAAKKDPQEGYRTLIDQQVVYIHPSSALFNRQPEWDLYSRFSEWKSGTNCSSLSGT

SEQ ID NO: 4230 - protein, 1220 aa, Homo Sapiens [sequence omitted]

SEQ ID NO: 4231 - protein, 1181 aa, Homo Sapiens
MAVAVAMAGALIGSEPGPAEELAKLEYLSLVSKVCTELDNHLGINDKDLAEFVISLAEKNTTFDTFKASLVKNGAEFTDSLISNLLRLIQTMRPPAKPSTSKDPVVKPKTEKEKLKELFPVLCQPDNPSVRTMLDEDDVKVAVDVLKELEALMPSAAGQEKQRDAEHRDRTKKKKRSRSRDRNRDRDRDRERNRDRDHKRRHRSRSRSRSRTRERNKVKSRYRSRSRSQSPPKDRKDRDKYGERNLDRWRDKHVDRPPPEEPTIGDIYNGKVTSIMQFGCFVQLEGLRKRWEGLVHISELRREGRVANVADVVSKGQRVKVKVLSFTGTKTSLSMKDVDQETGEDLNPNRRRNLVGETNEETSMRNPDRPTHLSLVSAPEVEDDSLERKRLTRISDPEKWEIKQMIAANVLSKEEFPDFDEETGILPKVDDEEDEDLEIELVEEEPPFLRGHTKQSMDMSPIKIVKNPDGSLSQAAMMQSALAKERRELKQAQREAEMDSIPMGLNKHWVDPLPDAEGRQIAANMRGIGMMPNDIPEWKKHAFGGNKASYGKKTQMSILEQRESLPIYKLKEQLVQAVHDNQILIVIGETGSGKTTQITQYLAEAGYTSRGKIGCTQPRRVAAMSVAKRVSEEFGCCLGQEVGYTIRFEDCTSPETVIKYMTDGMLLRECLIDPDLTQYAIIMLDEAHERTIHTDVLFGLLKKTVQKRQDMKLIVTSATLDAVKFSQYFYEAPIFTIPGRTYPVEILYTKEPETDYLDASLITVMQIHLTEPPGDILVFLTGQEEIDTACEILYERMKSLGPDVPELIILPVYSALPSEMQTRIFDPAPPGSRKVVIATNIAETSLTIDGIYYVVDPGFVKQKVYNSKTGIDQLVVTPISQAQAKQRAGRAGRTGPGKCYRLYTERAYRDEMLTTNVPEIQRTNLASTVLSLKAMGINDLLSFDFMDAPPMETLITAMEQLYTLGALDDEGLLTRLGRRMAEFPLEPMLCKMLIMSVHLGCSEEMLTIVSMLSVQNVFYRPKDKQALADQKKAKFHQTEGDHLTLLAVYNSWKNNKFSNPWCYENFIQARSLRRAQDIRKQMLGIMDRHKLDVVSCGKSTVRVQKAICSGFFRNAAKKDPQEGYRTLIDQQVVYIHPSSALFNRQPECPKHFLPVVAVAVSLEQCLSKFEDLNKELGLVTC

SEQ ID NO: 4232 - protein, 53 aa, Homo Sapiens
MAVAVAMAGALIGSEPGPAEELAKLEYLSLVSKVCTELDNHLGINDKDLGFSY

SEQ ID NO: 4233 - protein, 33 aa, Homo Sapiens
  misc_feature (1)..(1): Xaa can be any naturally occurring amino acid
XYRTLIDQQVVYIHPSSALFNRQPEWTVPMGHV

SEQ ID NO: 4234 - protein, 6 aa, Homo Sapiens
MGILSV

SEQ ID NO: 4235 - protein, 6 aa, Homo Sapiens
MGILSV

SEQ ID NO: 4236 - protein, 56 aa, Homo Sapiens
MGILSVDLLITLQILPPSANWWKSSPQWLTSCWSTLMRLIHQMAGRYRGTPLCLLR

SEQ ID NO: 4237 - protein, 55 aa, Homo Sapiens
MGILSVDLLITLQILPVFFSNCLFLALYDSVILLKHVVLLLSRSKSTRGEWRRML

SEQ ID NO: 4238 - protein, 145 aa, Homo Sapiens
MGILSVDLLITLQILPVFFSNCLFLALYDSVILLKHVVLLLSRSKSTRGEWRRMLTSEGLRCVWKSFLLDAYKQLNCPPSGFSKDGHILLVYEAYKSRLLVYSHLDLWMTDSVVLTLNFPRQISLCFGKNSAAELYIVSKKEKVP

SEQ ID NO: 4239 - protein, 306 aa, Homo Sapiens
MGILSVDLLITLQILPVFFSNCLFLALYDSVILLKHVVLLLSRSKSTRGEWRRMLTSEGLRCVWKSFLLDAYKQLNCPPSGFSKDGHILLVYEAYKSRLLVYSHLDLWMVKLGEDAPNSSVVHVSSTEGGDNSGNGTQEKIAEGATCHLLDFASPERPLVVNFGSATPPFTSQLPAFRKLVEEFSSVADFLLVYIDEAHPSDGWAIPGDSSLSFEVKKHQNQEDRCAAAQQLLERFSLPPQCRVVADRMDNNANIAYGVAFERVCIVQRQKIAYLGGKGPFSYNLQEVRHWLEKNFSKRKKTRLAG

SEQ ID NO: 4240 - protein, 271 aa, Homo Sapiens
MGILSVDLLITLQILPVFFSNCLFLALYDSVILLKHVVLLLSRSKSTRGEWRRMLTSEGLRCVWKSFLLDAYKQVKLGEDAPNSSVVHVSSTEGGDNSGNGTQEKIAEGATCHLLDFASPERPLVVNFGSATPPFTSQLPAFRKLVEEFSSVADFLLVYIDEAHPSDGWAIPGDSSLSFEVKKHQNQEDRCAAAQQLLERFSLPPQCRVVADRMDNNANIAYGVAFERVCIVQRQKIAYLGGKGPFSYNLQEVRHWLEKNFSKRKKTRLAG

SEQ ID NO: 4241 - protein, 271 aa, Homo Sapiens; identical to SEQ ID NO: 4240

SEQ ID NO: 4242 - protein, 37 aa, Homo Sapiens
  misc_feature (1)..(1): Xaa can be any naturally occurring amino acid
XMLTSEGLRCVWKSFLLDAYKQLNCPPSGFSKDGHIL

SEQ ID NO: 4243 - protein, 58 aa, Homo Sapiens
  misc_feature (1)..(1): Xaa can be any naturally occurring amino acid
XMLTSEGLRCVWKSFLLDAYKQTDSVVLTLNFPRQISLCFGKNSAAELYIVSKKEKVP

SEQ ID NO: 4244 - protein, 77 aa, Homo Sapiens
MEEAKKMISGLQALLLNGSLPEDEQERPLALCEPGVNPEEQLIIIQSRLDQSMEENQDLKKELLKCKQEARNLQGIK

SEQ ID NO: 4245 - protein, 472 aa, Homo Sapiens
MGGTQVKCLTSPSPIHSAKSESIITQSEEKADFVIIPAEGIENRTEGTDSPLSRDWRPGSPGTYLETSWEEQLLEQQEYLEKEMEEAKKMISGLQALLLNGSLPEDEQERPLALCEPGVNPEEQLIIIQSRLDQSMEENQDLKKELLKCKQEARNLQGIKDALQQRLTQQDTSVLQLKQELLRANMDKDELHNQNVDLQRKLDERNRLLGEYKKELGQKDRLLQQHQAKLEEALRKLSDVSYHQVDLERELEHKDVLLAHCMKREADEATNYNSHNSQSNGFLLPTAGKGATSVSNRGTSDLQLVRDALRSLRNSFSGHDPQHHTIDSLEQGISSLMERLHVMETQKKQERKVRVKSPRTQVGSEYRESWPPNSKLPHSQSSPTVSSTCTKVLYFTDRSLTPFMVNIPKRLEEVTLKDFKAAIDREGNHRYHFKALDPEFGTVKEEIFHDDDAIPGWEGKIVAWVEEDHGEN

SEQ ID NO: 4246 - protein, 218 aa, Homo Sapiens
MGTQVVMRFNNSLLPTEPSQQLQAYVAWVNAQLKKRPAVKPVQDLRQDLRDGVILAYLIEIVAGEKLSGVQLSPGNQQEMKNNVEKVLQFVASKKIRMHQTSAKDIVDGNLKSIMRLVLALAAHFKPGSSRTVNQGRDSRAPLQSHRPHCATAVAQGAAAALADVCHDMSRSGRDVFRYRQRNSSMDEEIENPYWSVRALVQQYEGQQRSPSESSCSR

SEQ ID NO: 4247 - protein, 683 aa, Homo Sapiens
MLACLTRGNLLDVLQEGFNEQQLQAYVAWVNAQLKKRPAVKPVQDLRQDLRDGVILAYLIEIVAGEKLSGVQLSPGNQQEMKNNVEKVLQFVASKKIRMHQTSAKDIVDGNLKSIMRLVLALAAHFKPGSSRTVNQGRDSRAPLQSHRPHCATAVAQGAAAALADVCHDMSRSGRDVFRYRQRNSSMDEEIENPYWSVRALVQQYEGQQRSPSESSCSSLTSPSPIHSAKSESIITQSEEKADFVIIPAEGIENRTEGTDSPLSRDWRPGSPGTYLETSWEEQLLEQQEYLEKEMEEAKKMISGLQALLLNGSLPEDEQERPLALCEPGVNPEEQLIIIQSRLDQSMEENQDLKKELLKCKQEARNLQGIKDALQQRLTQQDTSVLQLKQELLRANMDKDELHNQNVDLQRKLDERNRLLGEYKKELGQKDRLLQQHQAKLEEALRKLSDVSYHQVDLERELEHKDVLLAHCMKREADEATNYNSHNSQSNGFLLPTAGKGATSVSNRGTSDLQLVRDALRSLRNSFSGHDPQHHTIDSLEQGISSLMERLHVMETQKKQERKVRVKSPRTQVGSEYRESWPPNSKLPHSQSSPTVSSTCTKVLYFTDRSLTPFMVNIPKRLEEVTLKDFKAAIDREGNHRYHFKALDPEFGTVKEEIFHDDDAIPGWEGKIVAWVEEDHGEN

SEQ ID NO: 4248 - protein, 266 aa, Homo Sapiens
MMALGAAGATRVFVAMVAAALGGHPLLGVSATLNSVLNSNAIKNLPPPLGGAAGHPGSAVSAAPGILYPGGNKYQTIDNYQPYPCAEDEECGTDEYCASPTRGGDAGVQICLACRKRRKRCMRHAMCCPGNYCKNGICVSSDQNHFRGEIEETITESFGNDHSTLDGYSRRTTLSSKMYHTKGQEGSVCLRSSDCASGLCCARHFWSKICKPVLKEGQVCTKHRRKGSHGLEIFQRCYCGEGLSCRIQKDHHQASNSSRLHTCQRH

SEQ ID NO: 4249 - protein, 259 aa, Homo Sapiens
MAALMRSKDSSCCLLLLAAVLMVESSQIGSSRAKLNSIKSSLGGETPGQAANRSAGMYQGLAFGGSKKGKNLGQAYPCSSDKECEVGRYCHSPHQGSSACMVCRRKKKRCHRDGMCCPSTRCNNGICIPVTESILTPHIPALDGTRHRDRNHGHYSNHDLGWQNLGRPHTKMSHIKGHEGDPCLRSSDCIEGFCCARHFWTKICKPVLHQGEVCTKQRKKGSHGLEIFQRCDCAKGLSCKVWKDATYSSKARLHVCQKI

SEQ ID NO: 4250 - protein, 213 aa, Homo Sapiens
MTLRIDYCQGLLVGVSSSGLNIIQIQCQAYPCSSDKECEVGRYCHSPHQGSSACMVCRRKKKRCHRDGMCCPSTRCNNGICIPVTESILTPHIPALDGTRHRDRNHGHYSNHDLGWQNLGRPHTKMSHIKGHEGDPCLRSSDCIEGFCCARHFWTKICKPVLHQGEVCTKQRKKGSHGLEIFQRCDCAKGLSCKVWKDATYSSKARLHVCQKI

SEQ ID NO: 4251 - protein, 159 aa, Homo Sapiens
MVCRRKKKRCHRDGMCCPSTRCNNGICIPVTESILTPHIPALDGTRHRDRNHGHYSNHDLGWQNLGRPHTKMSHIKGHEGDPCLRSSDCIEGFCCARHFWTKICKPVLHQGEVCTKQRKKGSHGLEIFQRCDCAKGLSCKVWKDATYSSKARLHVCQKI

SEQ ID NO: 4252 - protein, 132 aa, Homo Sapiens
MQRLGATLLCLLLAAAVPTAPAPAPTATSAPVKPGPALSYPQEEATLNEMFREVEELMEDTQHKLRSAVEEMEAEEAAAKASSEVNLANLPPSYHNETNTDTKVGNNTIHVHREIHKECIIDEDCGPSMYCQ

SEQ ID NO: 4253 - protein, 183 aa, Homo Sapiens
MQRLGATLLCLLLAAAVPTAPAPAPTATSAPVKPGPALSYPQEEATLNEMFREVEELMEDTQHKLRSAVEEMEAEEAAAKASSEVNLANLPPSYHNETNTDTKVGNNTIHVHREIHKECIIDEDCGPSMYCQFASFQYTCQPCRGQRMLCTRDSECCGDQLCVWGHCTKMATRGSNGTICDNQ

SEQ ID NO: 4254 - protein, 235 aa, Homo Sapiens
MQRLGATLLCLLLAAAVPTAPAPAPTATSAPVKPGPALSYPQEEATLNEMFREVEELMEDTQHKLRSAVEEMEAEEAAAKASSEVNLANLPPSYHNETNTDTKVGNNTIHVHREIHKITNNQTGQMVFSETVITSVGDEEGRRSHECIIDEDCGPSMYCQFASFQYTCQPCRGQRMLCTRDSECCGDQLCVWGHCTKMATRGSNGTICDNQRDCQPGLCCAFQRGLLFPVCTPLP

SEQ ID NO: 4255 - protein, 350 aa, Homo Sapiens
MQRLGATLLCLLLAAAVPTAPAPAPTATSAPVKPGPALSYPQEEATLNEMFREVEELMEDTQHKLRSAVEEMEAEEAAAKASSEVNLANLPPSYHNETNTDTKVGNNTIHVHREIHKITNNQTGQMVFSETVITSVGDEEGRRSHECIIDEDCGPSMYCQFASFQYTCQPCRGQRMLCTRDSECCGDQLCVWGHCTKMATRGSNGTICDNQRDCQPGLCCAFQRGLLFPVCTPLPVEGELCHDPASRLLDLITWELEPDGALDRCPCASGLLCQPHSHSLVYVCKPTFVGSRDQDGEILLPREVPDEYEVGSFMEEVRQELEDLERSLTEEMALREPAAAAAALLGGEEI

SEQ ID NO: 4256 - protein, 350 aa, Homo Sapiens; identical to SEQ ID NO: 4255

SEQ ID NO: 4257 - protein, 364 aa, Homo Sapiens
MQRLGATLLCLLLAAAVPTAPAPAPTATSAPVKPGPALSYPQEEATLNEMFREVEELMEDTQHKLRSAVEEMEAEEAAAKASSEVNLANLPPSYHNETNTDTKVGNNTIHVHREIHKITNNQTGQMVFSETVITSVGDEEGRRSHECIIDEDCGPSMYCQFASFQYTCQPCRGQRMLCTRDSECCGDQLCVWGHCTKMATRGSNGTICDNQRDCQPGLCCAFQRGLLFPVCTPLPVEGELCHDPASRLLDLITWELEPDGALDRCPCASGLLCQPHRLPRLEPGFVPSLPSHSLVYVCKPTFVGSRDQDGEILLPREVPDEYEVGSFMEEVRQELEDLERSLTEEMALREPAAAAAALLGGEEI

SEQ ID NO: 4258 - protein, 224 aa, Homo Sapiens
MVAAVLLGLSWLCSPLGALVLDFNNIRSSADLHGARKGSQCLSDTDCNTRKFCLQPRDEKPFCATCRGLRRRCQRDAMCCPGTLCVNDVCTTMEDATPILERQLDEQDGTHAEGTTGHPVQENQPKRKPSIKKSQGRKGQEGESCLRTFDCGPGLCCARHFWTKICKPVLLEGQVCSRRGHKDTAQAPEIFQRCDCGPGLLCRSQLTSNRQHARLRVCQKIEKL

SEQ ID NO: 4259 - protein, 125 aa, Homo Sapiens
MDFRGLPGNYHKEENQEHQLGNNTLSSHLQIDKMTDNKTGEVLISENVVASIQPAEGSFEGDLKVPRMEEKEALVPIQKATDSFHTELHPRVAFWIIKLPRRRSHQDALEGGHWLSEKRHRLQAI

SEQ ID NO: 4260 - protein, 146 aa, Homo Sapiens
MDFRGLPGNYHKEENQEHQLGNNTLSSHLQIDKMTDNKTGEVLISENVVASIQPAEGSFEGDLKVPRMEEKEALVPIQKATDSFHTELHPRVAFWIIKLPRRRSHQDALEGGHWLSEKRHRLQAIRDGLRKGTHKDVLEEGTESSS

SEQ ID NO: 4261 - protein, 100 aa, Homo Sapiens
MEEKEALVPIQKATDSFHTELHPRVAFWIIKLPRRRSHQDALEGGHWLSEKRHRLQAIRDGLRKGTHKDVLEEGTESSSHSRLSPRKTHLLYILRPSRQL

SEQ ID NO: 4262 - protein, 242 aa, Homo Sapiens
MGEASPPAPARRHLLVLLLLLSTLVIPSAAAPIHDADAQESSLGLTGLQSLLQGFSRLFLKGNLLRGIDSLFSAPMDFRGLPGNYHKEENQEHQLGNNTLSSHLQIDKMTDNKTGEVLISENVVASIQPAEGSFEGDLKVPRMEEKEALVPIQKATDSFHTELHPRVAFWIIKLPRRRSHQDALEGGHWLSEKRHRLQAIRDGLRKGTHKDVLEEGTESSSHSRLSPRKTHLLYILRPSRQL

SEQ ID NO: 4263 - protein, 199 aa, Homo Sapiens
MGEASPPAPARRHLLVLLLLLSTLVIPSAAAPIHDADAQESSLGLTGLQSLLQGFSRLFLKGNLLRGIDSLFSAPMDFRGLPGNYHKEENQEHQLGNNTLSSHLQIDKVPRMEEKEALVPIQKATDSFHTELHPRVAFWIIKLPRRRSHQDALEGGHWLSEKRHRLQAIRDGLRKGTHKDVLEEGTESSSHSRLSPRKT

SEQ ID NO: 4264 - protein, 137 aa, Homo Sapiens
  misc_feature (1)..(1): Xaa can be any naturally occurring amino acid
XAAAPIHDADAQESSLGLTGLQSLLQGFSRLFLKVPRMEEKEALVPIQKATDSFHTELHPRVAFWIIKLPRRRSHQDALEGGHWLSEKRHRLQAIRDGLRKGTHKDVLEEGTESSSHSRLSPRKTHLLYILRPSRQL

SEQ ID NO: 4265 - protein, 724 aa, Homo Sapiens
MDCLCIVTTKKYRYQDEDTPPLEHSPAHLPNQANSPPVIVNTDTLEAPGYELQVNGTEGEMEYEEITLERGNSGLGFSIAGGTDNPHIGDDPSIFITKIIPGGAAAQDGRLRVNDSILFVNEVDVREVTHSAAVEALKEAGSIVRLYVMRRKPPAEKVMEIKLIKGPKGLGFSIAGGVGNQHIPGDNSIYVTKIIEGGAAHKDGRLQIGDKILAVNSVGLEDVMHEDAVAALKNTYDVVYLKVAKPSNAYLSDSYAPPDITTSYSQHLDNEISHSSYLGTDYPTAMTPTSPRRYSPVAKDLLGEEDIPREPRRIVIHRGSTGLGFNIVGGEDGEGIFISFILAGGPADLSGELRKGDQILSVNGVDLRNASHEQAAIALKNAGQTVTIIAQYKPEEYSRFEAKIHDLREQLMNSSLGSGTASLRSNPKRGFYIRALFDYDKTKDCGFLSQALSFRFGDVLHVIDASDEEWWQARRVHSDSETDDIGFIPSKRRVERREWSRLKAKDWGSSSGSQGREDSVLSYETVTQMEVHYARPIIILGPTKDRANDDLLSEFPDKFGSCVPHTTRPKREYEIDGRDYHFVSSREKMEKDIQAHKFIEAGQYNSHLYGTSVQSVREVAEQGKHCILDVSANAVRRLQAAHLHPIAIFIRPRSLENVLEINKRITEEQARKAFDRATKLEQEFTECFSAIVEGDSFEEIYHKVKRVIEDLSGPYIWVPARERL

SEQ ID NO: 4266 - protein, 721 aa, Homo Sapiens
MDCLCIVTTKKYRYQDEDTPPLEHSPAHLPNQANSPPVIVNTDTLEAPGYVNGTEGEMEYEEITLERGNSGLGFSIAGGTDNPHIGDDPSIFITKIIPGGAAAQDGRLRVNDSILFVNEVDVREVTHSAAVEALKEAGSIVRLYVMRRKPPAEKVMEIKLIKGPKGLGFSIAGGVGNQHIPGDNSIYVTKIIEGGAAHKDGRLQIGDKILAVNSVGLEDVMHEDAVAALKNTYDVVYLKVAKPSNAYLSDSYAPPDITTSYSQHLDNEISHSSYLGTDYPTAMTPTSPRRYSPVAKDLLGEEDIPREPRRIVIHRGSTGLGFNIVGGEDGEGIFISFILAGGPADLSGELRKGDQILSVNGVDLRNASHEQAAIALKNAGQTVTIIAQYKPEEYSRFEAKIHDLREQLMNSSLGSGTASLRSNPKRGFYIRALFDYDKTKDCGFLSQALSFRFGDVLHVIDASDEEWWQARRVHSDSETDDIGFIPSKRRVERREWSRLKAKDWGSSSGSQGREDSVLSYETVTQMEVHYARPIIILGPTKDRANDDLLSEFPDKFGSCVPHTTRPKREYEIDGRDYHFVSSREKMEKDIQAHKFIEAGQYNSHLYGTSVQSVREVAEQGKHCILDVSANAVRRLQAAHLHPIAIFIRPRSLENVLEINKRITEEQARKAFDRATKLEQEFTECFSAIVEGDSFEEIYHKVKRVIEDLSGPYIWVPARERL

SEQ ID NO: 4267 - protein, 296 aa, Homo Sapiens
MDCLCIVTTKKYRYQDEDTPPLEHSPAHLPNQANSPPVIVNTDTLEAPGYVNGTEGEMEYEEITLERGNSGLGFSIAGGTDNPHIGDDPSIFITKIIPGGAAAQDGRLRVNDSILFVNEVDVREVTHSAAVEALKEAGSIVRLYVMRRKPPAEKVMEIKLIKGPKGLGFSIAGGVGNQHIPGDNSIYVTKIIEGGAAHKDGRLQIGDKILAVNSVGLEDVMHEDAVAALKNTYDVVYLKVAKPSNAYLSDSYAPPDITTCESPSNTKVPHDPSRLTHDMQSHDIPVAVPLQIFPMK

SEQ ID NO: 4268 - protein, 234 aa, Homo Sapiens
MDCLCIVTTKKYRYQDEDTPPLEHSPAHLPNQVNAPELVHVAERNLSHLEAGHGVVGHAHLSPFKANSPPVIVNTDTLEAPGYVNGTEGEMEYEEITLERGNSGLGFSIAGGTDNPHIGDDPSIFITKIIPGGAAAQDGRLRVNDSILFVNEVDVREVTHSAAVEALKEAGSIVRLYVMRRKPPAEKVMEIKLIKGPKGLGFSIAGGVGNQHIPGDNSIYVTKIIEGGAAHKDG

SEQ ID NO: 4269 - protein, 91 aa, Homo Sapiens
MEYEEITLERGNSGLGFSIAGGTDNPHIGDDPSIFITKIIPGGAAAQDGRLRVNDSILFVNEVDVREVTHSAAVEALKEAGSIVRLYVMRR

SEQ ID NO: 4270 - protein, 116 aa, Homo Sapiens
MEYEEITLERGNSGLGFSIAGGTDNPHIGDDPSIFITKIIPGGAAAQDGRLRVNDSILFVNEVDVREVTHSAAVEALKEAGSIVRLYVMRRKPPAEKVMEIKLIKGPKGLGFSIAG

SEQ ID NO: 4271 - protein, 281 aa, Homo Sapiens
MPINGVNLAWKYRYQDEDTPPLEHSPAHLPNQVNAPELVHVAERNLSHLEAGHGVVGHAHLSPFKANSPPVIVNTDTLEAPGYELQVNGTEGEMEYEEITLERGNSGLGFSIAGGTDNPHIGDDPSIFITKIIPGGAAAQDGRLRVNDSILFVNEVDVREVTHSAAVEALKEAGSIVRLYVMRRKPPAEKVMEIKLIKGPKGLGFSIAGGVGNQHIPGDNSIYVTKIIEGGAAHKDGRLQIGDKILAVNSVGLEDVMHEDAVAALKNTYDVVYLKVAKPSN

SEQ ID NO: 4272 - protein, 767 aa, Homo Sapiens
MSQRPRAPRSALWLLAPPLLRWAPPLLTVLHSDLFQALLDILDYYEASLSESQKYRYQDEDTPPLEHSPAHLPNQANSPPVIVNTDTLEAPGYELQVNGTEGEMEYEEITLERGNSGLGFSIAGGTDNPHIGDDPSIFITKIIPGGAAAQDGRLRVNDSILFVNEVDVREVTHSAAVEALKEAGSIVRLYVMRRKPPAEKVMEIKLIKGPKGLGFSIAGGVGNQHIPGDNSIYVTKIIEGGAAHKDGRLQIGDKILAVNSVGLEDVMHEDAVAALKNTYDVVYLKVAKPSNAYLSDSYAPPDITTSYSQHLDNEISHSSYLGTDYPTAMTPTSPRRYSPVAKDLLGEEDIPREPRRIVIHRGSTGLGFNIVGGEDGEGIFISFILAGGPADLSGELRKGDQILSVNGVDLRNASHEQAAIALKNAGQTVTIIAQYKPEEYSRFEAKIHDLREQLMNSSLGSGTASLRSNPKRGFYIRALFDYDKTKDCGFLSQALSFRFGDVLHVIDASDEEWWQARRVHSDSETDDIGFIPSKRRVERREWSRLKAKDWGSSSGSQGREDSVLSYETVTQMEVHYARPIIILGPTKDRANDDLLSEFPDKFGSCVPHTTRPKREYEIDGRDYHFVSSREKMEKDIQAHKFIEAGQYNSHLYGTSVQSVREVAEQGKHCILDVSANAVRRLQAAHLHPIAIFIRPRSLENVLEINKRITEEQARKAFDRATKLEQEFTECFSAIVEGDSFEEIYHKVKRVIEDLSGPYIWVPARERL

SEQ ID NO: 4273 - protein, 85 aa, Homo Sapiens
  misc_feature (1)..(1): Xaa can be any naturally occurring amino acid
XGPTKDRANDDLLSEFPDKFGSCVPHTTRPKREYEIDGRDYHFVSSREKMEKDIQAHKFIEAGQYNSHLYGTSVQSVREVAEQRD

SEQ ID NO: 4274 - protein, 97 aa, Homo Sapiens
MTATEALLRVLLLLLAFGHSTYGAECFPACNPQNGFCEDDNVCRCQPGWQGPLCDQCVTSPGCLHGLCGEPGQCICTDGWDGELCDRDVRACSSAPC

SEQ ID NO: 4275 - protein, 310 aa, Homo Sapiens
MTATEALLRVLLLLLAFGHSTYGAECFPACNPQNGFCEDDNVCRCQPGWQGPLCDQCVTSPGCLHGLCGEPGQCICTDGWDGELCDRDVRACSSAPCANNRTCVSLDDGLYECSCAPGYSGKDCQKKDGPCVINGSPCQHGGTCVDDEGRASHASCLCPPGFSGNFCEIVANSCTPNPCENDGVCTDIGGDFRCRCPAGFIDKTCSRPVTNCASSPCQNGGTCLQHTQGQAICFTILGVLTSLVVLGTVGIVFLNKCETWVSNLRYNHMLRKKKNLLLQYNSGEDLAVNIIFPEKIDMTTFSKEAGDEEI

SEQ ID NO: 4276 - protein, 383 aa, Homo Sapiens
MTATEALLRVLLLLLAFGHSTYGAECFPACNPQNGFCEDDNVCRCQPGWQGPLCDQCVTSPGCLHGLCGEPGQCICTDGWDGELCDRDVRACSSAPCANNRTCVSLDDGLYECSCAPGYSGKDCQKKDGPCVINGSPCQHGGTCVDDEGRASHASCLCPPGFSGNFCEIVANSCTPNPCENDGVCTDIGGDFRCRCPAGFIDKTCSRPVTNCASSPCQNGGTCLQHTQVSYECLCKPEFTGLTCVKKRALSPQQVTRLPSGYGLAYRLTPGVHELPVQQPEHRILKVSMKELNKKTPLLTEGQAICFTILGVLTSLVVLGTVGIVFLNKCETWVSNLRYNHMLRKKKNLLLQYNSGEDLAVNIIFPEKIDMTTFSKEAGDEEI

SEQ ID NO: 4277 - protein, 136 aa, Homo Sapiens
MTATEALLRVLLLLLAFGHSTYGAECFPACNPQNGFCEDDNVCRCQPGWQGPLCDQCVTSPGCLHGLCGEPGQCICTDGWDGELCDRGWHSPLFTSALRPYLPALAPTTSSQSPVAGVPHFLIPAHSVPCILKICL

SEQ ID NO: 4278 - protein, 54 aa, Homo Sapiens
MGSRCALALAVLSALLCQVWSSGVFELKLQEFVNKKGLLGNRNCCRGGAGPPPC

SEQ ID NO: 4279 - protein, 723 aa, Homo Sapiens
MGSRCALALAVLSALLCQVWSSGVFELKLQEFVNKKGLLGNRNCCRGGAGPPPCACRTFFRVCLKHYQASVSPEPPCTYGSAVTPVLGVDSFSLPDGGGADSAFSNPIRFPFGFTWPGTFSLIIEALHTDSPDDLATENPERLISRLATQRHLTVGEEWSQDLHSSGRTDLKYSYRFVCDEHYYGEGCSVFCRPRDDAFGHFTCGERGEKVCNPGWKGPYCTEPICLPGCDEQHGFCDKPGECKCRVGWQGRYCDECIRYPGCLHGTCQQPWQCNCQEGWGGLFCNQDLNYCTHHKPCKNGATCTNTGQGSYTCSCRPGYTGATCELGIDECDPSPCKNGGSCTDLENSYSCTCPPGFYGKICELSAMTCADGPCFNGGRCSDSPDGGYSCRCPVGYSGFNCEKKIDYCSSSPCSNGAKCVDLGDAYLCRCQAGFSGRHCDDNVDDCASSPCANGGTCRDGVNDFSCTCPPGYTGRNCSAPVSRCEHAPCHNGATCHERGHRYVCECARGYGGPNCQFLLPELPPGPAVVDLTEKLEGQGGPFPWVAVCAGVILVLMLLLGCAAVVVCVRLRLQKHRPPADPCRGETETMNNLANCQREKDISVSIIGATQIKNTNKKADFHGDHSADKNGFKARYPAVDYNLVQDLKGDDTAVRDAHSKRDTKCQPQGSSGEEKGTPTTLRGGEASERKRPDSGCSTSKDTKYQSVYVISEEKDECVIATEV

SEQ ID NO: 4280 - protein, 220 aa, Homo Sapiens
MVSPRMSGLLSQTVILALIFLPQTRPAGVFELQIHSFGPGPGPGAPRSPCSARLPCRLFFRVCLKPGLSEEAAESPCALGAALSARGPVYTEQPGAPAPDLPLPDGLLQVPFRDAWPGTFSFIIETWREELGDQIGGGLCLDLGHALRCRCRAGFAGPRCEHDLDDCAGRACANGGTCVEGGGAHRCSCALGFGGRDCRERADPCAARPCAHGGRCYAHF

SEQ ID NO: 4281 - protein, 618 aa, Homo Sapiens
MVSPRMSGLLSQTVILALIFLPQTRPAGVFELQIHSFGPGPGPGAPRSPCSARLPCRLFFRVCLKPGLSEEAAESPCALGAALSARGPVYTEQPGAPAPDLPLPDGLLQVPFRDAWPGTFSFIIETWREELGDQIGGPAWSLLARVAGRRRLAAGGPWARDIQRAGAWELRFSYRARCEPPAVGTACTRLCRPRSAPSRCGPGLRPCAPLEDECEAPLVCRAGCSPEHGFCEQPGECRCLEGWTGPLCTVPVSTSSCLSPRGPSSATTGCLVPGPGPCDGNPCANGGSCSETPRSFECTCPRGFYGLRCEVSGVTCADGPCFNGGLCVGGADPDSAYICHCPPGFQGSNCEKRVDRCSLQPCRNGGLCLDLGHALRCRCRAGFAGPRCEHDLDDCAGRACANGGTCVEGGGAHRCSCALGFGGRDCRERADPCAARPCAHGGRCYAHFSGLVCACAPGYMGARCEFPVHPDGASALPAAPPGLRPGDPQRYLLPPALGLLVAAGVAGAALLLVHVRRRGHSQDAGSRLLAGTPEPSVHALPDALNNLRTQEGSGDGPSSSVDWNRPEDVDPQGIYVISAPSIYAREVATPLFPPLHTGRAGQRQHLLFPYPSSILSVK

SEQ ID NO: 4282 - protein, 587 aa, Homo Sapiens
MVSPRMSGLLSQTVILALIFLPQTRPAGVFELQIHSFGPGPGPGAPRSPCSARLPCRLFFRVCLKPGLSEEAAESPCALGAALSARGPVYTEQPGAPAPDLPLPDGLLQVPFRDAWPGTFSFIIETWREELGDQIGGPAWSLLARVAGRRRLAAGGPWARDIQRAGAWELRFSYRARCEPPAVGTACTRLCRPRSAPSRCGPGLRPCAPLEDECEAPLVCRAGCSPEHGFCEQPGECRCLEGWTGPLCTVPVSTSSCLSPRGPSSATTGCLVPGPGPCDGNPCANGGSCSETPRSFECTCPRGFYGLRCEVSGVTCADGPCFNGGLCVGGADPDSAYICHCPPGFQGSNCEKRVDRCSLQPCRNGGLCLDLGHALRCRCRAGFAGPRCEHDLDDCAGRACANGGTCVEGGGAHRCSCALGFGGRDCRERADPCAARPCAHGGRCYAHFSGLVCACAPGYMGARCEFPVHPDGASALPAAPPGLRPGDPQRYLLPPALGLLVAAGVAGAALLLVHVRRRGHSQDAGSRLLAGTPEPSVHALPDALNNLRTQEGSGDGPSSSVDWNRPEDVDPQGIYVISAPSIYAREA

SEQ ID NO: 4283 - protein, 1785 aa, Homo Sapiens
MGISTVILEMCLLWGQVLSTGGWIPRTTDYASLIPSEVPLDPTVAEGSPFPSESTLESTVAEGSPISLESTLESTVAEGSLIPSESTLESTVAEGSDSGLALRLVNGDGRCQGRVEILYRGSWGTVCDDSWDTNDANVVCRQLGCGWAMSAPGNAWFGQGSGPIALDDVRCSGHESYLWSCPHNGWLSHNCGHGEDAGVICSAAQPQSTLRPESWPVRISPPVPTEGSESSLALRLVNGGDRCRGRVEVLYRGSWGTVCDDYWDTNDANVVCRQLGCGWAMSAPGNAQFGQGSGPIVLDDVRCSGHESYLWSCPHNGWLTHNCGHSEDAGVICSAPQSRPTPSPDTWPTSHASTAGPESSLALRLVNGGDRCQGRVEVLYRGSWGTVCDDSWDTSDANVVCRQLGCGWATSAPGNARFGQGSGPIVLDDVRCSGYESYLWSCPHNGWLSHNCQHSEDAGVICSAAHSWSTPSPDTLPTITLPASTVGSESSLALRLVNGGDRCQGRVEVLYQGSWGTVCDDSWDTNDANVVCRQLGCGWAMSAPGNARFGQGSGPIVLDDVRCSGHESYLWSCPHNGWLSHNCGHSEDAGVICSASQSRPTPSPDTWPTSHASTAGSESSLALRLVNGGDRCQGRVEVLYRGSWGTVCDDYWDTNDANVVCRQLGCGWAMSAPGNARFGQGSGPIVLDDVRCSGHESYLWSCPHNGWLSHNCGHHEDAGVICSASQSQPTPSPDTWPTSHASTAGSESSLALRLVNGGDRCQGRVEVLYRGSWGTVCDDYWDTNDANVVCRQLGCGWATSAPGNARFGQGSGPIVLDDVRCSGHESYLWSCPHNGWLSHNCGHHEDAGVICSASQSQPTPSPDTWPTSRASTAGSESTLALRLVNGGDRCRGRVEVLYQGSWGTVCDDYWDTNDANVVCRQLGCGWAMSAPGNAQFGQGSGPIVLDDVRCSGHESYLWSCPHNGWLSHNCGHHEDAGVICSAAQSQSTPRPDTWLTTNLPALTVGSESSLALRLVNGGDRCRGRVEVLYRGSWGTVCDDSWDTNDANVVCRQLGCGWAMSAPGNARFGQGSGPIVLDDVRCSGNESYLWSCPHKGWLTHNCGHHEDAGVICSATQINSTTTDWWHPTTTTTARPSSNCGGFLFYASGTFSSPSYPAYYPNNAKCVWEIEVNSGYRINLGFSNLKLEAHHNCSFDYVEIFDGSLNSSLLLGKICNDTRQIFTSSYNRMTIHFRSDISFQNTGFLAWYNSFPSDATLRLVNLNSSYGLCAGRVEIYHGGTWGTVCDDSWTIQEAEVVCRQLGCGRAVSALGNAYFGSGSGPITLDDVECSGTESTLWQCRNRGWFSHNCNHREDAGVICSGNHLSTPAPFLNITRPNTDYSCGGFLSQPSGDFSSPFYPGNYPNNAKCVWDIEVQNNYRVTVIFRDVQLEGGCNYDYIEVFDGPYRSSPLIARVCDGARGSFTSSSNFMSIRFISDHSITRRGFRAEYYSSPSNDSTNLLCLPNHMQASVSRSYLQSLGFSASDLVISTWNGYYECRPQITPNLVIFTIPYSGCGTFKQADNDTIDYSNFLTAAVSGGIIKRRTDLRIHVSCRMLQNTWVDTMYIANDTIHVANNTIQVEEVQYGNFDVNISFYTSSSFLYPVTSRPYYVDLNQDLYVQAEILHSDAVLTLFVDTCVASPYSNDFTSLTYDLIRSGCVRDDTYGPYSSPSLRIARFRFRAFHFLNRFPSVYLRCKMVVCRAYDPSSRCYRGCVLRSKRDVGSYQEKVDVVLGPIQLQTPPRREEEPR

SEQ ID NO: 4284 - protein, 2413 aa, Homo Sapiens
MGISTVILEMCLLWGQVLSTGGWIPRTTDYASLIPSEVPLDPTVAEGSPFPSESTLESTVAEGSPISLESTLESTVAEGSLIPSESTLESTVAEGSDSGLALRLVNGDGRCQGRVEILYRGSWGTVCDDSWDTNDANVVCRQLGCGWAMSAPGNAWFGQGSGPIALDDVRCSGHESYLWSCPHNGWLSHNCGHGEDAGVICSAAQPQSTLRPESWPVRISPPVPTEGSESSLALRLVNGGDRCRGRVEVLYRGSWGTVCDDYWDTNDANVVCRQLGCGWAMSAPGNAQFGQGSGPIVLDDVRCSGHESYLWSCPHNGWLTHNCGHSEDAGVICSAPQSRPTPSPDTWPTSHASTAGPESSLALRLVNGGDRCQGRVEVLYRGSWGTVCDDSWDTSDANVVCRQLGCGWATSAPGNARFGQGSGPIVLDDVRCSGYESYLWSCPHNGWLSHNCQHSEDAGVICSAAHSWSTPSPDTLPTITLPASTVGSESSLALRLVNGGDRCQGRVEVLYRGSWGTVCDDSWDTNDANVVCRQLGCGWAMLAPGNARFGQGSGPIVLDDVRCSGNESYLWSCPHNGWLSHNCGHSEDAGVICSGPESSLALRLVNGGDRCQGRVEVLYRGSWGTVCDDSWDTNDANVVCRQLGCGWATSAPGNARFGQGSGPIVLDDVRCSGHESYLWSCPNNGWLSHNCGHHEDAGVICSAAQSRSTPRPDTLSTITLPPSTVGSESSLTLRLVNGSDRCQGRVEVLYRGSWGTVCDDSWDTNDANVVCRQLGCGWATSAPGNARFGQGSGPIVLDDVRCSGHESYLWSCPHNGWLSHNCGHHEDAGVICSVSQSRPTPSPDTWPTSHASTAGPESSLALRLVNGGDRCQGRVEVLYRGSWGTVCDDSWDTSDANVVCRQLGCGWATSAPGNARFGQGSGPIVLDDVRCSGYESYLWSCPHNGWLSHNCQHSEDAGVICSAAHSWSTPSPDTLPTITLPASTVGSESSLALRLVNGGDRCQGRVEVLYQGSWGTVCDDSWDTNDANVVCRQLGCGWAMSAPGNARFGQGSGPIVLDDVRCSGHESYLWSCPHNGWLSHNCGHSEDAGVICSASQSRPTPSPDTWPTSHASTAGSESSLALRLVNGGDRCQGRVEVLYRGSWGTVCDDYWDTNDANVVCRQLGCGWAMSAPGNARFGQGSGPIVLDDVRCSGHESYLWSCPHNGWLSHNCGHHEDAGVICSASQSQPTPSPDTWPTSHASTAGSESSLALRLVNGGDRCQGRVEVLYRGSWGTVCDDYWDTNDANVVCRQLGCGWATSAPGNARFGQGSGPIVLDDVRCSGHESYLWSCPHNGWLSHNCGHHEDAGVICSASQSQPTPSPDTWPTSHASTAGSESSLALRLVNGGDRCQGRVEVLYRGSWGTVCDDYWDTNDANVVCRQLGCGWATSAPGNARFGQGSGPIVLDDVRCSGHESYLWSCPHNGWLSHNCGHHEDAGVICSASQSQPTPSPDTWPTSRASTAGSESTLALRLVNGGDRCRGRVEVLYQGSWGTVCDDYWDTNDANVVCRQLGCGWAMSAPGNAQFGQGSGPIVLDDVRCSGHESYLWSCPHNGWLSHNCGHHEDAGVICSAAQSQSTPRPDTWLTTNLPALTVGSESSLALRLVNGGDRCRGRVEVLYRGSWGTVCDDSWDTNDANVVCRQLGCGWAMSAPGNARFGQGSGPIVLDDVRCSGNESYLWSCPHKGWLTHNCGHHEDAGVICSATQINSTTTDWWHPTTTTTARPSSNCGGFLFYASGTFSSPSYPAYYPNNAKCVWEIEVNSGYRINLGFSNLKLEAHHNCSFDYVEIFDGSLNSSLLLGKICNDTRQIFTSSYNRMTIHFRSDISFQNTGFLAWYNSFPSDATLRLVNLNSSYGLCAGRVEIYHGGTWGTVCDDSWTIQEAEVVCRQLGCGRAVSALGNAYFGSGSGPITLDDVECSGTESTLWQCRNRGWFSHNCNHREDAGVICSGNHLSTPAPFLNITRPNTDYSCGGFLSQPSGDFSSPFYPGNYPNNAKCVWDIEVQNNYRVTVIFRDVQLEGGCNYDYIEVFDGPYRSSPLIARVCDGARGSFTSSSNFMSIRFISDHSITRRGFRAEYYSSPSNDSTNLLCLPNHMQASVSRSYLQSLGFSASDLVISTWNGYYECRPQITPNLVIFTIPYSGCGTFKQADNDTIDYSNFLTAAVSGGIIKRRTDLRIHVSCRMLQNTWVDTMYIANDTIHVANNTIQVEEVQYGNFDVNISFYTSSSFLYPVTSRPYYVDLNQDLYVQAEILHSDAVLTLFVDTCVASPYSNDFTSLTYDLIRSGCVRDDTYGPYSSPSLRIARFRFRAFHFLNRFPSVYLRCKMVVCRAYDPSSRCYRGCVLRSKRDVGSYQEKVDVVLGPIQLQTPPRREEEPR

SEQ ID NO: 4285 - protein, 2403 aa, Homo Sapiens
MGISTVILEMCLLWGQVLSTGGWIPRTTDYASLIPSEVPLDPTVAEGSPFPSESTLESTVAEGSPISLESTLESTVAEGSLIPSESTLESTVAEGSDSGLALRLVNGDGRCQGRVEILYRGSWGTVCDDSWDTNDANVVCRQLGCGWAMSAPGNAWFGQGSGPIALDDVRCSGHESYLWSCPHNGWLSHNCGHGEDAGVICSAAQPQSTLRPESWPVRISPPVPTEGSESSLALRLVNGGDRCRGRVEVLYRGSWGTVCDDYWDTNDANVVCRQLGCGWAMSAPGNAQFGQGSGPIVLDDVRCSGHESYLWSCPHNGWLTHNCGHSEDAGVICSAPQSRPTPSPDTWPTSHASTAGPESSLALRLVNGGDRCQGRVEVLYRGSWGTVCDDSWDTSDANVVCRQLGCGWATSAPGNARFGQGSGPIVLDDVRCSGYESYLWSCPHNGWLSHNCQHSEDAGVICSDTLPTITLPASTVGSESSLALRLVNGGDRCQGRVEVLYRGSWGTVCDDSWDTNDANVVCRQLGCGWAMLAPGNARFGQGSGPIVLDDVRCSGNESYLWSCPHNGWLSHNCGHSEDAGVICSGPESSLALRLVNGGDRCQGRVEVLYRGSWGTVCDDSWDTNDANVVCRQLGCGWATSAPGNARFGQGSGPIVLDDVRCSGHESYLWSCPNNGWLSHNCGHHEDAGVICSAAQSRSTPRPDTLSTITLPPSTVGSESSLTLRLVNGSDRCQGRVEVLYRGSWGTVCDDSWDTNDANVVCRQLGCGWATSAPGNARFGQGSGPIVLDDVRCSGHESYLWSCPHNGWLSHNCGHHEDAGVICSVSQSRPTPSPDTWPTSHASTAGPESSLALRLVNGGDRCQGRVEVLYRGSWGTVCDDSWDTSDANVVCRQLGCGWATSAPGNARFGQGSGPIVLDDVRCSGYESYLWSCPHNGWLSHNCQHSEDAGVICSAAHSWSTPSPDTLPTITLPASTVGSESSLALRLVNGGDRCQGRVEVLYQGSWGTVCDDSWDTNDANVVCRQLGCGWAMSAPGNARFGQGSGPIVLDDVRCSGHESYLWSCPHNGWLSHNCGHSEDAGVICSASQSRPTPSPDTWPTSHASTAGSESSLALRLVNGGDRCQGRVEVLYRGSWGTVCDDYWDTNDANVVCRQLGCGWAMSAPGNARFGQGSGPIVLDDVRCSGHESYLWSCPHNGWLSHNCGHHEDAGVICSASQSQPTPSPDTWPTSHASTAGSESSLALRLVNGGDRCQGRVEVLYRGSWGTVCDDYWDTNDANVVCRQLGCGWATSAPGNARFGQGSGPIVLDDVRCSGHESYLWSCPHNGWLSHNCGHHEDAGVICSASQSQPTPSPDTWPTSHASTAGSESSLALRLVNGGDRCQGRVEVLYRGSWGTVCDDYWDTNDANVVCRQLGCGWATSAPGNARFGQGSGPIVLDDVRCSGHESYLWSCPHNGWLSHNCGHHEDAGVICSASQSQPTPSPDTWPTSRASTAGSESTLALRLVNGGDRCRGRVEVLYQGSWGTVCDDYWDTNDANVVCRQLGCGWAMSAPGNAQFGQGSGPIVLDDVRCSGHESYLWSCPHNGWLSHNCGHHEDAGVICSAAQSQSTPRPDTWLTTNLPALTVGSESSLALRLVNGGDRCRGRVEVLYRGSWGTVCDDSWDTNDANVVCRQLGCGWAMSAPGNARFGQGSGPIVLDDVRCSGNESYLWSCPHKGWLTHNCGHHEDAGVICSATQINSTTTDWWHPTTTTTARPSSNCGGFLFYASGTFSSPSYPAYYPNNAKCVWEIEVNSGYRINLGFSNLKLEAHHNCSFDYVEIFDGSLNSSLLLGKICNDTRQIFTSSYNRMTIHFRSDISFQNTGFLAWYNSFPSDATLRLVNLNSSYGLCAGRVEIYHGGTWGTVCDDSWTIQEAEVVCRQLGCGRAVSALGNAYFGSGSGPITLDDVECSGTESTLWQCRNRGWFSHNCNHREDAGVICSGNHLSTPAPFLNITRPNTDYSCGGFLSQPSGDFSSPFYPGNYPNNAKCVWDIEVQNNYRVTVIFRDVQLEGGCNYDYIEVFDGPYRSSPLIARVCDGARGSFTSSSNFMSIRFISDHSITRRGFRAEYYSSPSNDSTNLLCLPNHMQASVSRSYLQSLGFSASDLVISTWNGYYECRPQITPNLVIFTIPYSGCGTFKQADNDTIDYSNFLTAAVSGGIIKRRTDLRIHVSCRMLQNTWVDTMYIANDTIHVANNTIQVEEVQYGNFDVNISFYTSSSFLYPVTSRPYYVDLNQDLYVQAEILHSDAVLTLFVDTCVASPYSNDFTSLTYDLIRSGCVRDDTYGPYSSPSLRIARFRFRAFHFLNRFPSVYLRCKMVVCRAYDPSSRCYRGCVLRSKRDVGSYQEKVDVVLGPIQLQTPPRREEEPR

SEQ ID NO: 4286 - protein, 2542 aa, Homo Sapiens
MGISTVILEMCLLWGQVLSTGGWIPRTTDYASLIPSEVPLDPTVAEGSPFPSESTLESTVAEGSPISLESTLESTVAEGSLIPSESTLESTVAEGSDSGLALRLVNGDGRCQGRVEILYRGSWGTVCDDSWDTNDANVVCRQLGCGWAMSAPGNAWFGQGSGPIALDDVRCSGHESYLWSCPHNGWLSHNCGHGEDAGVICSAAQPQSTLRPESWPVRISPPVPTEGSESSLALRLVNGGDRCRGRVEVLYRGSWGTVCDDYWDTNDANVVCRQLGCGWAMSAPGNAQFGQGSGPIVLDDVRCSGHESYLWSCPHNGWLTHNCGHSEDAGVICSAPQSRPTPSPDTWPTSHASTAGPESSLALRLVNGGDRCQGRVEVLYRGSWGTVCDDSWDTSDANVVCRQLGCGWATSAPGNARFGQGSGPIVLDDVRCSGYESYLWSCPHNGWLSHNCQHSEDAGVICSAAHSWSTPSPDTLPTITLPASTVGSESSLALRLVNGGDRCQGRVEVLYRGSWGTVCDDSWDTNDANVVCRQLGCGWAMLAPGNARFGQGSGPIVLDDVRCSGNESYLWSCPHNGWLSHNCGHSEDAGVICSGPESSLALRLVNGGDRCQGRVEVLYRGSWGTVCDDSWDTNDANVVCRQLGCGWATSAPGNARFGQGSGPIVLDDVRCSGHESYLWSCPNNGWLSHNCGHHEDAGVICSAAQSRSTPRPDTLSTITLPPSTVGSESSLTLRLVNGSDRCQGRVEVLYRGSWGTVCDDSWDTNDANVVCRQLGCGWATSAPGNARFGQGSGPIVLDDVRCSGHESYLWSCPHNGWLSHNCGHHEDAGVICSVSQSRPTPSPDTWPTSHASTAGPESSLALRLVNGGDRCQGRVEVLYRGSWGTVCDDSWDTSDANVVCRQLGCGWATSAPGNARFGQGSGPIVLDDVRCSGYESYLWSCPHNGWLSHNCQHSEDAGVICSAAHSWSTPSPDTLPTITLPASTVGSESSLALRLVNGGDRCQGRVEVLYQGSWGTVCDDSWDTNDANVVCRQLGCGWAMSAPGNARFGQGSGPIVLDDVRCSGHESYLWSCPHNGWLSHNCGHSEDAGVICSASQSRPTPSPDTWPTSHASTAGSESSLALRLVNGGDRCQGRVEVLYRGSWGTVCDDYWDTNDANVVCRQLGCGWAMSAPGNARFGQGSGPIVLDDVRCSGHESYLWSCPHNGWLSHNCGHHEDAGVICSASQSQPTPSPDTWPTSHASTAGSESSLALRLVNGGDRCQGRVEVLYRGSWGTVCDDYWDTNDANVVCRQLGCGWATSAPGNARFGQGSGPIVLDDVRCSGHESYLWSCPHNGWLSHNCGHHEDAGVICSASQSQPTPSPDTWPTSHASTAGSESSLALRLVNGGDRCQGRVEVLYRGSWGTVCDDYWDTNDANVVCRQLGCGWATSAPGNARFGQGSGPIVLDDVRCSGHESYLWSCPHNGWLSHNCGHHEDAGVICSASQSQPTPSPDTWPTSHASTAGSESSLALRLVNGGDRCQGRVEVLYRGSWGTVCDDYWDTNDANVVCRQLGCGWATSAPGNARFGQGSGPIVLDDVRCSGHESYLWSCPHNGWLSHNCGHHEDAGVICSASQSQPTPSPDTWPTSRASTAGSESTLALRLVNGGDRCRGRVEVLYQGSWGTVCDDYWDTNDANVVCRQLGCGWAMSAPGNAQFGQGSGPIVLDDVRCSGHESYLWSCPHNGWLSHNCGHHEDAGVICSAAQSQSTPRPDTWLTTNLPALTVGSESSLALRLVNGGDRCRGRVEVLYRGSWGTVCDDSWDTNDANVVCRQLGCGWAMSAPGNARFGQGSGPIVLDDVRCSGNESYLWSCPHKGWLTHNCGHHEDAGVICSATQINSTTTDWWHPTTTTTARPSSNCGGFLFYASGTFSSPSYPAYYPNNAKCVWEIEVNSGYRINLGFSNLKLEAHHNCSFDYVEIFDGSLNSSLLLGKICNDTRQIFTSSYNRMTIHFRSDISFQNTGFLAWYNSFPSDATLRLVNLNSSYGLCAGRVEIYHGGTWGTVCDDSWTIQEAEVVCRQLGCGRAVSALGNAYFGSGSGPITLDDVECSGTESTLWQCRNRGWFSHNCNHREDAGVICSGNHLSTPAPFLNITRPNTDYSCGGFLSQPSGDFSSPFYPGNYPNNAKCVWDIEVQNNYRVTVIFRDVQLEGGCNYDYIEVFDGPYRSSPLIARVCDGARGSFTSSSNFMSIRFISDHSITRRGFRAEYYSSPSNDSTNLLCLPNHMQASVSRSYLQSLGFSASDLVISTWNGYYECRPQITPNLVIFTIPYSGCGTFKQADNDTIDYSNFLTAAVSGGIIKRRTDLRIHVSCRMLQNTWVDTMYIANDTIHVANNTIQVEEVQYGNFDVNISFYTSSSFLYPVTSRPYYVDLNQDLYVQAEILHSDAVLTLFVDTCVASPYSNDFTSLTYDLIRSGCVRDDTYGPYSSPSLRIARFRFRAFHFLNRFPSVYLRCKMVVCRAYDPSSRCYRGCVLRSKRDVGSYQEKVDVVLGPIQLQTPPRREEEPR

SEQ ID NO: 4287 - protein, 1785 aa, Homo Sapiens; identical to SEQ ID NO: 4283

SEQ ID NO: 4288 - protein, 2403 aa, Homo Sapiens; identical to SEQ ID NO: 4285

SEQ ID NO: 4289 - protein, 2413 aa, Homo Sapiens; identical to SEQ ID NO: 4284

SEQ ID NO: 4290 - protein, 33 aa, Homo Sapiens
MFNFDTFWKNFKSKLGFINWDAINKDQRSSRIP

SEQ ID NO: 4291 - protein, 33 aa, Homo Sapiens; identical to SEQ ID NO: 4290

SEQ ID NO: 4292 - protein, 95 aa, Homo Sapiens
MFNFDTFWKNFKSKLGFINWDAINKNQVPPPSTRALLYFSRLWEDFKQNTPFLNWKAIIEGADASSLQKRAGRDDQNYNYNQHAYPTAYGGKYSV

SEQ ID NO: 4293 - protein, 123 aa, Homo Sapiens
MFNFDTFWKNFKSKLGFINWDAINKNQVPPPSTRALLYFSRLWEDFKQNTPFLNWKAIIEGADASSLQKRAGRDDQNYNYNQHAYPTAYGGKYSVKTPAKGGVSPSSSASRVQPGLLQWVKFW

SEQ ID NO: 4294 - protein, 123 aa, Homo Sapiens; identical to SEQ ID NO: 4293

SEQ ID NO: 4295 - protein, 476 aa, Homo Sapiens
MKFQGPLACLLLALCLGSGEAGPLQSGEESTGTNIGEALGHGLGDALSEGVGKAIGKEAGGAAGSKVSEALGQGTREAVGTGVRQVPGFGVADALGNRVGEAAHALGNTGHEIGRQAEDVIRHGADAVRGSWQGVPGHNGAWETSGGHGIFGSQGGLGGQGQGNPGGLGTPWVHGYPGNSAGSFGMNPQGAPWGQGGNGGPPNFGTNTQGAVAQPGYGSVRASNQNEGCTNPPPSGSGGGSSNSGGGSGSQSGSSGSGSNGDNNNGSSSGGSSSGSSSGGSSGGSSGGSSGNSGGSRGDSGSESSWGSSTGSSSGNHGGSGGGNGHKPGCEKPGNEARGSGESGIQNSETSPGMFNFDTFWKNFKSKLGFINWDAINKNQVPPPSTRALLYFSRLWEDFKQNTPFLNWKAIIEGADASSLQKRAGRDDQNYNYNQHAYPTAYGGKYSVKTPAKGGVSPSSSASRVQPGLLQWVKFW

SEQ ID NO: 4296 - protein, 386 aa, Homo Sapiens
MKFQGPLACLLLALCLGSGEAGPLQSGEESTGTNIGEALGHGLGDALSEGVGKAIGKEAGGAAGSKVSEALGQGTREAVGTGVRQVPGFGVADALGNRVGEAAHALGNTGHEIGRQAEDVIRHGADAVRGSWQGVPGHNGAWETSGGHGIFGSQGGLGGQGQGNPGGLGTPWVHGYPGNSAGSFGMNPQGAPWGQGGNGGPPNFGTNTQGAVAQPGYGSVRASNQNEGCTNPPPSGSGGGSSNSGGGSGSQSGSSGSGSNGDNNNGSSSGGSSSGSSSGGSSGGSSGGSSGNSGGSRGDSGSESSWGSSTGSSSGNHGGSGGGNGHKPGCEKPGNEARGSGESGIQNSETSPGMFNFDTFWKNFKSKLGFINWDAINKDQRSSRIP

SEQ ID NO: 4297 - protein, 436 aa, Homo Sapiens
MKFQGPLACLLLALCLGSGEAGPLQSGEESTGTNIGEALGHGLGDALSEGVGKAIGKEAGGAAGSKVSEALGQGTREAVGTGVRQVPGFGVADALGNRVGEAAHALGNTGHEIGRQAEDVIRHGADAVRGSWQGVPGHNGAWETSGGHGIFGSQGGLGGQGQGNPGGLGTPWVHGYPGNSAGSFGMNPQGAPWGQGGNGGPPNFGTNTQGAVAQPGYGSVRASNQNEGCTNPPPSGSGGGSSNSGGGSGSQSGSSGSGSNGDNNNGSSSGGSSSGSSSGGSSGGSSGGSSGNSGGSRGDSGSESSWGSSTGSSSGNHGGSGGGNGHKPGCEKPGNEARGSGESGIQGFRGQGVSSNMREISKEGNRLLGGSGDNYRGQGSSWGSGGGDAVGGVNTVNSETSPGMFNFDTFWKNFKSKLGFINWDAINKDQRSSRIP

SEQ ID NO: 4298 - protein, 398 aa, Homo Sapiens
MKFQGPLACLLLALCLGSGEAGPLQSGEESTGTNIGEALGHGLGDALSEGVGKAIGKEAGGAAGSKVSEALGQGTREAVGTGVRQVPGFGVADALGNRVGEAAHALGNTGHEIGRQAEDVIRHGADAVRGSWQGVPGHNGAWETSGGHGIFGSQGGLGGQGQGNPGGLGTPWVHGYPGNSAGSFGMNPQGAPWGQGGNGGPPNFGTNTQGAVAQPGYGSVRASNQNEGCTNPPPSGSGGGSSNSGGGSGSQSGSSGSGSNGDNNNGSSSGGSSSGSSSGGSSGGSSGGSSGNSGGSRGDSGSESSWGSSTGSSSGNHGGSGGGNGHKPGCEKPGNEARGSGESGIQGFRGQGVSSNMRNSETSPGMFNFDTFWKNFKSKLGFINWDAINKDQRSSRIP

SEQ ID NO: 4299 - protein, 369 aa, Homo Sapiens
MKFQGPLACLLLALCLGSGEAGPLQSGEESTGTNIGEALGHGLGDALSEGVGKAIGKEAGGAAGSKVSEALGQGTREAVGTGVRQVPGFGVADALGNRVGEAAHALGNTGHEIGRQAEDVIRHGADAVRGSWQGVPGHNGAWETSGGHGIFGSQGGLGGQGQGNPGGLGTPWVHGYPGNSAGSFGMNPQGAPWGQGGNGGPPNFGTNTQGAVAQPGYGSVRASNQNEGCTNPPPSGSGGGSSNSGGGSGSQSGSSGSGSNGDNNNGSSSGGSSSGSSSGGSSGGSSGGSSGNSGGSRGDSGSESSWGSSTGSSSGNHGGSGGGNGHKPGNSETSPGMFNFDTFWKNFKSKLGFINWDAINKDQRSSRIP

SEQ ID NO: 4300 - protein, 449 aa, Homo Sapiens
MKFQGPLACLLLALCLGSGEAGPLQSGEESTGTNIGEALGHGLGDALSEGVGKAIGKEAGGAAGSKVSEALGQGTREAVGTGVRQVPGFGVADALGNRVGEAAHALGNTGHEIGRQAEDVIRHGADAVRGSWQGVPGHNGAWETSGGHGIFGSQGGLGGQGQGNPGGLGTPWVHGYPGNSAGSFGMNPQGAPWGQGGNGGPPNFGTNTQGAVAQPGYGSVRASNQNEGCTNPPPSGSGGGSSNSGGSSTGSSSGNHGGSGGGNGHKPGCEKPGNEARGSGESGIQGQGSSWGSGGGDAVGGVNTVNSETSPGMFNFDTFWKNFKSKLGFINWDAINKNQVPPPSTRALLYFSRLWEDFKQNTPFLNWKAIIEGADASSLQKRAGRDDQPGAGWQEVAAVTSKNYNYNQHAYPTAYGGKYSVKTPAKGGVSPSSSASRVQPGLLQWVKFW

SEQ ID NO: 4301 - protein, 465 aa, Homo Sapiens
MKFQGPLACLLLALCLGSGEAGPLQSGEESTGTNIGEALGHGLGDALSEGVGKAIGKEAGGAAGSKVSEALGQGTREAVGTGVRQVPGFGVADALGNRVGEAAHALGNTGHEIGRQAEDVIRHGADAVRGSWQGVPGHNGAWETSGGHGIFGSQGGLGGQGQGNPGGLGTPWVHGYPGNSAGSFGMNPQGAPWGQGGNGGPPNFGTNTQGAVAQPGYGSVRASNQNEGCTNPPPSGSGGGSSNSGGSSTGSSSGNHGGSGGGNGHKPGCEKPGNEARGSGESGIQGFRGQGVSSNMREISKEGNRLLGGSGDNYRGQGSSWGSGGGDAVGGVNTVNSETSPGMFNFDTFWKNFKSKLGFINWDAINKNQVPPPSTRALLYFSRLWEDFKQNTPFLNWKAIIEGADASSLQKRAGRDDQNYNYNQHAYPTAYGGKYSVKTPAKGGVSPSSSASRVQPGLLQWVKFW

SEQ ID NO: 4302 - protein, 36 aa, Homo Sapiens
MLGITSCSDQQAKEGEGIQHRLLLRQPRWERRRKWT

SEQ ID NO: 4303 - protein, 36 aa, Homo Sapiens; identical to SEQ ID NO: 4302

SEQ ID NO: 4304 - protein, 36 aa, Homo Sapiens; identical to SEQ ID NO: 4302

SEQ ID NO: 4305 - protein, 36 aa, Homo Sapiens; identical to SEQ ID NO: 4302

SEQ ID NO: 4306 - protein, 36 aa, Homo Sapiens; identical to SEQ ID NO: 4302

SEQ ID NO: 4307 - protein, 36 aa, Homo Sapiens; identical to SEQ ID NO: 4302

SEQ ID NO: 4308 - protein, 36 aa, Homo Sapiens; identical to SEQ ID NO: 4302

SEQ ID NO: 4309 - protein, 36 aa, Homo Sapiens; identical to SEQ ID NO: 4302

SEQ ID NO: 4310 - protein, 36 aa, Homo Sapiens; identical to SEQ ID NO: 4302

SEQ ID NO: 4311 - protein, 36 aa, Homo Sapiens; identical to SEQ ID NO: 4302

SEQ ID NO: 4312 - protein, 36 aa, Homo Sapiens; identical to SEQ ID NO: 4302

SEQ ID NO: 4313 - protein, 36 aa, Homo Sapiens; identical to SEQ ID NO: 4302

SEQ ID NO: 4314 - protein, 36 aa, Homo Sapiens; identical to SEQ ID NO: 4302

SEQ ID NO: 4315 - protein, 36 aa, Homo Sapiens; identical to SEQ ID NO: 4302

SEQ ID NO: 4316 - protein, 36 aa, Homo Sapiens; identical to SEQ ID NO: 4302

SEQ ID NO: 4317 - protein, 36 aa, Homo Sapiens; identical to SEQ ID NO: 4302

SEQ ID NO: 4318 - protein, 36 aa, Homo Sapiens; identical to SEQ ID NO: 4302

SEQ ID NO: 4319 - protein, 253 aa, Homo Sapiens
MLGITSCSDQQAKEGEGLEGSSTGSSSGNHGGSGGGNGHKPGCEKPGNEARGSGESGIQGFRGQGVSSNMREISKEGNRLLGGSGDNYRGQGSSWGSGGGDAVGGVNTVNSETSPGMFNFDTFWKNFKSKLGFINWDAINKNQVPPPSTRALLYFSRLWEDFKQNTPFLNWKAIIEGADASSLQKRAGRDDQPGAGWQEVAAVTSKNYNYNQHAYPTAYGGKYSVKTPAKGGVSPSSSASRVQPGLLQWVKFW

SEQ ID NO: 4320 - protein, 131 aa, Homo Sapiens
MLGITSCSDQQAKEGEGLEGSSTGSSSGNHGGSGGGNGHKPGCEKPGNEARGSGESGIQGFRGQGVSSNMRGQGSSWGSGGGDAVGGVNTVNSETSPGMFNFDTFWKNFKSKLGFINWDAINKDQRSSRIP

SEQ ID NO: 4321 - protein, 201 aa, Homo Sapiens
MLGITSCSDQQAKEGEGLEGSSTGSSSGNHGGSGGGNGHKPGCEKPGNEARGSGESGIQGFRGQGVSSNMRNSETSPGMFNFDTFWKNFKSKLGFINWDAINKNQVPPPSTRALLYFSRLWEDFKQNTPFLNWKAIIEGADASSLQKRAGRDDQNYNYNQHAYPTAYGGKYSVKTPAKGGVSPSSSASRVQPGLLQWVKFW

SEQ ID NO: 4322 - protein, 116 aa, Homo Sapiens
MLGITSCSDQQAKEGEGLEGSSTGSSSGNHGGSGGGNGHKPGCEKPGNEARGSGESGIQGQGSSWGSGGGDAVGGVNTVNSETSPGMFNFDTFWKNFKSKLGFINWDAINKDQRSS

SEQ ID NO: 4323 - protein, 184 aa, Homo Sapiens
MLGITSCSDQQAKEGEGLEGSSTGSSSGNHGGSGGGNGHKPGCEKPGNEARGSGESGIQNSETSPGMFNFDTFWKNFKSKLGFINWDAINKDFKQNTPFLNWKAIIEGADASSLQKRAGRDDQPGAGWQEVAAVTSKNYNYNQHAYPTAYGGKYSVKTPAKGGVSPSSSASRVQPGLLQWVKFW

SEQ ID NO: 4324 - protein, 99 aa, Homo Sapiens
MLGITSCSDQQAKEGEGLEGSSTGSSSGNHGGSGGGNGHKPGCEKPGNEARGSGESGIQNSETSPGMFNFDTFWKNFKSKLGFINWDAINKDQRSSRIP

SEQ ID NO: 4325 - protein, 189 aa, Homo Sapiens
MLGITSCSDQQAKEGEGLEGSSTGSSSGNHGGSGGGNGHKPGCEKPGNEARGSGESGIQNSETSPGMFNFDTFWKNFKSKLGFINWDAINKNQVPPPSTRALLYFSRLWEDFKQNTPFLNWKAIIEGADASSLQKRAGRDDQNYNYNQHAYPTAYGGKYSVKTPAKGGVSPSSSASRVQPGLLQWVKFW

SEQ ID NO: 4326 - protein, 203 aa, Homo Sapiens
MLGITSCSDQQAKEGEGLEGSSTGSSSGNHGGSGGGNGHKPGCEKPGNEARGSGESGIQNSETSPGMFNFDTFWKNFKSKLGFINWDAINKNQVPPPSTRALLYFSRLWEDFKQNTPFLNWKAIIEGADASSLQKRAGRDDQPGAGWQEVAAVTSKNYNYNQHAYPTAYGGKYSVKTPAKGGVSPSSSASRVQPGLLQWVKFW

SEQ ID NO: 4327 - protein, 203 aa, Homo Sapiens; identical to SEQ ID NO: 4326

SEQ ID NO: 4328 - protein, 82 aa, Homo Sapiens
MLGITSCSDQQAKEGEGLEGSSTGSSSGNHGGSGGGNGHKPGNSETSPGMFNFDTFWKNFKSKLGFINWDAINKDQRSSRIP

SEQ ID NO: 4329 - protein, 172 aa, Homo Sapiens
MLGITSCSDQQAKEGEGLEGSSTGSSSGNHGGSGGGNGHKPGNSETSPGMFNFDTFWKNFKSKLGFINWDAINKNQVPPPSTRALLYFSRLWEDFKQNTPFLNWKAIIEGADASSLQKRAGRDDQNYNYNQHAYPTAYGGKYSVKTPAKGGVSPSSSASRVQPGLLQWVKFW

SEQ ID NO: 4330 - protein, 90 aa, Homo Sapiens
MNMKPATASALLLLLLGLAWTQGSHGWGADASSLQKRAGRDDQNYNYNQHAYPTAYGGKYSVKTPAKGGVSPSSSASRVQPGLLQWVKFW

SEQ ID NO: 4331 - protein, 36 aa, Homo Sapiens
SGNHGGSGGGNGHKPGISRLWLTKWVLLSSHISLVP

SEQ ID NO: 4332 - protein, 152 aa, Homo Sapiens
SSTGSSSGNHGGSGGGNGHKPGNSETSPGMFNFDTFWKNFKSKLGFINWDAINKNQVPPPSTRALLYFSRLWEDFKQNTPFLNWKAIIEGADASSLQKRAGRDDQNYNYNQHAYPTAYGGKYSVKTPAKGGVSPSSSASRVQPGLLQWVKFW

SEQ ID NO: 4333 - protein, 74 aa, Homo Sapiens
  misc_feature (1)..(1): Xaa can be any naturally occurring amino acid
XALLLLLLGLAWTQGSHGWGADASSLQKRAGRDDQNYNYNQHAYPTAYGGKYSVKTPAKASRVQPGLLQWVKFW

SEQ ID NO: 4334 - protein, 201 aa, Homo Sapiens
  misc_feature (1)..(1): Xaa can be any naturally occurring amino acid
XGGGNGHKPGCEKPGNEARGSGESGIQGFRGQGVSSNMREISKEGNRLLGGSGDNYRNSETSPGMFNFDTFWKNFKSKLGFINWDAINKNQVPPPSTRALLYFSRLWEDFKQNTPFLNWKAIIEGADASSLQKRAGRDDQPGAGWQEVAAVTSKNYNYNQHAYPTAYGGKYSVKTPAKGGVSPSSSASRVQPGLLQWVKFW

SEQ ID NO: 4335 - protein, 109 aa, Homo Sapiens
  misc_feature (1)..(1): Xaa can be any naturally occurring amino acid
XPATASALLLLLLGLAWTQGSHGWVGTAGCTGCGRVITAETCRQRRSELQLQPACVSHCLWWEVLSQDPCKGGSLTFFLGFPGATWPAAVGEVLVGNFLQPPPRPRKAL

SEQ ID NO: 4336 - protein, 96 aa, Homo Sapiens
  misc_feature (1)..(1): Xaa can be any naturally occurring amino acid
XPPPSTRALLYFSRLWEDFKQNTPFLNWKAIIEGADASSLQKRAGRDDQNYNYNQHAYPTAYGGKYSVKTPAKGGVSPSSSASRVQPGLLQWVKFW

SEQ ID NO: 4337 - protein, 497 aa, Homo Sapiens
MKISILLMFLWGLSCALPVTRYQNNESEDSEEWKGHLAQAPTPPLANEDPSDSTQSEEGLGSDDHQYIYRLAGGFSRSTGKGGDDKDDDEDDSGDDTFGDDDSGPGPKDRQEGGNSRLGSDEDSDDTIQASEESAPQGQDSAQDTTSESRELDNEDRVDSKPEGGDSTQESESEEHWVGGGSDGESSHGDGSELDDEGMQSDDPESIRSERGNSRMNSAGMKSKESGENSEQANTQDSGGSQLLEHPSRKIFRKSRISEEDDRSELDDNNTMEEVKSDSTENSNSRDTGLSQPRRDSKGDSQEDSKENLSQEESQNVDGPSSESSQEANLSSQENSSESQEEVVSESRGDNPDPTTSYVEDQEDSDSSEEDSSHTLSHSKSESREEQADSESSESLNFSEESPESPEDENSSSQEGLQSHSSSAESQSEESHSEEDDSDSQDSSRSKEDSNSTESKSSSEEDGQLKNIEIESRKLTVDAYHNKPIGDQDDNDCQDGY

SEQ ID NO: 4338 - protein, 513 aa, Homo Sapiens
MKISILLMFLWGLSCALPVTRYQNNESEDSEEWKGHLAQAPTPPLESSESSEGSKVSSEEQANEDPSDSTQSEEGLGSDDHQYIYRLAGGFSRSTGKGGDDKDDDEDDSGDDTFGDDDSGPGPKDRQEGGNSRLGSDEDSDDTIQASEESAPQGQDSAQDTTSESRELDNEDRVDSKPEGGDSTQESESEEHWVGGGSDGESSHGDGSELDDEGMQSDDPESIRSERGNSRMNSAGMKSKESGENSEQANTQDSGGSQLLEHPSRKIFRKSRISEEDDRSELDDNNTMEEVKSDSTENSNSRDTGLSQPRRDSKGDSQEDSKENLSQEESQNVDGPSSESSQEANLSSQENSSESQEEVVSESRGDNPDPTTSYVEDQEDSDSSEEDSSHTLSHSKSESREEQADSESSESLNFSEESPESPEDENSSSQEGLQSHSSSAESQSEESHSEEDDSDSQDSSRSKEDSNSTESKSSSEEDGQLKNIEIESRKLTVDAYHNKPIGDQDDNDCQDGY

SEQ ID NO: 4339 - protein, 542 aa, Homo Sapiens
MELRSELPSVPGAATAAAATATGPPVASVASVAAAAAAAASLPVSVAGGLLRGPPLLLRAAEKYPRTPKCARCRNHGVVSALKGHKRYCRWKDCLCAKCTLIAERQRVMAAQVALRRQQAQEENEARELQLLYGTAEGLALAAANGIIPPRPAYEVFGSVCAADGGGPGAGAPAGTGGGAAGAGGSEAKLQKFDLFPKTLLQAGRPGSPLPPPVKPLSPDGADSGPGTSSPEVRPGSGSENGDGESFSGSPLARASKEAGGSCPGSAGPGGGGEEDSPGSASPLGSESGSEADKEEGEAAPAPGLGGGSGPRQRTPLDILTRVFPGHRRGVLELVLQGCGGDVVQAIEQVLNHHRGGLAAGLGPAAPPDKAAVGAAAAADDAWPSRVDAAAAAAAAAGGPGLPAPLQAGPAAPPHHRPLLAGAMAPGALGSLSSRSAFSPLQPNASHFGADAGAYPLGAPLGLSPLRLAYSAAAAHSRGLAFMAPYSTAGLVPTLGFRPPMDYAFSDLMRDRSAAAAAAVHKEPTYGGGLYGPMVNGAPEKQ

SEQ ID NO: 4340 - protein, 542 aa, Homo Sapiens; identical to SEQ ID NO: 4339

SEQ ID NO: 4341 - protein, 855 aa, Homo Sapiens
MAALGVAEAVAAPHPAEGAETAEAVELSRALSRLLPGLEADSKPGRRRALEALRRALEEPGPAADPTAFQGPWARLLLPRLLRCLSDPAEGCRALAVHLLDLGLRRAARPRDALPRLLPALAARLAGPVPARRPPEACEELRLALVQLLGLAVDLCGAALAPHLDDALRALRCSLLDPFAAVRRESCSCAAALAQATPDHFHMQSESLIGPLMQTISHQHWKVRVAAIEATGAVIHFGNGKSVDDVLSHFAQRLFDDVPQVRRAVASVVGGWLLCLRDRYSFFHKLIPLLLSSLNDEVPEVRQLAASLWEDVGLQWQKENEEDLKDKLDFAPPTPPHYPPHERRPVLGCRELVFRNLSKILPALCHDITDWVVGTRVKSAQLLPVLLLHAEDHATQHLEVVLRTLFQACTDEEAAVVQSCTRSAELVGTFVSPEVFLKLILSTLKKTPSASGLLVLASAMRGCPREALQPHLAAIATELAQAHICQASENDLYLERLLLCVQALVSVCHEDCGVASLQLLDVLLTIVALAGATGLRDKAQETMDSLAMVEGVSSCQDLYRKHIGPLLERVTASHLDWTAHSPELLQFSVIVAQSGPALGEALPHVVPTLRACLQPSQDPQMRLKLFSILSTVLLRATDTINSQGQFPSYLETVTKDILAPNLQWHAGRTAAAIRTAAVSCLWALTSSEVLSAEQIRDVQETLMPQVLTTLEEDSKMTRLISCRIINTFLKTSGGMTDPEKLIRIYPELLKRLDDVSNDVRMAAASTLVTWLQCVKGANAKSYYQSSVQYLYRELLVHLDDPERAIQDAILEVLKEGSGLFPDLLVRETEAVIHKHRSATYCEQLLQHVQAVPATQ

SEQ ID NO: 4342 - protein, 280 aa, Homo Sapiens
MTGGAREKAHIARSPATAQGPALGEALPHVVPTLRACLQPSQDPQMRLKLFSILSTVLLRATDTINSQGQFPSYLETVTKDILAPNLQWHAGRTAAAIRTAAVSCLWALTSSEVLSAEQIRDVQETLMPQVLTTLEEDSKMTRLISCRIINTFLKTSGGMTDPEKLIRIYPELLKRLDDVSNDVRMAAASTLVTWLQCVKGANAKSYYQSSVQYLYRELLVHLDDPERAIQDAILEVLKEGSGLFPDLLVRETEAVIHKHRSATYCEQLLQHVQAVPATQ

SEQ ID NO: 4343 - protein, 196 aa, Homo Sapiens
  misc_feature (1)..(1): Xaa can be any naturally occurring amino acid
XLCARCAAPCSTPSPPCAARAAAAPPPWRRPRPVRRAVASVVGGWLLCLRDRYSFFHKLIPLLLSSLNDEVPEVRQLAASLWEDVGLQWQKENEEDLKDKLDFAPPTPPHYPPHERRPVLGCRELVFRNLSKILPALCHDITDWVVGTRVKSAQLLPVLLLHAEDHATQHLEVVLRTLFQACTDEEAAVVQSCTRS

SEQ ID NO: 4344 - protein, 657 aa, Homo Sapiens
  misc_feature (1)..(1): Xaa can be any naturally occurring amino acid
XSPPCAARAAAAPPPWRRPRPHWKVRVAAIEATGAVIHFGNGKSVDDVLSHFAQRLFDDVPQVRRAVASVVGGWLLCLRDRYSFFHKLIPLLLSSLNDEVPEVRQLAASLWEDVGLQWQKENEEDLKDKLDFAPPTPPHYPPHERRPVLGCRELVFRNLSKILPALCHDITDWVVGTRVKSAQLLPVLLLHAEDHATQHLEVVLRTLFQACTDEEAAVVQSCTRSAELVGTFVSPEVFLKLILSTLKKTPSASGLLVLASAMRGCPREALQPHLAAIATELAQAHICQASENDLYLERLLLCVQALVSVCHEDCGVASLQLLDVLLTIVALAGATGLRDKAQETMDSLAMVEGVSSCQDLYRKHIGPLLERVTASHLDWTAHSPELLQFSVIVAQSGPALGEALPHVVPTLRACLQPSQDPQMRLKLFSILSTVLLRATDTINSQGQFPSYLETVTKDILAPNLQWHAGRTAAAIRTAAVSCLWALTSSEVLSAEQIRDVQETLMPQVLTTLEEDSKMTRLISCRIINTFLKTSGGMTDPEKLIRIYPELLKRLDDVSNDVRMAAASTLVTWLQCVKGANAKSYYQSSVQYLYRELLVHLDDPERAIQDAILEVLKEGSGLFPDLLVRETEAVIHKHRSATYCEQLLQHVQAVPATQ

SEQ ID NO: 4345 - protein, 68 aa, Homo Sapiens
AEGEGLVLPKKIRVRSAVEQWLVNVEKSMFDVLKKFLSQGIEDWNCQMFSQWVLSHPGQVVLTVTFAI

SEQ ID NO: 4346 - protein, 130 aa, Homo Sapiens
DYLEVKRLIFPRFYFLSNAELLDILADSRNPESVQPHLVKCFENIKQLLIWKQDIGPPAVKMLISAEGEGLVLPKYDKCYKLFRFCTTSLFKISALKFLIYYKSALSKLFLQRLYPYVNILLPFHIPYNT

SEQ ID NO: 4347 - protein, 430 aa, Homo Sapiens
METFIPIDLTTENQEMDKEETKTKPRLLRYEEKKYEDVKPLETQPAEIAEKETLEYKTVRTFSESLKSEKTEDYLRESIIQQHMVSPEPASLKEKGKSRRKKDQTHACPNVRKARPVSYDRTEPKDDDVIRNIIRLREKLGWQTILPQHSLKYGSSKIAIQKITLKKPLEDDGEFVYCLPRKSPKSLYNPYDLQVINIVGSVKEVELIPTLEWLSERRHYYLLRQFKIFSDFRMNKAFVTWKLNVKRIKTEKSRSFLYHHLFLADDLFQTCLVYIRGLCEDAINLKNYNDHENNLSAICLVKLDSSRTYSLDEFCEEQLQQATQALKQLEDIRNKAISEMKSTFLKVAEKNEIKEYFESKLSEDDTTHFKLPKYRRLLETFFKFVMLVDYIFQELIRQLMNTAVTLLLELFNGSAGMPFSVEKKNENLIR

SEQ ID NO: 4348 - protein, 228 aa, Homo Sapiens
METFIPIDLTTENQEMDKEETKTKPRLLRYEEKKYEDVKPLETQPAEIAEKETLEYKTVRTFSESLKSEKTEDYLRESIIQQHMVSPEPASLKEKGKSRRKKDQTHACPNVRKARPVSYDRTEPKDDDVIRNIIRLREKLGWQTILPQHSLKYGSSKIAIQKITLKKPLEDDGEFVYCLPRKSPKSLYNPYDLQVVSAHTAKHCKEFWVITASFISKRYLVICGAVYI

SEQ ID NO: 4349 - protein, 228 aa, Homo Sapiens; identical to SEQ ID NO: 4348

SEQ ID NO: 4350 - protein, 4515 aa, Homo Sapiens
METFIPIDLTTENQEMDKEETKTKPRLLRYEEKKYEDVKPLETQPAEIAEKETLEYKTVRTFSESLKSEKTEDYLRESIIQQHMVSPEPASLKEKGKSRRKKDQTHACPNVRKARPVSYDRTEPKDDDVIRNIIRLREKLGWQTILPQHSLKYGSSKIAIQKITLKKPLEDDGEFVYCLPRKSPKSLYNPYDLQVVSAHTAKHCKEFWVITASFISKVINIVGSVKEVELIPTLEWLSERRHYYLLRQFKIFSDFRMNKAFVTWKLNVKRIKTEKSRSFLYHHLFLADDLFQTCLVYIRGLCEDAINLKNYNDHENNLSAICLVKLDSSRTYSLDEFCEEQLQQATQALKQLEDIRNKAISEMKSTFLKVAEKNEIKEYFESKLSEDDTTHFKLPKYRRLLETFFKFVMLVDYIFQELIRQLMNTAVTLLLELFNGSAGMPFSVEKKNENLIRTFKDNSFPTGKTTNDCEELVDNSKLHAISVQKSEVKTDTDINEILNSVEVGKDLRKTYAPIFEVNLCLRIPAESDSSENSKENFHESDQCPEECVMFEDEMSENKDNCVKKHSSEELLPKAKKSKEISYNLEDIISDTEIETEFENKYMYYEFPEFPTNLFIDPNRLEFSVKIQNMLTNMEKCITTITPLCQDPQLSIFIDLVSIMDLPNKTGSIIHYKEQTRWPDCHILFETDPAYQNIIVNLLTIIGNSMGLVNAYSHKFIKYCTMTEKAKIMSMKISSMGELTSKEFEAILNRFRNYFRHIVNMAIEKRIGIFNVVSLDYQSECLLYIDNVIHMSHTLIQSVIEKKNKNLLEVVESSLQQLECDPTEIEEFLEHFIFLNAISSKISKLEKEFLTMSQLYSVAKHHQIHISEEQIAIFQVLLLKFSQLKSSMKLSKINKDTAITKFRDNLEACISGLHVDVGNLKAKIRTPLLLCAGTQVSTAMEMIQTLSGEAASLTNKAKAYSHYQDCFSDSQSHMHSVNVEEITQIVLSEISDIEGDLTLRKKLWEAQEEWKRASWEWRNSSLQSIDVESVQRNVSKLMHIISVLEKGLPKSDMVTHLKQVVTEFKQELPIIIALGNPCLKPRHWEALQEIIGKSVPLDKNCKVENLLALKMFQYENEINDMSTSATNEAALEKMLFKIIDFWNTTPLPLILHHTEIYSIFIIPSIDDISAQLEESQVILATIKGSPHIGPIKDLVNEWDQNLTLFSYTLEEWMNCQRNWLYLEPVFHSSEIRRQLPAETELFSQVISMWKKIMSKIQNKQNALQITTSAGVLEILQNCNIHLEHIKKSLEDYLEVKRLIFPRFYFLSNAELLDILADSRNPESVQPHLVKCFENIKQLLIWKQDIGPPAVKMLISAEGEGLVLPKKIRVRSAVEQWLVNVEKSMFDVLKKERYIYNIILLFQSQIMFYNDCVKSFVSSYSREKLEKVHAGLMCHLEEVADLVVLDTSNSRTKAILGALLILYVHCRDIVINLLLKNIFNAEDFEWTRHLQYKWNEKQKLCYVSQGNASFTYGYEYLGCTSRLVITPLTDRCWLTLMEALHLNLGGCPAGPAGTGKTETVKDLAKSLGKHCVVFNCFEDLDYKIVRKFFFGLVQSGAWSCFDEFNLIDLEVLSVIASQILTIKAAKDNYSARFVLEGKEIRINMSCAVFITMNPRYGGGVELPDNLKSLFRPVAMMVPHYQMIAEIILFSFGFKSANSLSGKLTNLYELARKQLSQQDHYNFGLRSLKIVLIMAGTKKREFKCLSEADETLIVIEAIREASLPKCPPEDVPLFENIIGDIFPEVTVLKVNQLALEKVIYTATQQLGLQNWSSQKEKIIQFYNQLQVCVGVMLVGPTGGGKTTVRRILEKALTLLPIADFLSVAERKSASKISERKGKVDICVLNPKCVTLSELYGQLDPNTMEWTDGLLSATIRSYVYFNTPKNTKKDIDLRLKSRISDLSNVFKLDSSDTTETDDNIFEEIEKVVKIPENHNFDWQWIILDGPVDTFWVENLNSVLDDTRTLCLANSERIALTNKIRVIFEVDNLSQASPATVSRCAMVYMDPVDLGWEPYVKSWLLKTSKIISQSGVDCLEFMIKNSVTDGLQFIRNRQKFQPYPMEDITVVITLCRILDAFFDFMGKNGGFEQSDDLNDTSSKEANSQRESVTFKDIEKRDENTWYPEKNPDKLTKIIQKLFVFAFTWAFGGALNREDEHRENIPFCPSLEPDSLAKVTYDFDKLVHELFGNSSQVGWKHWGQSQGRRRKGNCINLPTGECSIFGYFVDIEQCEFIPWSDLVPNDQTLIQRGTSLLTNLQRSGGNFLKITECGECINYTATRDTTCLSFLMSLLLKNSCPVLLTGESGVGKTAAINQMLEKLEGPGAFDIKHGSILGDTLLYSEIKKSSSLKQNITILIPETHKTATGSSDNPTKKPEVRTNKKLLKNNDHKGVVVSTINFSTNVTAAKTKEMILKKLIRRTKDTLGAPKNNRILIFIDDMNMPVSDMYGAQPPLELIRQLLDLGGVYDTEKNTWKNIQDLSIVAACVPVVNDISPRLLKHFSMLVLPHPSQDILCTIFQAHLGIYFSINNFTPEVQKSKDQIISCSLAIYHQVRQNMLPTPTKCHYMFNLRDMFKLLLGLLQADRTVVNSKEMAALLFVHEATRVFHDRLIDFTDKSLFYRLLSRELENCFQIGIDGCGKKTCATLACYLTDNKLYRVPISHKCAYIEFKEVFKKVFIHAGLKGKPTVLMVPNLNIEQDSFLEDLNYIISSGRIPDLFENVELDSIAMKIRYLTEQSGHMDNRQSLLSFFQKRIYKNLHIFVIMSPEGPSFRQNCRVYPSMISSCTIDWYERWPEEALLIVANSFLKEKVNFENRENLKEKLAPTCVQIHKSMKDLNRKYFEETGRFYYTTPNSYLQFMETFAHILRAREEEMQTKRDRFHMGLSTILEATTLVTEMQEELLILGPQVEQKTKETETLMEKLRKDSQVVEKVQMLVKQDEEIVAEEVRIVEDYAQKTANELKSVLPAFDKAIVALNALDKADVAELRVYTRPPFLVLTVMNAVCILLQKKPNWATAKLLLSETGFLKKLINLDKDSIPDKVFVKLKKIVTLPDFNPHKISLVSVACCSLCQWVIALNNYHEVQKVVGPKQIQVAEAQNVLKIARQRLAEKQRGLQLVEEHLLFLQAAYKDTVAEKQLLANRKTMASRRFQCASVLLTVLEDEKTRWQETINQIDNKLEGILGDILLSAACIVYSGILTPEFRQLIVNKWETFCIENGISLSSKFSLIKVMAQKYEISRWHNQGLPHGQYSVENAILIKNGQQWPLLIDPHRQAHKWIRQMEGSRLQKLSIEDSNYTKKIENAMKTGGSVLLQNLLETLAPGLKAILKKDIYQKKGHYFIRVGDAEFEYNSNFRLYLSTEIDNPHFLPSVYNFVTMINFTVTFQGLQDQLLSTVVTHEVPHLEDQRSKLLESISLDAITLEELEEKTLNLLQKALGSILDDDKIVDTLRKSKMTSNEISKRIEATKKAESEIQAIRKNYLPIATRGALLYFLVADLTQINYMYQFSLDWFHQVFVSSVVSKSKEQEHSFKREKVSPKEVHEFISISKEPNLENEKNLLDKHIKSAIDMLTKSIFKVVSSALFNEDKLCFSFRLCTVIMQNNANGNLIQDDIGFLPEEEWNIFLYSGILINIKSALSQSRLTSTFEIGESQHLQWLSDSRWRQCQYVSTHLEPFSLLCKSLLSNVSQWDTFKNSKAVYSLISTPFSSENASLEENTKPPEETELLNENKETCNPINFPWEKLTSFQRLILVKVLRPESLNNSVRKFITEKMGNKYLQRTGVNLKDAYKGSNARTPLILIQTHGIDLTNILLRFAQELKGTTHHVTIISLGRDQAAKAEDLILKALTKTQQWVFLQNCHLATSFMPRLCTIVESFNSPNVTIDPEFRLWLSSKSYSSFPIPVLKKGLKIAVESPQGLKSNLLQTFGCTGSGEVTEEIFENPDCGQWWKKLLFSLCFFNAVINERKNYGILGWNIAYKFNSSDLGVAIKVLENSLRGQPSISWQALRYLIGEVIYGGRVIDNWDKRCLKTLLYKFCNPEVLKDDFSFSRSASIKDYIHIIQSLPDDDLPEVLGIHPEAIRSCWETQGEKFIENLIAMQPKTTTANLMIRPEQSKDELVMEILSDLLKRLPLTVEKEEIAVGTPSTLKSMMSSSIWESLSKNLKDHDPLIHCVLLTFLKQEIKRFDKLLFVIHKSLKDLQLAIKGEIILTQELEEIFNSFLNMRVPTLWQKHAYRSCKPLSSWIDDLIQRLNFFNTWAKVAYTAIQRRYMRFVTVWKQSIPSTSQKCKHPEDSENNFFEGFPSRYWLPAFFFPQAFLAAVLQDYGRSRGIAVDALTFTHHVISNTTDKDEKFSVFMPKKLNIVRRAFKGSASSHTGVYIFGLFIEGARWNREQKILEDSLPLEMCCDFPDIYFLPTKISTKTPNASNQTDSELYAFECPVYQTPERSRILATTGLPTNFLTSVYLSTKKPPSHWITMRVALLCEKNEK

SEQ ID NO: 4351 - protein, 453 aa, Homo Sapiens
METFIPIDLTTENQEMDKEETKTKPRLLRYEEKKYEDVKPLETQPAEIAEKETLEYKTVRTFSESLKSEKTEDYLRESIIQQHMVSPEPASLKEKGKSRRKKDQTHACPNVRKARPVSYDRTEPKDDDVIRNIIRLREKLGWQTILPQHSLKYGSSKIAIQKITLKKPLEDDGEFVYCLPRKSPKSLYNPYDLQVVSAHTAKHCKEFWVITASFISKVINIVGSVKEVELIPTLEWLSERRHYYLLRQFKIFSDFRMNKAFVTWKLNVKRIKTEKSRSFLYHHLFLADDLFQTCLVYIRGLCEDAINLKNYNDHENNLSAICLVKLDSSRTYSLDEFCEEQLQQATQALKQLEDIRNKAISEMKSTFLKVAEKNEIKEYFESKLSEDDTTHFKLPKYRRLLETFFKFVMLVDYIFQELIRQLMNTAVTLLLELFNGSAGMPFSVEKKNENLIR

SEQ ID NO: 4352 - protein, 4515 aa, Homo Sapiens; identical to SEQ ID NO: 4350

SEQ ID NO: 4353 - protein, 3507 aa, Homo Sapiens
MGRRSQWIWAMRCQMLVPVLSLHIGLARALGCGCIASKIECLIRCNAPFPLLDAVGSVASQELQSLTGTVGVTSGAAAYPRWNLARARAPPHLPGTQDPLRRVRDPTPIVASSPGRRRGSWSGGYGQEASEPGVVGLCCAVLPIHPSLALAGVGGPDLRRFQEGPQRPSDHGAAEKHMETFIPIDLTTENQEMDKEETKTKPRLLRYEEKKYEDVKPLETQPAEIAEKETLEYKTVRTFSESLKSEKTEEPKDDDVIRNIIRLREKLGWQTILPQHSLKYGSSKIAIQKITLKKPLEDDGEFVYCLPRKSPKSLYNPYDLQVVSAHTAKHCKEFWVITASFISKLDSSRTYSLDEFCEEQLQQATQALKQLEDIRNKAISEMKSTFLKVAEKNEIKEYFESKLSEDDTTHFKLPKYRRLLETFFKFVMLVDYIFQELIRQLMNTAVTLLLELFNGSAGMPFSVEKKNENLIRTFKDNSFPTGKTTNDCEELVDNSKLHAISVQKSEVKTDTDINEILNSVEVGKDLRKTYAPIFEVNLCLRIPAESDSSENSKENFHESDQCPEECVMFEDEMSENKDNCVKKHSSEELLPKAKKSKEISYNLEDIISATITPLCQDPQLSIFIDLVSIMDLPNKTGSIIHYKEQTRWPDCHILFETDPAYQNIIVNLLTIIGNSMGLVNAYSHKFIKYCTMTEKAKIMSMKISSMGELTSKEFEAILNRFRNYFRHIVNMAIEKRIGIFNVVVESSLQQLECDPTEIEEFLEHFIFLNAISSKISKLEKEFLTMSQLYSVAKHHQIHISEEQIAIFQVLLLKFSQLKSSMKLSKINKDTAITKFRDNLEACISGLHVDVGNLKAKIRTPLLLCAGTQVSTAMEMIQTLSGEAASLTNKAKAYSHYQDCFSDSQSHMHSVNVEEITQIVLSEISDIEGDLTLRKKLWEAQEEWKRASWEWRNSSLQSIDVESVQRNVSKLMHIISVLEKEIYSIFIIPSIDDISAQLEESQVILATIKGSPHIGPIKSQIMFYNDCVKSFVSSYSREKLEKVHAGLMCHLEEVADLVVLDTSNSRTKAILGALLILYVHCRDIVINLLLKNIFNAEDFEWTRHLQYKWNEKQKLCYVSQGNASFTYGYEYLGCTSRLVITPLTDRCWLTLMEALHLNLGGCPAGPAGTGKTETVKDLAKCALFAFKCNTALIKLPNSLIVLTCFGLEKTVLVMNTVMSFRFVLEGKEIRINMSCAVFITMNPRYGGGVELPDNLKSLFRPVAMMVPHYQMIAEIILFSFGFKSANSLSGKLTNLYELARKQLSQQDHYNFGLRSLKIVLIMAGTKKREFKCDTSDSLSEADETLIVIEAIREASLPKCPPEDVPLFENIIGDIFPEVTVLKVNQLALEKVIYTATQQLGLQNWSSQKEKIIQFYNQLQVCVGVMLVGPTGGGKTTVRRILEKALTLLPIADFLSVAERKSASKISERKGKVDICVLNPKCVTLSELYGQLDPNTMEWTDGLLSATIRSYVYFNTPKNTKKDIDLRLKSRISDLSNVFKLDSSDTTETDDNIFEEIEKVVKIPENHNFDWQWIILDGPVDTFWVENLNSVLDDTRTLCLANSERIALTNKIRVIFEVDNLSQASPATVSRCAMVYMDPVDLGWEPYVKSWLLKTSKIISQSGVDCLEFMIKNSVTDGLQFIRNRQKFQPYPMEDITVVITLCRILDAFFDFMGKNGGFEQSDDLNDTSSKEANSQRESVTFKDIEKRDENTWYPEKNPDKLTKIIQKLFVFAFTWAFGGALNREDEHRENIPFCPSLEPDSLAKVTYDFDKLVHELFGNSSQVGINLPTGECSIFGYFVDIEQCEFIPWSDLVPNDQTLIQRDNPTKKPEVRTNKKLLKNNDHKGVVVSTINFSTNVTAAKTKEMILKKLIRRTKDTLGAPKNNRILIFIDDMNMPVSDMYGAQPPLELIRQLLDLGGVYDTEKNTWKNIQDLSIVAACVPVVNDISPRLLKHFSMLVLPHPSQDILCTIFQIGIDGCGKKTCATLACYLTDNKLYRVPISHKCAYIEFKEVFKKVFIHAGLKGKPTVLMVPNLNIEQDSFLEDLNYIISSGRIPDLFENVELDSIAMKIRYLTEQSGHMDNRQSLLSFFQKRIYKNLHIFVIMSPEGPSFRQNCRVYPSMISSCTIDWYERWPEEALLIVANSFLKEKVNFENRENLKEKLAPTCVQIHKSMKDLNRKYFEETGRFYYTTPNSYLQFMETFAHILRAREEEMQTKRDRFHMGLSTILEATTLVTEMQEELLILGPQVEQKTKETETLMEKLRKDSQVVEKVQMLVKQDEEIVAEEVRIVEDYAQKTANELKSVLPAFDKAIVALNALDKADVAELRVYTRPPFLVLTVMNAVCILLQKKPNWATAKLLLSETGFLKKLINLDKDSIPDKVFVKLKKIVTLPDFNPHKISLVSVACCSLCQWVIALNNYHEVQKVVGPKQIQVAEAQNVLKIARQRLAEKQRGLQLISRWHNQGLPHGQYSVENAILIKNGQQWPLLIDPHRQAHKWIRQMEGSRLQKLSIEDSNYTKKIENAMKTGGSVLLQSCQASTWRKKLYLSTEIDNPHFLPSVYNFVTMINFTVTFQGLQDQLLSTVVTHEVPHLEDQRSKLLESISLDAITLEELEEKTLNLLQKALGSILDDDKIVDTLRKSKMTSNEISKRIEATKKAESEIQAIRKNYLPIATRGALLYFLVADLTQINYMYQFSLDWFHQVFVSSVVSKSKEQEHSFKREKVSPKEVHEFISISKEPNLENEKNLLDKHIKSAIDMLTKSIFKVVSSALFNEDKLCFSFRLCTVIMQNNANGNLIQDDIGFLPEEEWNIFLYSGILINIKSALSQSRLTSTFEIGESQHLQWLSDSRWRQCQYVSTHLEPFSLLCKSLLSNVSQWDTFKNSKAVYSLISTPFSSENASLEENTKPPEEKHTFCLLLRAINHTGTDLGPVGRGQWLTSTACDRHTDVCSFSFALNDGVPDVEHVQDIFYGHCVDKYHVKVLRPESLNNSVRKFITEKMGNKYLQRTGVNLKDAYKGSNARTPLILIQTHGSASIKDYIHIIQSLPDDDLPEVLGIHPEAIRSCWETQGEKFIENLIAMQPKTTTANLMIRPEQSKDELVMEILSDLLKRLPLTVEKEEIAVGTPSTLKSMMSSSIWESLSKNLKDHDPLIHCVLLTFLKQEIKRFDKLLFVIHKSLKDLQLAIKGEIILTQELEEIFNSFLNMRVPTLWQKHAYRSCKPLSSWIDDLIQRLNFFNTWAKVAYTAIQRRYMRFVTVWKQSIPSTSQKCKHPEDSENNFFEGFPSRYWLPAFFFPQAFLAAVLQDYGRSRGIAVDALTFTHHVISNTTDKDEKFSVFMPKKLNIVRRAFKGSASSHTGVYIFGLFIEGARWNREQKILEDSLPLEMCCDFPDIYFLPTKISTKTPNASNQTDSELYAFECPVYQTPERSRILATTGLPTNFLTSVYLSTKKPPSHWITMRVALLCEKNEK

SEQ ID NO: 4354 - protein, 1481 aa, Homo Sapiens
  misc_feature (1)..(1): Xaa can be any naturally occurring amino acid
XELFGNSSQVGINLPTGECSIFGYFVDIEQCEFIPWSDLVPNDQTLIQRGTSLLTNLQRSGGNFLKITECGECINYTATRDTTCLSFLMSLLLKNSCPVLLTGESGVGKTAAINQMLEKLEGPGAFDIKHGSILGDTLLYSEIKKSSSLKQNITILIPETHKTATGSSDNPTKKPEVRTNKKLLKNNDHKGVVVSTINFSTNVTAAKTKEMILKKLIRRTKDTLGAPKNNRILIFIDDMNMPVSDMYGAQPPLELIRQLLDLGGVYDTEKNTWKNIQDLSIVAACVPVVNDISPRLLKHFSMLVLPHPSQDILCTIFQLLLGLLQADRTVVNSKEMAALLFVHEATRVFHDRLIDFTDKSLFYRLLSRELENCFQIQWTQENLMNHSTVFLDFLDINKTHRKKIYQNTSDYNKLASVLDEFQMKLGSISLELSHSMVFFKEAIEHIIRATRVLRQPGSHMLLIGIDGCGKKTCATLACYLTDNKLYRVPISHKCAYIEFKEVFKKVFIHAGLKGKPTVLMVPNLNIEQDSFLEDLNYIISSGRIPDLFENVELDSIAMKIRYLTEQSGHMDNRQSLLSFFQKRIYKNLHIFVIMSPEGPSFRQNCRVYPSMISSCTIDWYERWPEEALLIVANSFLKEKVNFENRENLKEKLAPTCVQIHKSMKDLNRKYFEETGRFYYTTPNSYLQFMETFAHILRAREEEMQTKRDRFHMGLSTILEATTLVTEMQEELLILGPQVEQKTKETETLMEKLRKDSQVVEKVQMLVKQDEEIVAEEVRIVEDYAQKTANELKSVLPAFDKAIVALNALDKADVAELRVYTRPPFLVLTVMNAVCILLQKKPNWATAKLLLSETGFLKKLINLDKDSIPDKVFVKLKKIVTLPDFNPHKISLVSVACCSLCQWVIALNNYHEVQKVVGPKQIQVAEAQNVLKIARQRLAEKQRGLQLVEEHLLFLQAAYKDTVAEKQLLANRKTMASRRFQCASVLLTVLEDEKISRWHNQGLPHGQYSVENAILIKNGQQWPLLIDPHRQAHKWIRQMEGSRLQKLSIEDSNYTKKIENAMKTGGSVLLQNLLETLAPGLKAILKKDIYQKKGHYFIRVGDAEFEYNSNFRLYLSTEIDNPHFLPSVYNFVTMINFTVTFQGLQDQLLSTVVTHEVPHLEDQRSKLLESISLDAITLEELEEKTLNLLQKALGSILDDDKIVDTLRKSKMTSNEISKRIEATKKAESEIQAIRKNYLPIATRGALLYFLVADLTQINYMYQFSLDWFHQVFVSSVVSKSKEQEHSFKREKVSPKEVHEFISISKEPNLENEKNLLDKHIKSAIDMLTKSIFKVVSSALFNEDKLCFSFRLCTVIMQNNANGNLIQDDIGFLPEEEWNIFLYSGILINIKSALSQSRLTSTFEIGESQHLQWLSDSRWRQCQYVSTHLEPFSLLCKSLLSNVSQWDTFKNSKAVYSLISTPFSSENASLEENTKPPEESKSS

SEQ ID NO: 4355 - protein, 1477 aa, Homo Sapiens
  misc_feature (1)..(1): Xaa can be any naturally occurring amino acid
XELFGNSSQVGINLPTGECSIFGYFVDIEQCEFIPWSDLVPNDQTLIQRGTSLLTNLQRSGGNFLKITECGECINYTATRDTTCLSFLMSLLLKNSCPVLLTGESGVGKTAAINQMLEKLEGPGAFDIKHGSILGDTLLYSEIKKSSSLKQNITILIPETHKTATGSSDNPTKKPEVRTNKKLLKNNDHKGVVVSTINFSTNVTAAKTKEMILKKLIRRTKDTLGAPKNNRILIFIDDMNMPVSDMYGAQPPLELIRQLLDLGGVYDTEKNTWKNIQDLSIVAACVPVVNDISPRLLKHFSMLVLPHPSQDILCTIFQLLLGLLQADRTVVNSKEMAALLFVHEATRVFHDRLIDFTDKSLFYRLLSRELENCFQIQWTQENLMNHSTVFLDFLDINKTHRKKIYQNTSDYNKLASVLDEFQMKLGSISLELSHSMVFFKEAIEHIIRATRVLRQPGSHMLLIGIDGCGKKTCATLACYLTDNKLYRVPISHKCAYIEFKEVFKKVFIHAGLKGKPTVLMVPNLNIEQDSFLEDLNYIISSGRIPDLFENVELDSIAMKIRYLTEQSGHMDNRQSLLSFFQKRIYKNLHIFVIMSPEGPSFRQNCRVYPSMISSCTIDWYERWPEEALLIVANSFLKEKVNFENRENLKEKLAPTCVQIHKSMKDLNRKYFEETGRFYYTTPNSYLQFMETFAHILRAREEEMQTKRDRFHMGLSTILEATTLVTEMQEELLILGPQVEQKTKETETLMEKLRKDSQVVEKVQMLVKQDEEIVAEEVRIVEDYAQKTANELKSVLPAFDKAIVALNALDKADVAELRVYTRPPFLVLTVMNAVCILLQKKPNWATAKLLLSETGFLKKLINLDKDSIPDKVFVKLKKIVTLPDFNPHKISLVSVACCSLCQWVIALNNYHEVQKVVGPKQIQVAEAQNVLKIARQRLAEKQRGLQLVEEHLLFLQAAYKDTVAEKQLLANRKTMASRRFQCASVLLTVLEDEKISRWHNQGLPHGQYSVENAILIKNGQQWPLLIDPHRQAHKWIRQMEGSRLQKLSIEDSNYTKKIENAMKTGGSVLLQNLLETLAPGLKAILKKDIYQKKGHYFIRVGDAEFEYNSNFRLYLSTEIDNPHFLPSVYNFVTMINFTVTFQGLQDQLLSTVVTHEVPHLEDQRSKLLESISLDAITLEELEEKTLNLLQKALGSILDDDKIVDTLRKSKMTSNEISKRIEATKKAESEIQAIRKNYLPIATRGALLYFLVADLTQINYMYQFSLDWFHQVFVSSVVSKSKEQEHSFKREKVSPKEVHEFISISKEPNLENEKNLLDKHIKSAIDMLTKSIFKVVSSALFNEDKLCFSFRLCTVIMQNNANGNLIQDDIGFLPEEEWNIFLYSGILINIKSALSQSRLTSTFEIGESQHLQWLSDSRWRQCQYVSTHLEPFSLLCKSLLSNVSQWDTFKNSKAVYSLISTPFSSENASLEENTKPPEE

SEQ ID NO: 4356 - protein, 126 aa, Homo Sapiens
  misc_feature (1)..(1): Xaa can be any naturally occurring amino acid
XLEYKTVRTFSESLKSEKTEEPKDDDVIRNIIRLREKLGWQTILPQHSLKYGSSKIAIQKITLKKPLEDDGEFVYCLPRKSPKSLYNPYDLQVVSAHTAKHCKEFWVITASFISKRYLVICGAVYI

SEQ ID NO: 4357 - protein, 204 aa, Homo Sapiens
  misc_feature (1)..(1): Xaa can be any naturally occurring amino acid
XMLISAEGEGLVLPKKIRVRSAVEQWLVNVEKSMFDVLKKFLSQGIEDWNCQMFSQWVLSHPGQVVLTVSQIMFYNDCVKSFVSSYSREKLEKVHAGLMCHLEEVADLVVLDTSNSRTKAILGALLILYVHCRDIVINLLLKNIFNAEDFEWTRHLQYKWNEKQKLCYVSQGNASFTYGYEYLGCTSRLVITPLTDRCWLTLME

SEQ ID NO: 4358 - protein, 219 aa, Homo Sapiens
  misc_feature (1)..(1): Xaa can be any naturally occurring amino acid
XRFVTVWKQSIPSTSQKCKHPEDSENNFFEGFPSRYWLPAFFFPQAFLAAVLQDYGRSRGIAVDALTFTHHVISNTTDKDEKFSVFMPKKLNIVRRAFKGSASSHTGVYIFGLFIEGARWNREQKILEDSLPLEMCCDFPDIYFLPTKISTKTPNASNQTDSELYAFECPVYQTPERSRILATTGLPTNFLTSVYLSTKKPPSHWITMRVALLCEKNEK

SEQ ID NO: 4359 - protein, 300 aa, Homo Sapiens
  misc_feature (1)..(1): Xaa can be any naturally occurring amino acid
XTGVSHRADGERGTVGINLPTGECSIFGYFVDIEQCEFIPWSDLVPNDQTLIQRGTSLLTNLQRSGGNFLKITECGECINYTATRDTTCLSFLMSLLLKNSCPVLLTGESGVGKTAAINQMLEKLEGPGAFDIKHGSILGDTLLYSEIKKSSSLKQNITILIPETHKTATGSSDNPTKKPEVRTNKKLLKNNDHKGVVVSTINFSTNVTAAKTKEMILKKLIRRTKDTLGAPKNNRILIFIDDMNMPVSDMYGAQPPLELIRQLLDLGGVYDTEKNTWKNIQDLSIVAACVPVVNDISPR

SEQ ID NO: 4360 - protein, 358 aa, Homo Sapiens
MAPQNLSTFCLLLLYLIGAVIAGRDFYKILGVPRSASIKDIKKAYRKLALQLHPDRNPDDPQAQEKFQDLGAAYEVLSDSEKRKQYDTYGEEGLKDGHQSSHGDIFSHFFGDFGFMFGGTPRQQDRNIPRGSDIIVDLEVTLEEVYAGNFVEVVRNKPVARQAPGKRKCNCRQEMRTTQLGPGRFQMTQEVVCDECPNVKLVNEERTLEVEIEPGVRDGMEYPFIGEGEPHVDGEPGDLRFRIKVVKHPIFERRGDDLYTNVTISLVESLVGFEMDITHLDGHKVHISRDKITRPGAKLWKKGEGLPNFDNNNIKGSLIITFDVDFPKEQLTEEAREGIKQLLKQGSVQKVYNGLQGY

SEQ ID NO: 4361 - protein, 358 aa, Homo Sapiens; identical to SEQ ID NO: 4360

SEQ ID NO: 4362 - protein, 223 aa, Homo Sapiens
MATPQSIFIFAICILMITELILASKSYYDILGVPKSASERQIKKAFHKLAMKYHPDKNKSPDAEAKFREIAEAYETLSDANRRKEYDTLGHSAFTSGKGQRGSGSSFEQSFNFNFDDLFKDFGFFGQNQNTGSKKRFENHFQTRQDGGSSRQRHHFQEFSFGGGLFDDMFEDMEKMFSFSGFDSTNQHTVQTENRFHGSSKHCRTVTQRRGNMVTTYTDCSGQ

SEQ ID NO: 4363 - protein, 153 aa, Homo Sapiens
MGAPLLSPGWGAGAAGRRWWMLLAPLLPALLLVRPAGALVEGLYCGTRDCYEVLGVSRSAGKAEIARAYRQLARRYHPDRYRPQPGDEGPGRTPQSAEEAFLLVATAYETLKVSQAAAELQQYCMQNACKDALLVGVPAGSNPFREPRSCALL

SEQ ID NO: 4364 - protein, 504 aa, Homo Sapiens
MVAPGSVTSRLGSVFPFLLVLVDLQYEGAECGVNADVEKHLELGKKLLAAGQLADALSQFHAAVDGDPDNYIAYYRRATVFLAMGKSKAALPDLTKVIQLKMDFTAARLQRGHLLLKQGKLDEAEDDFKKVLKSNPSENEEKEAQSQLIKSDEMQRLRSQALNAFGSGDYTAAIAFLDKILEVCVWDAELRELRAECFIKEGEPRKAISDLKAASKLKNDNTEAFYKISTLYYQLGDHELSLSEVRECLKLDQDHKRCFAHYKQVKKLNKLIESAEELIRDGRYTDATSKYESVMKTEPSIAEYTVRSKERICHCFSKDEKPVEAIRVCSEVLQMEPDNVNALKDRAEAYLIEEMYDEAIQDYETAQEHNENDQQIREGLEKAQRLLKQSQKRDYYKILGVKRNAKKQEIIKAYRKLALQWHPDNFQNEEEKKKAEKKFIDIAAAKEVLSDPEMRKKFDDGEDPLDAESQQGGGGNPFHRSWNSWQGFNPFSSGGPFRFKFHFN

SEQ ID NO: 4365 - protein, 453 aa, Homo Sapiens
MVAPGSVTSRLGSVFPFLLVLVDLQYEGAECGVNADVEKHLELGKKLLAAGQLADALSQFHAAVDGDPDNYIAYYRRATVFLAMGKSKAALPDLTKVIQLKMDFTAARLQRGHLLLKQGKLDEAEDDFKKVVCVWDAELRELRAECFIKEGEPRKAISDLKAASKLKNDNTEAFYKISTLYYQLGDHELSLSEVRECLKLDQDHKRCFAHYKQVKKLNKLIESAEELIRDGRYTDATSKYESVMKTEPSIAEYTVRSKERICHCFSKDEKPVEAIRVCSEVLQMEPDNVNALKDRAEAYLIEEMYDEAIQDYETAQEHNENDQQIREGLEKAQRLLKQSQKRDYYKILGVKRNAKKQEIIKAYRKLALQWHPDNFQNEEEKKKAEKKFIDIAAAKEVLSDPEMRKKFDDGEDPLDAESQQGGGGNPFHRSWNSWQGFNPFSSGGPFRFKFHFN

SEQ ID NO: 4366 - protein, 60 aa, Homo Sapiens
MRGMKLLGALLALAALLQGAVSLKIAAFNIQTFGETKMSNATLVSYIVQGCTRHLSLRGQ

SEQ ID NO: 4367 - protein, 60 aa, Homo Sapiens; identical to SEQ ID NO: 4366

SEQ ID NO: 4368 - protein, 60 aa, Homo Sapiens; identical to SEQ ID NO: 4366

SEQ ID NO: 4369 - protein, 282 aa, Homo Sapiens [sequence omitted]

SEQ ID NO: 4370 - protein, 282 aa, Homo Sapiens [sequence omitted]

SEQ ID NO: 4371 - protein, 86 aa, Homo Sapiens
MRGMKLLGALLALAALLQGAVSLKIAAFNIQTFGETKMSNATLVSYIVQILSRYDIALVQEVRDSHLTAVGKLLDNLNQWVTVAGS

SEQ ID NO: 4372 - protein, 108 aa, Homo Sapiens
NREPAIVRFFSRFTEVREFAIVPLHAAPGDAVAEIDALYDVYLDVQEKWGLEDVMLMGDFNAGCSYVRPSQWSSIRLWTSPTFQWLIPDSADTTATPTHCAYDRLPMA

SEQ ID NO: 4373 - protein, 72 aa, Homo Sapiens
SIRLWTSPTFQWLIPDSADTTATPTHCAYDRIVVAGMLLRGAVVPDSALPFNFQAAYGLSDQLVCVLPCTAT

SEQ ID NO: 4374 - protein, 90 aa, Homo Sapiens
  misc_feature (1)..(1): Xaa can be any naturally occurring amino acid
XHYVVSEPLGRNSYKERYLFVYRPDQVSAVDSYYYDDGCEPCGNDTFNREPAIVRFFSRFTGSVPHTTWLSPQRSGSLPLFPCMRPRGTQ

SEQ ID NO: 4375 - protein, 75 aa, Homo Sapiens
  misc_feature (1)..(1): Xaa can be any naturally occurring amino acid
XRYLFVYRPDQVSAVDSYYYDDGCEPCGNDTFNREPAIVRFFSRFTGSVPHTTWLSPQRSGSLPLFPCMRPRGTQ

SEQ ID NO: 4376 - protein, 65 aa, Homo Sapiens
  misc_feature (1)..(1): Xaa can be any naturally occurring amino acid
XTFQWLIPDSADTTATPTHCAYDRIVVAGMLLRGAVVPDSALPFNFQAAYGLSDQLVCVLPCTAT

SEQ ID NO: 4377 - protein, 26 aa, Homo Sapiens
MHYPTALLFLILANGAQAFRICAFNA

SEQ ID NO: 4378 - protein, 85 aa, Homo Sapiens
MHYPTALLFLILANGAQAFRICAFNAQRLTLAKVAREQVMDTLVRALNISDHYPVEVELKLSQAHSVQPLSLTVLLLLSLLSPQL

SEQ ID NO: 4379 - protein, 62 aa, Homo Sapiens
MHYPTALLFLILANGAQAFRICAFNAQRLTLAKVAREQVMDTLVRDVILLGDFNADCASLTK

SEQ ID NO: 4380 - protein, 104 aa, Homo Sapiens
MHYPTALLFLILANGAQAFRICAFNAQRLTLAKVAREQVMDTLVRILARCDIMVLQEVVDSSGSAIPLLLRELNRFDGSGPYSTLSSPQLGRSTYMETYVYFYR

SEQ ID NO: 4381 - protein, 208 aa, Homo Sapiens
MHYPTALLFLILANGAQAFRICAFNAQRLTLAKVAREQVMDTLVRILARCDIMVLQEVVDSSGSAIPLLLRELNRFDGSGPYSTLSSPQLGRSTYMETYVYFYRSHKTQVLSSYVYNDEDDVFAREPFVAQFSLPSNVLPSLVLVPLHTTPKAVEKELNALYDVFLEVSQHWQSKDVILLGDFNADCASLTKKRLDKLELRTEPGFHW

SEQ ID NO: 4382 - protein, 302 aa, Homo Sapiens
MHYPTALLFLILANGAQAFRICAFNAQRLTLAKVAREQVMDTLVRILARCDIMVLQEVVDSSGSAIPLLLRELNRFDGSGPYSTLSSPQLGRSTYMETYVYFYRSHKTQVLSSYVYNDEDDVFAREPFVAQFSLPSNVLPSLVLVPLHTTPKAVEKELNALYDVFLEVSQHWQSKDVILLGDFNADCASLTKKRLDKLELRTEPGFHWVIADGEDTTVRASTHCTYDRVVLHGERCRSLLHTAAAFDFPTSFQLTEEEALNISDHYPVEVELKLSQAHSVQPLSLTVLLLLSLLSPQLCPAA

SEQ ID NO: 4383 - protein, 302 aa, Homo Sapiens; identical to SEQ ID NO: 4382

SEQ ID NO: 4384 - protein, 302 aa, Homo Sapiens; identical to SEQ ID NO: 4382

SEQ ID NO: 4385 - protein, 302 aa, Homo Sapiens; identical to SEQ ID NO: 4382

SEQ ID NO: 4386 - protein, 302 aa, Homo Sapiens; identical to SEQ ID NO: 4382

SEQ ID NO: 4387 - protein, 302 aa, Homo Sapiens; identical to SEQ ID NO: 4382

SEQ ID NO: 4388 - protein, 278 aa, Homo Sapiens
MGGPRALLAALWALEAAGTAALRIGAFNIQSFGDSKVSDPACGSIIAKILAGYDLALVQEVRDPDLSAVSALMEQINSVSEHEYSFVSSQPLGRDQYKEMYLFVYRKDAVSVVDTYLYPDPEDVFSREPFVVKFSAPGTAQNLVLIPLHAAPHQAVAEIDALYDVYLDVIDKWGTDDMLFLGDFNADCSYVRAQDWAAIRLRSSEVFKWLIPDSADTTVGNSDCAYDRIVACGARLRRSLKPQSATVHDFQEEFGLDQTQALAISDHFPVEVTLKFHR

SEQ ID NO: 4389 - protein, 278 aa, Homo Sapiens; identical to SEQ ID NO: 4388

SEQ ID NO: 4390 - protein, 299 aa, Homo Sapiens
MGGPRALLAALWALEAAGTAALRIGAFNIQSFGDSKVSDPACGSIIAKILAGYDLALVQEVRDPDLSAVSALMEQINSVSEHEYSFVSSQPLGRDQYKEMYLFVYRKDAVSVVDTYLYPDPEDVFSREPFVVKFSAPGTGERAPPLPSRRALTPPPLPAAAQNLVLIPLHAAPHQAVAEIDALYDVYLDVIDKWGTDDMLFLGDFNADCSYVRAQDWAAIRLRSSEVFKWLIPDSADTTVGNSDCAYDRIVACGARLRRSLKPQSATVHDFQEEFGLDQTQALAISDHFPVEVTLKFHR

SEQ ID NO: 4391 - protein, 299 aa, Homo Sapiens; identical to SEQ ID NO: 4390

SEQ ID NO: 4392 - protein, 299 aa, Homo Sapiens; identical to SEQ ID NO: 4390

SEQ ID NO: 4393 - protein, 254 aa, Homo Sapiens
PRALLAALWALEAAGTAALRIGAFNIQSFGDSKVSDPACGSIIAKILAGYDLALVQEVRDPDLSAVSALMEQINSVSEHEYSFVSSQPLGRDQYKEMYLFVYRKDAVSVVDTYLYPDPEDVFSREPFVVKFSAPGTGERAPPLPSRRALTPPPLPAAAQNLVLIPLHAAPHQAVAEIDALYDVYLDVIDKWGTDDWAAIRLRSSEVFKWLIPDSADTTVGNSDCAYDRIVACGARLRRSLKPQSATVHDFQEEF

SEQ ID NO: 4394 - protein, 137 aa, Homo Sapiens
ADVFSREPFVVWFQSPHTAVKDFVIIPLHTTPETSVKEIDELVEVYTDVKHRWKAENFIFMGDFNAGCSYVPKKAWKNIRLRTDPRFVWLIGDQEDTTVKKSTNCAYDRPWMSATTFQLNLNYSLQGPSPTAKNLSL

SEQ ID NO: 4395 - protein, 275 aa, Homo Sapiens
MSRELAPLLLLLLSIHSALAMRICSFNVRSFGESKQEDKNAMDVIVKVIKRCDIILVMEIKDSNNRICPILMEKLNREKLVSVKRSYHYHDYQDGDADVFSREPFVVWFQSPHTAVKDFVIIPLHTTPETSVKEIDELVEVYTDVKHRWKAENFIFMGDFNAGCSYVPKKAWKNIRLRTDPRFVWLIGDQEDTTVKKSTNCAYDRIVLRGQEIVSSVVPKSNSVFDFQKAYKLTEEEALDVSDHFPVEFKLQSSRAFTNSKKSVTLRKKTKSKRS

SEQ ID NO: 4396 - protein, 100 aa, Homo Sapiens
MSRELAPLLLLLLSIHSALAMRICSFNVRSFGESKQEDKNAMDVIVKVIKRCDIILVMEIKDSNNRICPILMEKLNRNSRRGITYNYVISSRLGRNTYKE

SEQ ID NO: 4397 - protein, 158 aa, Homo Sapiens
MSRELAPLLLLLLSIHSALAMRICSFNVRSFGESKQEDKNAMDVIVKVIKRCDIILVMEIKDSNNRICPILMEKLNRNSRRGITYNYVISSRLGRNTYKEQYAFLYKEKLVSVKRSYHYHDYQDGDADVFSREPFVVWFQSPHTAVKDFVIIPLHTTP

SEQ ID NO: 4398 - protein, 305 aa, Homo Sapiens
MSRELAPLLLLLLSIHSALAMRICSFNVRSFGESKQEDKNAMDVIVKVIKRCDIILVMEIKDSNNRICPILMEKLNRNSRRGITYNYVISSRLGRNTYKEQYAFLYKEKLVSVKRSYHYHDYQDGDADVFSREPFVVWFQSPHTAVKDFVIIPLHTTPETSVKEIDELVEVYTDVKHRWKAENFIFMGDFNAGCSYVPKKAWKNIRLRTDPRFVWLIGDQEDTTVKKSTNCAYDRIVLRGQEIVSSVVPKSNSVFDFQKAYKLTEEEALDVSDHFPVEFKLQSSRAFTNSKKSVTLRKKTKSKRS

SEQ ID NO: 4399 - protein, 288 aa, Homo Sapiens
MSRELAPLLLLLLSIHSALAMRICSFNVRSFGESKQEDKNAMDVIVKVIKRCDIILVMEIKDSNNRICPILMEKLNRNSRRGITYNYVISSRLGRNTYKEQYAFLYKEKLVSVKRSYHYHDYQDGDADVFSREPFVVWFQSPHTAVKDFVIIPLHTTPETSVKEIDELVEVYTDVKHRWKAENFIFMGDFNAGCSYVPKKAWKNIRLRTDPRFVWLIGDQEDTTVKKSTNCAYDRIVLRGQEIVSSVVPKSNSVFDFQKAYKLTEEEVRLPSCLSMPLSWKDELAWAT

SEQ ID NO: 4400 - protein, 218 aa, Homo Sapiens
MIPLLLAALLCVPAGALTCYGDSGQPVDWFVVYKLPALRGSGEAAQRGLQYKYLDESSGGWRDGRALINSPEGAVGRSLQPLYRSNTSQLAFLLYNDQPPQPSKAQDSSMRGHTKGKQLTYTYPWVYNYQLEGIFAQEFPDLENVVKGHHVSQEPWNSSITLTSQAGAVFQSFAKFSKFGDDLYSGWLAAALGTNLQVQFWHKTVGILPSNCSDIWQV

SEQ ID NO: 4401 - protein, 360 aa, Homo Sapiens
MIPLLLAALLCVPAGALTCYGDSGQPVDWFVVYKLPALRGSGEAAQRGLQYKYLDESSGGWRDGRALINSPEGAVGRSLQPLYRSNTSQLAFLLYNDQPPQPSKAQDSSMRGHTKGVLLLDHDGGFWLVHSVPNFPPPASSAAYSWPHSACTYGQTLLCVSFPFAQFSKMGKQLTYTYPWVYNYQLEGIFAQEFPDLENVVKGHHVSQEPWNSSITLTSQAGAVFQSFAKFSKFGDDLYSGWLAAALGTNLQVQFWHKTVGILPSNCSDIWQVLNVNQIAFPGPAGPSFNSTEDHSKWCVSPKGPWTCVGDMNRNQGEEQRGGGTLCAQLPALWKAFQPLVKNYQPCNGMARKPSRAYKI

SEQ ID NO: 4402 - protein, 361 aa, Homo Sapiens
MKQKMMARLLRTSFALLFLGLFGVLGAATISCRNEEGKAVDWFTFYKLPKRQNKESGETGLEYLYLDSTTRSWRKSEQLMNDTKSVLGRTLQQLYEAYASKSNNTAYLIYNDGVPKPVNYSRKYGHTKGLLLWNRVQGFWLIHSIPQFPPIPEEGYDYPPTGRRNGQSGICITFKYNQYEAIDSQLLVCNPNVYSCSIPATFHQELIHMPQLCTRASSSEIPGRLLTTLQSAQGQKFLHFAKSDSFLDDIFAAWMAQRLKTHLLTETWQRKRQELPSNCSLPYHVYNIKAIKLSRHSYFSSYQDHAKWCISQKGTKNRWTCIGDLNRSPHQAFRSGGFICTQNWQIYQAFQGLVLYYESCK

SEQ ID NO: 4403 - protein, 153 aa, Homo Sapiens
MPQLCTRASSSEIPGRLLTTLQSAQGQKFLHFAKSDSFLDDIFAAWMAQRLKTHLLTETWQRKRQELPSNCSLPYHVYNIKAIKLSRHSYFSSYQDHAKWCISQKGTKNRWTCIGDLNRSPHQAFRSGGFICTQNWQIYQAFQGLVLYYESCK

SEQ ID NO: 4404 - protein, 107 aa, Homo Sapiens
MWSGWWLWPLVAVCTADFFRDEAERIMRDSPVIDGHNDLPWQLLDMFNNRLQDERANLTTLAGTHTNIPKLRAGFVGGQFWSVYTPCDTQNKDAVRRTLEQMDVVHR

SEQ ID NO: 4405 - protein, 111 aa, Homo Sapiens
MWSGWWLWPLVAVCTADFFRDEAERIMRDSPVIDGHNDLPWQLLDMFNNRLQDERANLTTLAGTHTNIPKLRAGFVGGQFWSVYTPCDTQNKDAVRRTLEQMDVVHRMCRM

SEQ ID NO: 4406 - protein, 411 aa, Homo Sapiens
MWSGWWLWPLVAVCTADFFRDEAERIMRDSPVIDGHNDLPWQLLDMFNNRLQDERANLTTLAGTHTNIPKLRAGFVGGQFWSVYTPCDTQNKDAVRRTLEQMDVVHRMCRMYPETFLYVTSSAGIRQAFREGKVASLIGVEGGHSIDSSLGVLRALYQLGMRYLTLTHSCNTPWADNWLVDTGDSEPQSQGLSPFGQRVVKELNRLGVLIDLAHVSVATMKATLQLSRAPVIFSHSSAYSVCASRRNVPDDVLRLVKQTDSLVMVNFYNNYISCTNKANLSQVADHLDHIKEVAGARAVGFGGDFDGVPRVPEGLEDVSKYPDLIAELLRRNWTEAEVKGALADNLLRVFEAVEQASNLTQAPEEEPIPLDQLGGSCRTHYGYSSGASSLHRHWGLLLASLAPLVLCLSLL

SEQ ID NO: 4407 - protein, 411 aa, Homo Sapiens; identical to SEQ ID NO: 4406

SEQ ID NO: 4408 - protein, 411 aa, Homo Sapiens; identical to SEQ ID NO: 4406

SEQ ID NO: 4409 - protein, 161 aa, Homo Sapiens
MKLQTLAVSVTALKFWSAYVPCQTQDRDALRLTLEQIDLIRRMCASYSELELVTSAKALNDTQKLACLIGVEGGHSLDNSLSILRTFYMLGVRYLTLTHTCNTPWAESSAKGVHSFYNNISGLTDFGEKVVAEMNRLGMMVDLSHVSDAVARRALEVSQAP

SEQ ID NO: 4410 - protein, 123 aa, Homo Sapiens
MQMIIIWALLDTEAESSAKGVHSFYNNISGLTDFGEKVVAEMNRLGMMVDLSHVSDAVARRALEVSQAPVIFSHSAARGVCNSARNVPDDILQLLKKNGGVVMVSLSMGVIQCNPSANVSTVA

SEQ ID NO: 4411 - protein, 114 aa, Homo Sapiens
MQPSGLEGPGTFGRWPLLSLLLLLLLLQPVTCAYTTPGPPRALTTLGAPRAHTMPGTYAPSTTLSSPSTQGLQEQARALMRDFPLVDGHNDLPLVLRQVYQKGLQDVNLRNFSY

SEQ ID NO: 4412 - protein, 137 aa, Homo Sapiens
MQPSGLEGPGTFGRWPLLSLLLLLLLLQPVTCAYTTPGPPRALTTLGAPRAHTMPGTYAPSTTLSSPSTQGLQEQARALMRDFPLVDGHNDLPLVLRQVYQKGLQDVNLRNFSYGQTSLDRLRDGLVGAQFWSAYVP

SEQ ID NO: 4413 - protein, 486 aa, Homo Sapiens
MQPSGLEGPGTFGRWPLLSLLLLLLLLQPVTCAYTTPGPPRALTTLGAPRAHTMPGTYAPSTTLSSPSTQGLQEQARALMRDFPLVDGHNDLPLVLRQVYQKGLQDVNLRNFSYGQTSLDRLRDGLVGAQFWSAYVPCQTQDRDALRLTLEQIDLIRRMCASYSELELVTSAKALNDTQKLACLIGVEGGHSLDNSLSILRTFYMLGVRYLTLTHTCNTPWAESSAKGVHSFYNNISGLTDFGEKVVAEMNRLGMMVDLSHVSDAVARRALEVSQAPVIFSHSAARGVCNSARNVPDDILQLLKKNGGVVMVSLSMGVIQCNPSANVSTVADHFDHIKAVIGSKFIGIGGDYDGAGKFPQGLEDVSTYPVLIEELLSRGWSEEELQGVLRGNLLRVFRQVEKVQEENKWQSPLEDKFPDEQLSSSCHSDLSRLRQRQSLTSGQELTEIPIHWTAKLPAKWSVSESSPHMAPVLAVVATFPVLILWL

SEQ ID NO: 4414 - protein, 486 aa, Homo Sapiens; identical to SEQ ID NO: 4413

SEQ ID NO: 4415 - protein, 258 aa, Homo Sapiens
MQPSGLEGPGTFGRWPLLSLLLLLLLLQPVTCAYTTPGPPRALTTLGAPRAHTMPGTYAPSTTLSSPSTQGLQEQARALMRDFPLVDGHNDLPLVLRQVYQKGLQDVNLRNFSYGQTSLDRLRDGLVGAQFWSAYVPCQTQDRDALRLTLEQIDLIRRMCASYSELELVTSAKALNDTQKLACLIGVEGGHSLDNSLSILRTFYMLGVRYLTLTHTCNTPWAESSAKGVHSFYNNISGLTDFGEMLWHGGPWKCHRHL

SEQ ID NO: 4416 - protein, 513 aa, Homo Sapiens
MIRTPLSASAHRLLLPGSRGRPPRNMQPTGREGSRALSRRYLRRLLLLLLLLLLRQPVTRAETTPGAPRALSTLGSPSLFTTPGVPSALTTPGLTTPGTPKTLDLRGRAQALMRSFPLVDGHNDLPQVLRQRYKNVLQDVNLRNFSHGQTSLDRLRDGLVGAQFWSASVSCQSQDQTAVRLALEQIDLIHRMCASYSELELVTSAEGLNSSQKLACLIGVEGGHSLDSSLSVLRSFYVLGVRYLTLTFTCSTPWAESSTKFRHHMYTNVSGLTSFGEKVVEELNRLGMMIDLSYASDTLIRRVLEVSQAPVIFSHSAARAVCDNLLNVPDDILQLLKKNGGIVMVTLSMGVLQCNLLANVSTVADHFDHIRAVIGSEFIGIGGNYDGTGRFPQGLEDVSTYPVLIEELLSRSWSEEELQGVLRGNLLRVFRQVEKVREESRAQSPVEAEFPYGQLSTSCHSHLVPQNGHQATHLEVTKQPTNRVPWRSSNASPYLVPGLVAAATIPTFTQWLC

SEQ ID NO: 4417 - protein, 357 aa, Homo Sapiens
MATVIHNPLKALGDQFYKEAIEHCRSYNSRLCAERSVRLPFLDSQTGVAQNNCYIWMEKRHRGPGLAPGQLYTYPARCWRKKRRLHPPEDPKLRLLEIKPEVELPLKKDGFTSESTTLEALLRGEGVEKKVDAREEESIQEIQRVLENDENVEEGNEEEDLEEDIPKRKNRTRGRARGSAGGRRRHDAASQEDHDKPYVCDICGKRYKNRPGLSYHYAHTHLASEEGDEAQDQETRSPPNHRNENHRPQKGPDGTVIPNNYCDFCLGGSNMNKKSGRPEELVSCADCGRSAHLGGEGRKEKEAAAAARTTEDLFGSTSESDTSTFHGFDEDDLEEPRSCRGRRSGRGSPTADKKGSC

SEQ ID NO: 4418 - protein, 357 aa, Homo Sapiens; identical to SEQ ID NO: 4417

SEQ ID NO: 4419 - protein, 378 aa, Homo Sapiens
MATVIHNPLKALGDQFYKEAIEHCRSYNSRLCAERSVRLPFLDSQTGVAQNNCYIWMEKRHRGPGLAPGQLYTYPARCWRKKRRLHPPEDPKLRLLEIKPEVELPLKKDGFTSESTTLEALLRGEGVEKKVDAREEESIQEIQRVLENDENVEEGNEEEDLEEDIPKRKNRTRGRARGSAGGRRRHDAASQEDHDKPYVCDICGKRYKNRPGLSYHYAHTHLASEEGDEAQDQETRSPPNHRNENHRPQKGPDGTVIPNNYCDFCLGGSNMNKKSGRPEELVSCADCGRSGHPTCLQFTLNMTEAVKTYKWQCIECKSCILCGTSENDDQLLFCDDCDRGYHMYCLNPPVAEPPEGSWSCHLCWELLKEKASAFGCQA

SEQ ID NO: 4420 - protein, 412 aa, Homo Sapiens
MFYGRINGRNFAASSLPVAFAATPLMLFLPNPQLIFSFPISSRNHITGLMPPGKLKLENLFHMCTRLGDQFYKEAIEHCRSYNSRLCAERSVRLPFLDSQTGVAQNNCYIWMEKRHRGPGLAPGQLYTYPARCWRKKRRLHPPEDPKLRLLEIKPEVELPLKKDGFTSESTTLEALLRGEGVEKKVDAREEESIQEIQRVLENDENVEEGNEEEDLEEDIPKRKNRTRGRARGSAGGRRRHDAASQEDHDKPYVCDICGKRYKNRPGLSYHYAHTHLASEEGDEAQDQETRSPPNHRNENHRPQKGPDGTVIPNNYCDFCLGGSNMNKKSGRPEELVSCADCGRSAHLGGEGRKEKEAAAAARTTEDLFGSTSESDTSTFHGFDEDDLEEPRSCRGRRSGRGSPTADKKGSC

SEQ ID NO: 4421 - protein, 412 aa, Homo Sapiens; identical to SEQ ID NO: 4420

SEQ ID NO: 4422 - protein, 367 aa, Homo Sapiens
MGFTDLEEPISGCPGGPWALGLGDQFYKEAIEHCRSYNSRLCAERSVRLPFLDSQTGVAQNNCYIWMEKRHRGPGLAPGQLYTYPARCWRKKRRLHPPEDPKLRLLEIKPEVELPLKKDGFTSESTTLEALLRGEGVEKKVDAREEESIQEIQRVLENDENVEEGNEEEDLEEDIPKRKNRTRGRARGSAGGRRRHDAASQEDHDKPYVCDICGKRYKNRPGLSYHYAHTHLASEEGDEAQDQETRSPPNHRNENHRPQKGPDGTVIPNNYCDFCLGGSNMNKKSGRPEELVSCADCGRSAHLGGEGRKEKEAAAAARTTEDLFGSTSESDTSTFHGFDEDDLEEPRSCRGRRSGRGSPTADKKGSC

SEQ ID NO: 4423 - protein, 367 aa, Homo Sapiens; identical to SEQ ID NO: 4422

SEQ ID NO: 4424 - protein, 170 aa, Homo Sapiens
MKTPWKVLLGLLGAAALVTIITVPVVLLNKGNDATADSRKTYTLTDYLKNTYRLKLYSLRWISDHEYLYKQENNILVFNAEYGNSSVFLENSTFDEFGHSINDYSISPDGQFILLEYNYVKQWRHSYTASYDIYDLNKRQLITEERIPNNTQWVTWSPVGHKLVSICLEQ

SEQ ID NO: 4425 - protein, 766 aa, Homo Sapiens
MKTPWKVLLGLLGAAALVTIITVPVVLLNKGTDDATADSRKTYTLTDYLKNTYRLKLYSLRWISDHEYLYKQENNILVFNAEYGNSSVFLENSTFDEFGHSINDYSISPDGQFILLEYNYVKQWRHSYTASYDIYDLNKRQLITEERIPNNTQWVTWSPVGHKLAYVWNNDIYVKIEPNLPSYRITWTGKEDIIYNGITDWVYEEEVFSAYSALWWSPNGTFLAYAQFNDTEVPLIEYSFYSDESLQYPKTVRVPYPKAGAVNPTVKFFVVNTDSLSSVTNATSIQITAPASMLIGDHYLCDVTWATQERISLQWLRRIQNYSVMDICDYDESSGRWNCLVARQHIEMSTTGWVGRFRPSEPHFTLDGNSFYKIISNEEGYRHICYFQIDKKDCTFITKGTWEVIGIEALTSDYLYYISNEYKGMPGGRNLYKIQLSDYTKVTCLSCELNPERCQYYSVSFSKEAKYYQLRCSGPGLPLYTLHSSVNDKGLRVLEDNSALDKMLQNVQMPSKKLDFIILNETKFWYQMILPPHFDKSKKYPLLLDVYAGPCSQKADTVFRLNWATYLASTENIIVASFDGRGSGYQGDKIMHAINRRLGTFEVEDQIEAARQFSKMGFVDNKRIAIWGWSYGGYVTSMVLGSGSGVFKCGIAVAPVSRWEYYDSVYTERYMGLPTPEDNLDHYRNSTVMSRAENFKQVEYLLIHGTADDNVHFQQSAQISKALVDVGVDFQAMWYTDEDHGIASSTAHQHIYTHMSHFIKQCFSLP

SEQ ID NO: 4426 - protein, 118 aa, Homo Sapiens
MKTPWKVLLGLLGAAALVTIITVPVVLLNKGTDDATADSRKTYTLTDYLKNTYRLKLYSLRWISDHEYLYKQENNILVFNAEYGNSSVFLENSTFHMAKWIFLSFLKCSLPWLLFSLL

SEQ ID NO: 4427 - protein, 118 aa, Homo Sapiens; identical to SEQ ID NO: 4426

SEQ ID NO: 4428 - protein, 86 aa, Homo Sapiens
  misc_feature (1)..(1): Xaa can be any naturally occurring amino acid
XDATADSRKTYTLTDYLKNTYRLKLYSLRWISDHEYLYKQENNILVFNAEYGNSSVFLENSTFHMAKWIFLSFLKCSLPWLLFSLL

SEQ ID NO: 4429 - protein, 272 aa, Homo Sapiens
APWAPVLLLALGLRGLQAGARRAPDPGFQERFFQQRLDHFNFERFGNKTFPQRFLVSDRFWVRGEGPIFFYTGNEGDVWAFANNSAFVAELAAERGALLVFAEHRYYGKSLPFGAQSTQRGHTELLTVEQALADFAELLRALRRDLGAQDAPAIAFGGRKPSHLSSQPPAQLGCAATLAAFPSESCTRTWPRVGICGSQKCRPPCGTCGPLRRKRGNGVLGAAALTLCPSPSYGGMLSAYLRMKYPHLVAGALAASAPVLAVAGLGDSNQFF

SEQ ID NO: 4430 - protein, 492 aa, Homo Sapiens [sequence omitted]

SEQ ID NO: 4431 - protein, 61 aa, Homo Sapiens
  misc_feature (1)..(1): Xaa can be any naturally occurring amino acid
XSGSEHCYDIYRLYHSCADPTGCGTGPDARAWDYQISEPPATSSSPTGTWTPGQGAGFGGT

SEQ ID NO: 4432 - protein, 155 aa, Homo Sapiens
  misc_feature (1)..(1): Xaa can be any naturally occurring amino acid
XTFPQRFLVSDRFWVRGEGPIFFYTGNEGDVWAFANNSAFVAELAAERGALLVFAEHRYYGKSLPFGAQSTQRGHTELLTVEQALADFAELLRALRRDLGAQDAPAIAFGGSLRHGPLGVRHLPAAVRREGPDPALHVRPECLHRAGHDGLPLPH

SEQ ID NO: 4433 - protein, 244 aa, Homo Sapiens
  misc_feature (1)..(1): Xaa can be any naturally occurring amino acid
XTVRWEFGTCQPLSDEKDLTQLFMFARNAFTVLAMMDYPYPTDFLGPLPANPVKVGCDRLLSEAQRITGLRALAGALPPAPDGCADPTGCGTGPDARAWDYQACTEINLTFASNNVTDMFPDLPFTDELRQRYCLDTWGVWPRPDWLLTSFWGGDLRAASNIIFSNGNLDPWAGGGIRRNLSASVIAVTIQGGAHHLDLRASHPEDPASVVEARKLEATIIGEWVKAARREQQPALRGGPRLSL

SEQ ID NO: 4434 - protein, 120 aa, Homo Sapiens
  misc_feature (1)..(1): Xaa can be any naturally occurring amino acid
XVLLLALGLRGLQAGARRAPDPGFQERFFQQRLDHFNFERFGNKTFPQRFLVSGSGSGARGPSSSTLGTRATCGPSPTTRPSSRSWRPSGGLYWSSRSTATTGSRCRSVRSPRSAGTRSC

SEQ ID NO: 4435 - protein, 201 aa, Homo Sapiens
MDLSLLWVLLPLVTMAWGQYGDYGYPYQQYHDYSDDGWVNLNRQGFSYQCPQGQVIVAVRSIFSKKEGSDRQWNYACMPTPQSLGEPTECWWEEINRAGMEWYQTCSNNGLVAGFQSRYFESVLDREWQFYCCRYSKRCPYSCWLTTEYPGHYGEEMDMISYNYDYYIRGATTTFSAVERDRQWKFIMCRMTEYDCEFANV

SEQ ID NO: 4436 - protein, 349 aa, Homo Sapiens
MAGPAIHTAPMLFLVLLLPLELSLAGALAPGTPARNLPENHIDLPGPALWTPQASHHRRRGPGKKEWGPGLPSQAQDGAVVTATRQASRLPEAEGLLPEQSPAGLLQDKDLLLGLALPYPEKENRPPGWERTRKRSREHKRRRDRLRLHQGRALVRGPSSLMKKAELSEAQVLDAAMEESSTSLAPTMFFLTTFEAAPATEESLILPVTSLRPQQAQPRSDGEVMPTLDMALFDWTDYEDLKPDGWPSAKKKEKHRGKLSSDGNETSPAEGEPCDHHQDCLPGTCCDLREHLCTPHNRGLNNKCFDDCMCVEGLRCYAKFHRNRRVTRRKGRCVEPETANGDQGSFINV

SEQ ID NO: 4437 - protein, 136 aa, Homo Sapiens
MRTHTRGAPSVFFIYLLCFVSAYITDENPEVMIPFTNANYDSHPMLYFSRAEVAELQLRAASSHEHIAARLTEAVHTMLSSPLEYLPPWDPKDYSARWNEIFGNNLGALAMFCVLYPENIEARDMAKDYMERMAAQ

SEQ ID NO: 4438 - protein, 139 aa, Homo Sapiens
MRTHTRGAPSVFFIYLLCFVSAYITDENPEVMIPFTNANYDSHPMLYFSRAEVAELQLRAASSHEHIAARLTEAVHTMLSSPLEYLPPWDPKDYSARWNEIFGNNLGALAMFCVLYPENIEARDMAKDYMERMAAQPSW

SEQ ID NO: 4439 - protein, 144 aa, Homo Sapiens
MRTHTRGAPSVFFIYLLCFVSAYITDENPEVMIPFTNANYDSHPMLYFSRAEVAELQLRAASSHEHIAARLTEAVHTMLSSPLEYLPPWDPKDYSARWNEIFGNNLGALAMFCVLYPENIEARDMAKDYMERMAAQPSWLVKDA

SEQ ID NO: 4440 - protein, 228 aa, Homo Sapiens
MRTHTRGAPSVFFIYLLCFVSAYITDENPEVMIPFTNANYDSHPMLYFSRAEVAELQLRAASSHEHIAARLTEAVHTMLSSPLEYLPPWDPKDYSARWNEIFGNNLGALAMFCVLYPENIEARDMAKDYMERMAAQPSWLVKDAPWDEVPLAHSLVGFATAYDFLYNYLSKTQQEKFLEVIANASGYMYETSYRRGWGFQYLHNHQPTNCMALLTGSLVLMNQGMMAA

SEQ ID NO: 4441 - protein, 228 aa, Homo Sapiens; identical to SEQ ID NO: 4440

SEQ ID NO: 4442 - protein, 958 aa, Homo Sapiens [sequence omitted]

SEQ ID NO: 4443 - protein, 308 aa, Homo Sapiens
MRTHTRGAPSVFFIYLLCFVSAYITDENPEVMIPFTNANYDSHPMLYFSRAEVAELQLRAASSHEHIAARLTEAVHTMLSSPLEYLPPWDPKDYSARWNEIFGNNLGALAMFCVLYPENIEARDMAKDYMERMAAQPSWLVKDAPWDEVPLAHSLVGFATAYDFLYNYLSKTQQEKFLEVIANASGYMYETSYRRGWGFQYLHNHQPTNCMALLTGSLVLMNQGYLQEAYLWTKQVLTIMEKSLVLLREVTDGSLYEGVAYGSYTTRSLFQYMFLVQRHFNINHFGHPWLKQHFAFMYRTILPGMMAA

SEQ ID NO: 4444 - protein, 958 aa, Homo Sapiens [sequence omitted]

SEQ ID NO: 4445 - protein, 958 aa, Homo Sapiens [sequence omitted]

SEQ ID NO: 4446 - protein, 1118 aa, Homo Sapiens
MARSPGRAYALLLLLICFNVGSGLHLQVLSTRNENKLLPKHPHLVRQKRAWITAPVALREGEDLSKKNPIAKIHSDLAEERGLKITYKYTGKGITEPPFGIFVFNKDTGELNVTSILDREETPFFLLTGYALDARGNNVEKPLELRIKVLDINDNEPVFTQDVFVGSVEELSAAHTLVMKINATDADEPNTLNSKISYRIVSLEPAYPPVFYLNKDTGEIYTTSVTLDREEHSSYTLTVEARDGNGEVTDKPVKQAQVQIRILDVNDNIPVVENKVLEGMVEENQVNVEVTRIKVFDADEIGSDNWLANFTFASGNEGGYFHIETDAQTNEGIVTLIKEVDYEEMKNLDFSVIVANKAAFHKSIRSKYKPTPIPIKVKVKNVKEGIHFKSSVISIYVSESMDRSSKGQIIGNFQAFDEDTGLPAHARYVKLEDRDNWISVDSVTSEIKLAKLPDFESRYVQNGTYTVKIVAISEDYPRKTITGTVLINVEDINDNCPTLIEPVQTICHDAEYVNVTAEDLDGHPNSGPFSFSVIDKPPGMAEKWKIARQESTSVLLQQSEKKLGRSEIQFLISDNQGFSCPEKQVLTLTVCECLHGSGCREAQHDSYVGLGPAAIALMILAFLLLLLVPLLLLMCHCGKGAKGFTPIPGTIEMLHPWNNEGAPPEDKVVPSFLPVDQGGSLVGRNGVGGMAKEATMKGSSSASIVKGQHEMSEMDGRWEEHRSLLSGRATQFTGATGAIMTTETTKTARATGASRDMAGAQAAAVALNEEFLRNYFTDKAASYTEEDENHTAKDCLLVYSQEETESLNASIGCCSFIEGELDDRFLDDLGLKFKTLAEVCLGQKIDINKEIEQRQKPATETSMNTASHSLCEQTMVNSENTYSSGSSFPVPKSLQEANAEKVTQEIVTERSVSSRQAQKVATPLPDPMASRNVIATETSYVTGSTMPPTTVILGPSQPQSLIVTERVYAPASTLVDQPYANEGTVVVTERVIQPHGGGSNPLEGTQHLQDVPYVMVRERESFLAPSSGVQPTLAMPNIAVGQNVTVTERVLAPASTLQSSYQIPTENSMTARNTTVSGAGVPGPLPDFGLEESGHSNSTITTSSTRVTKHSTVQHSYS

SEQ ID NO: 4447 - protein, 232 aa, Homo Sapiens
MARSPGRAYALLLLLICFNVGSGLHLQVLSTRNENKLLPKHPHLVRQKRAWITAPVALREGEDLSKKNPIAKIHSDLAEERGLKITYKYTGKGITEPPFGIFVFNKDTGELNVTSILDREETPFFLLTGYALDARGNNVEKPLELRIKVLDINDNEPVFTQDVFVGSVEELSAAHTLVMKINATDADEPNTLNSKISYRIVSLEPAYPPVFYLNKDTGEIYTTSVTLDREVS

SEQ ID NO: 4448 - protein, 1301 aa, Homo Sapiens
MKIITYFCIWAVAWAIPVPQSKPLERHVEKSMNLHLLARSNVSVQDELNASGTIKESGVLVHEGDRGRQENTQDGHKGEGNGSKWAEVGGKSFSTYSTLANEEGNIEGWNGDTGKAETYGHDGIHGKEENITANGIQGQVSIIDNAGATNRSNTNGNTDKNTQNGDVGDAGHNEDVAVVQEDGPQVAGSNNSTDNEDEIIENSCRNEGNTSEITPQINSKRNGTKEAEVTPGTGEDAGLDNSDGSPSGNGADEDEDEGSGDDEDEEAGNGKDSSNNSKGQEGQDHGKEDDHDSSIGQNSDSKEYYDPEGKEDPHNEVDGDKTSKSEENSAGIPEDNGSQRIEDTQKLNHRESKRVENRITKESETHAVGKSQDKGIEIKGPSSGNRNITKEVGKGNEGKEDKGQHGMILGKGNVKTQGEVVNIEGPGQKSEPGNKVGHSNTGSDSNSDGYDSYDFDDKSMQGDDPNSSDESNGNDDANSESDNNSSSRGDASYNSDESKDNGNGSDSKGAEDDDSDSTSDTNNSDSNGNGNNGNDDNDKSDSGKGKSDSSDSDSSDSSNSSDSSDSSDSDSSDSNSSSDSDSSDSDSSDSSDSDSSDSSNSSDSSDSSDSSDSSDSSDSSDSKSDSSKSESDSSDSDSKSDSSDSNSSDSSDNSDSSDSSNSSNSSDSSDSSDSSDSSSSSDSSNSSDSSDSSDSSNSSESSDSSDSSDSDSSDSSDSSNSNSSDSDSSNSSDSSDSSNSSDSSDSSDSSNSSDSSDSSDSSNSSDSSDSSDSSDSSDSSNSSDSNDSSNSSDSSDSSNSSDSSNSSDSSDSSDSSDSDSSNSSDSSNSSDSSDSSNSSDSSDSSDSSDGSDSDSSNRSDSSNSSDSSDSSDSSNSSDSSDSSDSNESSNSSDSSDSSNSSDSDSSDSSNSSDSSDSSNSSDSSESSNSSDNSNSSDSSNSSDSSDSSDSSNSSDSSNSSDSSNSSDSSDSNSSDSSDSSNSSDSSDSSDSSDSSDSSDSSNSSDSSDSSDSSDSSNSSDSSNSSDSSNSSDSSDSSDSSDSSDSSDSSDSSDSSNSSDSSDSSDSSDSSDSSDSSDSSDSSESSDSSDSSNSSDSSDSSDSSDSSDSSDSSDSSDSSDSSNSSDSSDSSDSSDSSDSSNSSDSSDSSESSDSSDSSDSSDSSDSSDSSDSSDSSDSSNSSDSSDSSDSSDSSDSSDSSDSSDSSDSSDSSDSSDSSDSSDSSDSSDSSDSNESSDSSDSSDSSDSSNSSDSSDSSDSSDSTSDSNDESDSQSKSGNGNNNGSDSDSDSEGSDSNHSTSDD

SEQ ID NO: 4449 - protein, 1301 aa, Homo Sapiens; identical to SEQ ID NO: 4448

SEQ ID NO: 4450 - protein, 123 aa, Homo Sapiens
EMTRKQPDVDKVTKTYKRRAADPSSLQSHIPVLDKGRAGRKRFPASSLYPSGSQTQIETKNPRVNLLVSKWQQVWLLALERRRKLNDALDRLEEVWKFIPSTPHCHLPSFLITHCHCQNLGIF

SEQ ID NO: 4451 - protein, 7461 aa, Homo Sapiens
MAGYLSPAAYLYVEEQEYLQAYEDVLERYKDERDKVQKKTFTKWINQHLMKVRKHVNDLYEDLRDGHNLISLLEVLSGDTLPREKGRMRFHRLQNVQIALDYLKRRQVKLVNIRNDDITDGNPKLTLGLIWTIILHFQISDIHVTGESEDMSAKERLLLWTQQATEGYAGIRCENFTTCWRDGKLFNAIIHKYRPDLIDMNTVAVQSNLANLEHAFYVAEKIGVIRLLDPEDVDVSSPDEKSVITYVSSLYDAFPKVPEGGEGIGANDVEVKWIEYQNMVNYLIQWIRHHVTTMSERTFPNNPVELKALYNQYLQFKETEIPPKETEKSKIKRLYKLLEIWIEFGRIKLLQGYHPNDIEKEWGKLIIAMLEREKALRPEVERLEMLQQIANRVQRDSVICEDKLILAGNALQSDSKRLESGVQFQNEAEIAGYILECENLLRQHVIDVQILIDGKYYQADQLVQRVAKLRDEIMALRNECSSVYSKGRILTTEQTKLMISGITQSLNSGFAQTLHPSLTSGLTQSLTPSLTSSSMTSGLSSGMTSRLTPSVTPAYTPGFPSGLVPNFSSGVEPNSLQTLKLMQIRKPLLKSSLLDQNLTEEEINMKFVQDLLNWVDEMQVQLDRTEWGSDLPSVESHLENHKNVHRAIEEFESSLKEAKISEIQMTAPLKLTYAEKLHRLESQYAKLLNTSRNQERHLDTLHNFVSRATNELIWLNEKEEEEVAYDWSERNTNIARKKDYHAELMRELDQKEENIKSVQEIAEQLLLENHPARLTIEAYRAAMQTQWSWILQLCQCVEQHIKENTAYFEFFNDAKEATDYLRNLKDAIQRKYSCDRSSSIHKLEDLVQESMEEKEELLQYKSTIANLMGKAKTIIQLKPRNSDCPLKTSIPIKAICDYRQIEITIYKDDECVLANNSHRAKWKVISPTGNEAMVPSVCFTVPPPNKEAVDLANRIEQQYQNVLTLWHESHINMKSVVSWHYLINEIDRIRASNVASIKTMLPGEHQQVLSNLQSRFEDFLEDSQESQVFSGSDITQLEKEVNVCKQYYQELLKSAEREEQEESVYNLYISEVRNIRLRLENCEDRLIRQIRTPLERDDLHESVFRITEQEKLKKELERLKDDLGTITNKCEEFFSQAAASSSVPTLRSELNVVLQNMNQVYSMSSTYIDKLKTVNLVLKNTQAAEALVKLYETKLCEEEAVIADKNNIENLISTLKQWRSEVDEKRQVFHALEDELQKAKAISDEMFKTYKERDLDFDWHKEKADQLVERWQNVHVQIDNRLRDLEGIGKSLKYYRDTYHPLDDWIQQVETTQRKIQENQPENSKTLATQLNQQKMLVSEIEMKQSKMDECQKYAEQYSATVKDYELQTMTYRAMVDSQQKSPVKRRRMQSSADLIIQEFMDLRTRYTALVTLMTQYIKFAGDSLKRLEEEEKSLEEEKKEHVEKAKELQKWVSNISKTLKDAEKAGKPPFSKQKISSEEISTKKEQLSEALQTIQLFLAKHGDKMTDEERNELEKQVKTLQESYNLLFSESLKQLQESQTSGDVKVEEKLDKVIAGTIDQTTGEVLSVFQAVLRGLIDYDTGIRLLETQLMISGLISPELRKCFDLKDAKSHGLIDEQILCQLKELSKAKEIISAASPTTIPVLDALAQSMITESMAIKVLEILLSTGSLVIPATGEQLTLQKAFQQNLVSSALFSKVLERQNMCKDLIDPCTSEKVSLIDMVQRSTLQENTGMWLLPVRPQEGGRITLKCGRNISILRAAHEGLIDRETMFRLLSAQLLSGGLINSNSGQRMTVEEAVREGVIDRDTASSILTYQVQTGGIIQSNPAKRLTVDEAVQCDLITSSSALLVLEAQRGYVGLIWPHSGEIFPTSSSLQQELITNELAYKILNGRQKIAALYIPESSQVIGLDAAKQLGIIDNNTASILKNITLPDKMPDLGDLEACKNARRWLSFCKFQPSTVHDYRQEEDVFDGEEPVTTQTSEETKKLFLSYLMINSYMDANTGQRLLLYDGDLDEAVGMLLEGCHAEFDGNTAIKECLDVLSSSGVFLNNASGREKDECTATPSSFNKCHCGEPEHEETPENRKCAIDEEFNEMRNTVINSEFSQSGKLASTISIDPKVNSSPSVCVPSLISYLTQTELADISMLRSDSENILTNYENQSRVETNERANECSHSKNIQNFPSDLIENPIMKSKMSKFCGVNETENEDNTNRDSPIFDYSPRLSALLSHDKLMHSQGSFNDTHTPESNGNKCEAPALSFSDKTMLSGQRIGEKFQDQFLGIAAINISLPGEQYGQKSLNMISSNPQVQYHNDKYISNTSGEDEKTHPGFQQMPEDKEDESEIEEYSCAVTPGGDTDNAIVSLTCATPLLDETISASDYETSLLNDQQNNTGTDTDSDDDFYDTPLFEDDDHDSLLLDGDDRDCLHPEDYDTLQEENDETASPADVFYDVSKENENSMVPQGAPVGSLSVKNKAHCLQDFLMDVEKDELDSGEKIHLNPVGSDKVNGQSLETGSERECTNILEGDESDSLTDYDIVGGKESFTASLKFDDSGSWRGRKEEYVTGQEFHSDTDHLDSMQSEESYGDYIYDSNDQDDDDDDGIDEEGGGIRDENGKPRCQNVAEDMDIQLCASILNENSDENENINTMILLDKMHSCSSLEKQQRVNVVQLASPSENNLVTEKSNLPEYTTEIAGKSKENLLNHEMVLKDVLPPIIKDTESEKTFGPASISHDNNNISSTSELGTDLANTKVKLIQGSELPELTDSVKGKDEYFKNMTPKVDSSLDHIICTEPDLIGKPAEESHLSLIASVTDKDPQGNGSDLIKGRDGKSDILIEDETSIQKMYLGEGEVLVEGLVEEENRHLKLLPGKNTRDSFKLINSQFPFPQITNNEELNQKGSLKKATVTLKDEPNNLQIIVSKSPVQFENLEEIFDTSVSKEISDDITSDITSWEGNTHFEESFTDGPEKELDLFTYLKHCAKNIKAKDVAKPNEDVPSHVLITAPPMKEHLQLGVNNTKEKSTSTQKDSPLNDMIQSNDLCSKESISGGGTEISQFTPESIEATLSILSRKHVEDVGKNDFLQSERCANGLGNDNSSNTLNTDYSFLEINNKKERIEQQLPKEQALSPRSQEKEVQIPELSQVFVEDVKDILKSRLKEGHMNPQEVEEPSACADTKILIQNLIKRITTSQLVNEASTVPSDSQMSDSSGVSPMTNSSELKPESRDDPFCIGNLKSELLLNILKQDQHSQKITGVFELMRELTHMEYDLEKRGITSKVLPLQLENIFYKLLADGYSEKIEHVGDFNQKACSTSEMMEEKPHILGDIKSKEGNYYSPNLETVKEIGLESSTVWASTLPRDEKLKDLCNDFPSHLECTSGSKEMASGDSSTEQFSSELQQCLQHTEKMHEYLTLLQDMKPPLDNQESLDNNLEALKNQLRQLETFELGLAPIAVILRKDMKLAEEFLKSLPSDFPRGHVEELSISHQSLKTAFSSLSNVSSERTKQIMLAIDSEMSKLAVSHEEFLHKLKSFSDWVSEKSKSVKDIEIVNVQDSEYVKKRLEFLKNVLKDLGHTKMQLETTAFDVQFFISEYAQDLSPNQSKQLLRLLNTTQKCFLDVQESVTTQVERLETQLHLEQDLDDQKIVAERQQEYKEKLQGICDLLTQTENRLIGHQEAFMIGDGTVELKKYQSKQEELQKDMQGSAQALAEVVKNTENFLKENGEKLSQEDKALIEQKLNEAKIKCEQLNLKAEQSKKELDKVVTTAIKEETEKVAAVKQLEESKTKIENLLDWLSNVDKDSERAGTKHKQVIEQNGTHFQEGDGKSAIGEEDEVNGNLLETDVDGQVGTTQENLNQQYQKVKAQHEKIISQHQAVIIATQSAQVLLEKQGQYLSPEEKEKLQKNMKELKVHYETALAESEKKMKLTHSLQEELEKFDADYTEFEHWLQQSEQELENLEAGADDINGLMTKLKRQKSFSEDVISHKGDLRYITISGNRVLEAAKSCSKRDGGKVDTSATHREVQRKLDHATDRFRSLYSKCNVLGNNLKDLVDKYQHYEDASCGLLAGLQACEATASKHLSEPIAVDPKNLQRQLEETKALQGQISSQQVAVEKLKKTAEVLLDARGSLLPAKNDIQKTLDDIVGRYEDLSKSVNERNEKLQITLTRSLSVQDGLDEMLDWMGNVESSLKEQGQVPLNSTALQDIISKNIMLEQDIAGRQSSINAMNEKVKKFMETTDPSTASSLQAKMKDLSARFSEASHKHKETLAKMEELKTKVELFENLSEKLQTFLETKTQALTEVDVPGKDVTELSQYMQESTSEFLEHKKHLEVLHSLLKEISSHGLPSDKALVLEKTNNLSKKFKEMEDTIKEKKEAVTSCQEQLDAFQVLVKSLKSWIKETTKKVPIVQPSFGAEDLGKSLEDTKKLQEKWSLKTPEIQKVNNSGISLCNLISAVTTPAKAIAAVKSGGAVLNGEGTATNTEEFWANKGLTSIKKDMTDISHGYEDLGLLLKDKIAELNTKLSKLQKAQEESSAMMQWLQKMNKTATKWQQTPAPTDTEAVKTQVEQNKSFEAELKQNVNKVQELKDKLTELLEENPDTPEAPRWKQMLTEIDSKWQELNQLTIDRQQKLEESSNNLTQFQTVEAQLKQWLVEKELMVSVLGPLSIDPNMLNTQRQQVQILLQEFATRKPQYEQLTAAGQGILSRPGEDPSLRGIVKEQLAAVTQKWDSLTGQLSDRCDWIDQAIVKSTQYQSLLRSLSDKLSDLDNKLSSSLAVSTHPDAMNQQLETAQKMKQEIQQEKKQIKVAQALCEDLSALVKEEYLKAELSRQLEGILKSFKDVEQKAENHVQHLQSACASSHQFQQMSRDFQAWLDTKKEEQNKSHPISAKLDVLESLIKDHKDFSKTLTAQSHMYEKTIAEGENLLLKTQGSEKAALQLQLNTIKTNWDTFNKQVKERENKLKESLEKALKYKEQVETLWPWIDKCQNNLEEIKFCLDPAEGENSIAKLKSLQKEMDQHFGMVELLNNTANSLLSVCEIDKEVVTDENKSLIQKVDMVTEQLHSKKFCLENMTQKFKEFQEVSKESKRQLQCAKEQLDIHDSLGSQAYSNKYLTMLQTQQKSLQALKHQVDLAKRLAQDLVVEASDSKGTSDVLLQVETIAQEHSTLSQQVDEKCSFLETKLQGIGHFQNTIREMFSQFAEFDDELDSMAPVGRDAETLQKQKETIKAFLKKLEALMASNDNANKTCKMMLATEETSPDLVGIKRDLEALSKQCNKLLDRAQAREEQVEGTIKRLEEFYSKLKEFSILLQKAEEHEESQGPVGMETETINQQLNMFKVFQKEEIEPLQGKQQDVNWLGQGLIQSAAKSTSTQGLEHDLDDVNARWKTLNKKVAQRAAQLQEALLHCGRFQDALESLLSWMVDTEELVANQKPPSAEFKVVKAQIQEQKLLQRLLDDRKSTVEVIKREGEKIATTAEPADKVKILKQLSLLDSRWEALLNKAETRNRQLEGISVVAQQFHETLEPLNEWLTTIEKRLVNCEPIGTQASKLEEQIAQHKVLQEDILLRKQNVDQALLNGLELLKQTTGDEVLIIQDKLEAIKARYKDITKLSTDVAKTLEQALQLARRLHSTHEELCTWLDKVEVELLSYETQVLKGEEASQAQMRPKELKKEAKNNKALLDSLNEVSSALLELVPWRAREGLEKMVAEDNERYRLVSDTITQKVEEIDAAILRSQQFDQAADAELSWITETEKKLMSLGDIRLEQDQTSAQLQVQKTFTMEILRHKDIIDDLVKSGHKIMTACSEEEKQSMKKKLDKVLKNYDTICQINSERYLQLERAQSLVNQFWETYEELWPWLTETQSIISQLPAPALEYETLRQQQEEHRQLRELIAEHKPHIDKMNKTGPQLLELSPGEGFSIQEKYVAADTLYSQIKEDVKKRAVALDEAISQSTQFHDKIDQILESLERIVERLRQPPSISAEVEKIKEQISENKNVSVDMEKLQPLYETLKQRGEEMIARSGGTDKDISAKAVQDKLDQMVFIWENIHTLVEEREAKLLDVMELAEKFWCDHMSLIVTIKDTQDFIRDLEDPGIDPSVVKQQQEAAETIREEIDGLQEELDIVINLGSELIAACGEPDKPIVKKSIDELNSAWDSLNKAWKDRIDKLEEAMQAAVQYQDGLQAVFDWVDIAGGKLASMSPIGTDLETVKQQIEELKQFKSEAYQQQIEMERLNHQAELLLKKVTEESDKHTVQDPLMELKLIWDSLEERIINRQHKLEGALLALGQFQHALDELLAWLTHTEGLLSEQKPVGGDPKAIEIELAKHHVLQNDVLAHQSTVEAVNKAGNDLIESSAGEEASNLQNKLEVLNQRWQNVLEKTEQRKQQLDGALRQAKGFHGEIEDLQQWLTDTERHLLASKPLGGLPETAKEQLNVHMEVCAAFEAKEETYKSLMQKGQQMLARCPKSAETNIDQDINNLKEKWESVETKLNERKTKLEEALNLAMEFHNSLQDFINWLTQAEQTLNVASRPSLILDTVLFQIDEHKVFANEVNSHREQIIELDKTGTHLKYFSQKQDVVLIKNLLISVQSRWEKVVQRLVERGRSLDDARKRAKQFHEAWSKLMEWLEESEKSLDSELEIANDPDKIKTQLAQHKEFQKSLGAKHSVYDTTNRTGRSLKEKTSLADDNLKLDDMLSELRDKWDTICGKSVERQNKLEEALLFSGQFTDALQALIDWLYRVEPQLAEDQPVHGDIDLVMNLIDNHKAFQKELGKRTSSVQALKRSARELIEGSRDDSSWVKVQMQELSTRWETVCALSISKQTRLEAALRQAEEFHSVVHALLEWLAEAEQTLRFHGVLPDDEDALRTLIDQHKEFMKKLEEKRAELNKATTMGDTVLAICHPDSITTIKHWITIIRARFEEVLAWAKQHQQRLASALAGLIAKQELLEALLAWLQWAETTLTDKDKEVIPQEIEEVKALIAEHQTFMEEMTRKQPDVDKVTKTYKRRAADPSSLQSHIPVLDKGRAGRKRFPASSLYPSGSQTQIETKNPRVNLLVSKWQQVWLLALERRRKLNDALDRLEELREFANFDFDIWRKKYMRWMNHKKSRVMDFFRRIDKDQDGKITRQEFIDGILSSKFPTSRLEMSAVADIFDRDGDGYIDYYEFVAALHPNKDAYKPITDADKIEDEVTRQVAKCKCAKRFQVEQIGDNKYRFFLGNQFGDSQQLRLVRILRSTVMVRVGGGWMALDEFLVKNDPCRVHHHGSKMLRSESNSSITTTQPTIAKGRTNMELREKFILADGASQGMAAFRPRGRRSRPSSRGASPNRSTSVSSQAAQAASPQVPATTTPKGTPIQGSKLRLPGYLSGKGFHSGEDSGLITTAAARVRTQFADSKKTPSRPGSRAGSKAGSRASSRRGSDASDFDISEIQSVCSDVETVPQTHRPTPRAGSRPSTAKPSKIPTPQRKSPASKLDKSSKR

SEQ ID NO: 4452 - protein, 5375 aa, Homo Sapiens
MAGYLSPAAYLYVEEQEYLQAYEDVLERYKDERDKVQKKTFTKWINQHLMKVRKHVNDLYEDLRDGHNLISLLEVLSGDTLPREKGRMRFHRLQNVQIALDYLKRRQVKLVNIRNDDITDGNPKLTLGLIWTIILHFQISDIHVTGESEDMSAKERLLLWTQQATEGYAGIRCENFTTCWRDGKLFNAIIHKYRPDLIDMNTVAVQSNLANLEHAFYVAEKIGVIRLLDPEDVDVSSPDEKSVITYVSSLYDAFPKVPEGGEGIGANDVEVKWIEYQNMVNYLIQWIRHHVTTMSERTFPNNPVELKALYNQYLQFKETEIPPKETEKSKIKRLYKLLEIWIEFGRIKLLQGYHPNDIEKEWGKLIIAMLEREKALRPEVERLEMLQQIANRVQRDSVICEDKLILAGNALQSDSKRLESGVQFQNEAEIAGYILECENLLRQHVIDVQILIDGKYYQADQLVQRVAKLRDEIMALRNECSSVYSKGRILTTEQTKLMISGITQSLNSGFAQTLHPSLTSGLTQSLTPSLTSSSMTSGLSSGMTSRLTPSVTPAYTPGFPSGLVPNFSSGVEPNSLQTLKLMQIRKPLLKSSLLDQNLTEEEINMKFVQDLLNWVDEMQVQLDRTEWGSDLPSVESHLENHKNVHRAIEEFESSLKEAKISEIQMTAPLKLTYAEKLHRLESQYAKLLNTSRNQERHLDTLHNFVSRATNELIWLNEKEEEEVAYDWSERNTNIARKKDYHAELMRELDQKEENIKSVQEIAEQLLLENHPARLTIEAYRAAMQTQWSWILQLCQCVEQHIKENTAYFEFFNDAKEATDYLRNLKDAIQRKYSCDRSSSIHKLEDLVQESMEEKEELLQYKSTIANLMGKAKTIIQLKPRNSDCPLKTSIPIKAICDYRQIEITIYKDDECVLANNSHRAKWKVISPTGNEAMVPSVCFTVPPPNKEAVDLANRIEQQYQNVLTLWHESHINMKSVVSWHYLINEIDRIRASNVASIKTMLPGEHQQVLSNLQSRFEDFLEDSQESQVFSGSDITQLEKEVNVCKQYYQELLKSAEREEQEESVYNLYISEVRNIRLRLENCEDRLIRQIRTPLERDDLHESVFRITEQEKLKKELERLKDDLGTITNKCEEFFSQAAASSSVPTLRSELNVVLQNMNQVYSMSSTYIDKLKTVNLVLKNTQAAEALVKLYETKLCEEEAVIADKNNIENLISTLKQWRSEVDEKRQVFHALEDELQKAKAISDEMFKTYKERDLDFDWHKEKADQLVERWQNVHVQIDNRLRDLEGIGKSLKYYRDTYHPLDDWIQQVETTQRKIQENQPENSKTLATQLNQQKMLVSEIEMKQSKMDECQKYAEQYSATVKDYELQTMTYRAMVDSQQKSPVKRRRMQSSADLIIQEFMDLRTRYTALVTLMTQYIKFAGDSLKRLEEEEKSLEEEKKEHVEKAKELQKWVSNISKTLKDAEKAGKPPFSKQKISSEEISTKKEQLSEALQTIQLFLAKHGDKMTDEERNELEKQVKTLQESYNLLFSESLKQLQESQTSGDVKVEEKIVAERQQEYKEKLQGICDLLTQTENRLIGHQEAFMIGDGTVELKKYQSKQEELQKDMQGSAQALAEVVKNTENFLKENGEKLSQEDKALIEQKLNEAKIKCEQLNLKAEQSKKELDKVVTTAIKEETEKVAAVKQLEESKTKIENLLDWLSNVDKDSERAGTKHKQVIEQNGTHFQEGDGKSAIGEEDEVNGNLLETDVDGQVGTTQENLNQQYQKVKAQHEKIISQHQAVIIATQSAQVLLEKQGQYLSPEEKEKLQKNMKELKVHYETALAESEKKMKLTHSLQEELEKFDADYTEFEHWLQQSEQELENLEAGADDINGLMTKLKRQKSFSEDVISHKGDLRYITISGNRVLEAAKSCSKRDGGKVDTSATHREVQRKLDHATDRFRSLYSKCNVLGNNLKDLVDKYQHYEDASCGLLAGLQACEATASKHLSEPIAVDPKNLQRQLEETKALQGQISSQQVAVEKLKKTAEVLLDARGSLLPAKNDIQKTLDDIVGRYEDLSKSVNERNEKLQITLTRSLSVQDGLDEMLDWMGNVESSLKEQGQVPLNSTALQDIISKNIMLEQDIAGRQSSINAMNEKVKKFMETTDPSTASSLQAKMKDLSARFSEASHKHKETLAKMEELKTKVELFENLSEKLQTFLETKTQALTEVDVPGKDVTELSQYMQESTSEFLEHKKHLEVLHSLLKEISSHGLPSDKALVLEKTNNLSKKFKEMEDTIKEKKEAVTSCQEQLDAFQVLVKSLKSWIKETTKKVPIVQPSFGAEDLGKSLEDTKKLQEKWSLKTPEIQKVNNSGISLCNLISAVTTPAKAIAAVKSGGAVLNGEGTATNTEEFWANKGLTSIKKDMTDISHGYEDLGLLLKDKIAELNTKLSKLQKAQEESSAMMQWLQKMNKTATKWQQTPAPTDTEAVKTQVEQNKSFEAELKQNVNKVQELKDKLTELLEENPDTPEAPRWKQMLTEIDSKWQELNQLTIDRQQKLEESSNNLTQFQTVEAQLKQWLVEKELMVSVLGPLSIDPNMLNTQRQQVQILLQEFATRKPQYEQLTAAGQGILSRPGEDPSLRGIVKEQLAAVTQKWDSLTGQLSDRCDWIDQAIVKSTQYQSLLRSLSDKLSDLDNKLSSSLAVSTHPDAMNQQLETAQKMKQEIQQEKKQIKVAQALCEDLSALVKEEYLKAELSRQLEGILKSFKDVEQKAENHVQHLQSACASSHQFQQMSRDFQAWLDTKKEEQNKSHPISAKLDVLESLIKDHKDFSKTLTAQSHMYEKTIAEGENLLLKTQGSEKAALQLQLNTIKTNWDTFNKQVKERENKLKESLEKALKYKEQVETLWPWIDKCQNNLEEIKFCLDPAEGENSIAKLKSLQKEMDQHFGMVELLNNTANSLLSVCEIDKEVVTDENKSLIQKVDMVTEQLHSKKFCLENMTQKFKEFQEVSKESKRQLQCAKEQLDIHDSLGSQAYSNKYLTMLQTQQKSLQALKHQVDLAKRLAQDLVVEASDSKGTSDVLLQVETIAQEHSTLSQQVDEKCSFLETKLQGIGHFQNTIREMFSQFAEFDDELDSMAPVGRDAETLQKQKETIKAFLKKLEALMASNDNANKTCKMMLATEETSPDLVGIKRDLEALSKQCNKLLDRAQAREEQVEGTIKRLEEFYSKLKEFSILLQKAEEHEESQGPVGMETETINQQLNMFKVFQKEEIEPLQGKQQDVNWLGQGLIQSAAKSTSTQGLEHDLDDVNARWKTLNKKVAQRAAQLQEALLHCGRFQDALESLLSWMVDTEELVANQKPPSAEFKVVKAQIQEQKLLQRLLDDRKSTVEVIKREGEKIATTAEPADKVKILKQLSLLDSRWEALLNKAETRNRQLEGISVVAQQFHETLEPLNEWLTTIEKRLVNCEPIGTQASKLEEQIAQHKVLQEDILLRKQNVDQALLNGLELLKQTTGDEVLIIQDKLEAIKARYKDITKLSTDVAKTLEQALQLARRLHSTHEELCTWLDKVEVELLSYETQVLKGEEASQAQMRPKELKKEAKNNKALLDSLNEVSSALLELVPWRAREGLEKMVAEDNERYRLVSDTITQKVEEIDAAILRSQQFDQAADAELSWITETEKKLMSLGDIRLEQDQTSAQLQVQKTFTMEILRHKDIIDDLVKSGHKIMTACSEEEKQSMKKKLDKVLKNYDTICQINSERYLQLERAQSLVNQFWETYEELWPWLTETQSIISQLPAPALEYETLRQQQEEHRQLRELIAEHKPHIDKMNKTGPQLLELSPGEGFSIQEKYVAADTLYSQIKEDVKKRAVALDEAISQSTQFHDKIDQILESLERIVERLRQPPSISAEVEKIKEQISENKNVSVDMEKLQPLYETLKQRGEEMIARSGGTDKDISAKAVQDKLDQMVFIWENIHTLVEEREAKLLDVMELAEKFWCDHMSLIVTIKDTQDFIRDLEDPGIDPSVVKQQQEAAETIREEIDGLQEELDIVINLGSELIAACGEPDKPIVKKSIDELNSAWDSLNKAWKDRIDKLEEAMQAAVQYQDGLQAVFDWVDIAGGKLASMSPIGTDLETVKQQIEELKQFKSEAYQQQIEMERLNHQAELLLKKVTEESDKHTVQDPLMELKLIWDSLEERIINRQHKLEGALLALGQFQHALDELLAWLTHTEGLLSEQKPVGGDPKAIEIELAKHHVLQNDVLAHQSTVEAVNKAGNDLIESSAGEEASNLQNKLEVLNQRWQNVLEKTEQRKQQLDGALRQAKGFHGEIEDLQQWLTDTERHLLASKPLGGLPETAKEQLNVHMEVCAAFEAKEETYKSLMQKGQQMLARCPKSAETNIDQDINNLKEKWESVETKLNERKTKLEEALNLAMEFHNSLQDFINWLTQAEQTLNVASRPSLILDTVLFQIDEHKVFANEVNSHREQIIELDKTGTHLKYFSQKQDVVLIKNLLISVQSRWEKVVQRLVERGRSLDDARKRAKQFHEAWSKLMEWLEESEKSLDSELEIANDPDKIKTQLAQHKEFQKSLGAKHSVYDTTNRTGRSLKEKTSLADDNLKLDDMLSELRDKWDTICGKSVERQNKLEEALLFSGQFTDALQALIDWLYRVEPQLAEDQPVHGDIDLVMNLIDNHKAFQKELGKRTSSVQALKRSARELIEGSRDDSSWVKVQMQELSTRWETVCALSISKQTRLEAALRQAEEFHSVVHALLEWLAEAEQTLRFHGVLPDDEDALRTLIDQHKEFMKKLEEKRAELNKATTMGDTVLAICHPDSITTIKHWITIIRARFEEVLAWAKQHQQRLASALAGLIAKQELLEALLAWLQWAETTLTDKDKEVIPQEIEEVKALIAEHQTFMEEMTRKQPDVDKVTKTYKRRAADPSSLQSHIPVLDKGRAGRKRFPASSLYPSGSQTQIETKNPRVNLLVSKWQQVWLLALERRRKLNDALDRLEELREFANFDFDIWRKKYMRWMNHKKSRVMDFFRRIDKDQDGKITRQEFIDGILSSKFPTSRLEMSAVADIFDRDGDGYIDYYEFVAALHPNKDAYKPITDADKIEDEVTRQVAKCKCAKRFQVEQIGDNKYRFFLGNQFGDSQQLRLVRILRSTVMVRVGGGWMALDEFLVKNDPCRVHHHGSKMLRSESNSSITTTQPTIAKGRTNMELREKFILADGASQGMAAFRPRGRRSRPSSRGASPNRSTSVSSQAAQAASPQVPATTTPKGTPIQGSKLRLPGYLSGKGFHSGEDSGLITTAAARVRTQFADSKKTPSRPGSRAGSKAGSRASSRRGSDASDFDISEIQSVCSDVETVPQTHRPTPRAGSRPSTAKPSKIPTPQRKSPASKLDKSSKR

SEQ ID NO: 4453 - protein, 5497 aa, Homo Sapiens
MAGYLSPAAYLYVEEQEYLQAYEDVLERYKDERDKVQKKTFTKWINQHLMKVRKHVNDLYEDLRDGHNLISLLEVLSGDTLPREKGRMRFHRLQNVQIALDYLKRRQVKLVNIRNDDITDGNPKLTLGLIWTIILHFQISDIHVTGESEDMSAKERLLLWTQQATEGYAGIRCENFTTCWRDGKLFNAIIHKYRPDLIDMNTVAVQSNLANLEHAFYVAEKIGVIRLLDPEDVDVSSPDEKSVITYVSSLYDAFPKVPEGGEGIGANDVEVKWIEYQNMVNYLIQWIRHHVTTMSERTFPNNPVELKALYNQYLQFKETEIPPKETEKSKIKRLYKLLEIWIEFGRIKLLQGYHPNDIEKEWGKLIIAMLEREKALRPEVERLEMLQQIANRVQRDSVICEDKLILAGNALQSDSKRLESGVQFQNEAEIAGYILECENLLRQHVIDVQILIDGKYYQADQLVQRVAKLRDEIMALRNECSSVYSKGRILTTEQTKLMISGITQSLNSGFAQTLHPSLTSGLTQSLTPSLTSSSMTSGLSSGMTSRLTPSVTPAYTPGFPSGLVPNFSSGVEPNSLQTLKLMQIRKPLLKSSLLDQNLTEEEINMKFVQDLLNWVDEMQVQLDRTEWGSDLPSVESHLENHKNVHRAIEEFESSLKEAKISEIQMTAPLKLTYAEKLHRLESQYAKLLNTSRNQERHLDTLHNFVSRATNELIWLNEKEEEEVAYDWSERNTNIARKKDYHAELMRELDQKEENIKSVQEIAEQLLLENHPARLTIEAYRAAMQTQWSWILQLCQCVEQHIKENTAYFEFFNDAKEATDYLRNLKDAIQRKYSCDRSSSIHKLEDLVQESMEEKEELLQYKSTIANLMGKAKTIIQLKPRNSDCPLKTSIPIKAICDYRQIEITIYKDDECVLANNSHRAKWKVISPTGNEAMVPSVCFTVPPPNKEAVDLANRIEQQYQNVLTLWHESHINMKSVVSWHYLINEIDRIRASNVASIKTMLPGEHQQVLSNLQSRFEDFLEDSQESQVFSGSDITQLEKEVNVCKQYYQELLKSAEREEQEESVYNLYISEVRNIRLRLENCEDRLIRQIRTPLERDDLHESVFRITEQEKLKKELERLKDDLGTITNKCEEFFSQAAASSSVPTLRSELNVVLQNMNQVYSMSSTYIDKLKTVNLVLKNTQAAEALVKLYETKLCEEEAVIADKNNIENLISTLKQWRSEVDEKRQVFHALEDELQKAKAISDEMFKTYKERDLDFDWHKEKADQLVERWQNVHVQIDNRLRDLEGIGKSLKYYRDTYHPLDDWIQQVETTQRKIQENQPENSKTLATQLNQQKMLVSEIEMKQSKMDECQKYAEQYSATVKDYELQTMTYRAMVDSQQKSPVKRRRMQSSADLIIQEFMDLRTRYTALVTLMTQYIKFAGDSLKRLEEEEKSLEEEKKEHVEKAKELQKWVSNISKTLKDAEKAGKPPFSKQKISSEEISTKKEQLSEALQTIQLFLAKHGDKMTDEERNELEKQVKTLQESYNLLFSESLKQLQESQTSGDVKVEEKIVAERQQEYKEKLQGICDLLTQTENRLIGHQEAFMIGDGTVELKKYQSKQEELQKDMQGSAQALAEVVKNTENFLKENGEKLSQEDKALIEQKLNEAKIKCEQLNLKAEQSKKELDKVVTTAIKEETEKVAAVKQLEESKTKIENLLDWLSNVDKDSERAGTKHKQVIEQNGTHFQEGDGKSAIGEEDEVNGNLLETDVDGQVGTTQENLNQQYQKVKAQHEKIISQHQAVIIATQSAQVLLEKQGQYLSPEEKEKLQKNMKELKVHYETALAESEKKMKLTHSLQEELEKFDADYTEFEHWLQQSEQELENLEAGADDINGLMTKLKRQKSFSEDVISHKGDLRYITISGNRVLEAAKSCSKRDGGKVDTSATHREVQRKLDHATDRFRSLYSKCNVLGNNLKDLVDKYQHYEDASCGLLAGLQACEATASKHLSEPIAVDPKNLQRQLEETKALQGQISSQQVAVEKLKKTAEVLLDARGSLLPAKNDIQKTLDDIVGRYEDLSKSVNERNEKLQITLTRSLSVQDGLDEMLDWMGNVESSLKEQGQVPLNSTALQDIISKNIMLEQDIAGRQSSINAMNEKVKKFMETTDPSTASSLQAKMKDLSARFSEASHKHKETLAKMEELKTKVELFENLSEKLQTFLETKTQALTEVDVPGKDVTELSQYMQESTSEFLEHKKHLEVLHSLLKEISSHGLPSDKALVLEKTNNLSKKFKEMEDTIKEKKEAVTSCQEQLDAFQVLVKSLKSWIKETTKKVPIVQPSFGAEDLGKSLEDTKKLQEKWSLKTPEIQKVNNSGISLCNLISAVTTPAKAIAAVKSGGAVLNGEGTATNTEEFWANKGLTSIKKDMTDISHGYEDLGLLLKDKIAELNTKLSKLQKAQEESSAMMQWLQKMNKTATKWQQTPAPTDTEAVKTQVEQNKSFEAELKQNVNKVQELKDKLTELLEENPDTPEAPRWKQMLTEIDSKWQELNQLTIDRQQKLEESSNNLTQFQTVEAQLKQWLVEKELMVSVLGPLSIDPNMLNTQRQQVQILLQEFATRKPQYEQLTAAGQGILSRPGEDPSLRGIVKEQLAAVTQKWDSLTGQLSDRCDWIDQAIVKSTQYQSLLRSLSDKLSDLDNKLSSSLAVSTHPDAMNQQLETAQKMKQEIQQEKKQIKVAQALCEDLSALVKEEYLKAELSRQLEGILKSFKDVEQKAENHVQHLQSACASSHQFQQMSRDFQAWLDTKKEEQNKSHPISAKLDVLESLIKDHKDFSKTLTAQSHMYEKTIAEGENLLLKTQGSEKAALQLQLNTIKTNWDTFNKQVKERENKLKESLEKALKYKEQVETLWPWIDKCQNNLEEIKFCLDPAEGENSIAKLKSLQKEMDQHFGMVELLNNTANSLLSVCEIDKEVVTDENKSLIQKVDMVTEQLHSKKFCLENMTQKFKEFQEVSKESKRQLQCAKEQLDIHDSLGSQAYSNKYLTMLQTQQKSLQALKHQVDLAKRLAQDLVVEASDSKGTSDVLLQVETIAQEHSTLSQQVDEKCSFLETKLQGIGHFQNTIREMFSQFAEFDDELDSMAPVGRDAETLQKQKETIKAFLKKLEALMASNDNANKTCKMMLATEETSPDLVGIKRDLEALSKQCNKLLDRAQAREEQVEGTIKRLEEFYSKLKEFSILLQKAEEHEESQGPVGMETETINQQLNMFKVFQKEEIEPLQGKQQDVNWLGQGLIQSAAKSTSTQGLEHDLDDVNARWKTLNKKVAQRAAQLQEALLHCGRFQDALESLLSWMVDTEELVANQKPPSAEFKVVKAQIQEQKLLQRLLDDRKSTVEVIKREGEKIATTAEPADKVKILKQLSLLDSRWEALLNKAETRNRQLEGISVVAQQFHETLEPLNEWLTTIEKRLVNCEPIGTQASKLEEQIAQHKALEDDIINHNKHLHQAVSIGQSLKVLSSREDKDMVQSKLDFSQVWYIEIQEKSHSRSELLQQALCNAKIFGEDEVELMNWLNEVHDKLSKLSVQDYSTEGLWKQQSELRVLQEDILLRKQNVDQALLNGLELLKQTTGDEVLIIQDKLEAIKARYKDITKLSTDVAKTLEQALQLARRLHSTHEELCTWLDKVEVELLSYETQVLKGEEASQAQMRPKELKKEAKNNKALLDSLNEVSSALLELVPWRAREGLEKMVAEDNERYRLVSDTITQKVEEIDAAILRSQQFDQAADAELSWITETEKKLMSLGDIRLEQDQTSAQLQVQKTFTMEILRHKDIIDDLVKSGHKIMTACSEEEKQSMKKKLDKVLKNYDTICQINSERYLQLERAQSLVNQFWETYEELWPWLTETQSIISQLPAPALEYETLRQQQEEHRQLRELIAEHKPHIDKMNKTGPQLLELSPGEGFSIQEKYVAADTLYSQIKEDVKKRAVALDEAISQSTQFHDKIDQILESLERIVERLRQPPSISAEVEKIKEQISENKNVSVDMEKLQPLYETLKQRGEEMIARSGGTDKDISAKAVQDKLDQMVFIWENIHTLVEEREAKLLDVMELAEKFWCDHMSLIVTIKDTQDFIRDLEDPGIDPSVVKQQQEAAETIREEIDGLQEELDIVINLGSELIAACGEPDKPIVKKSIDELNSAWDSLNKAWKDRIDKLEEAMQAAVQYQDGLQAVFDWVDIAGGKLASMSPIGTDLETVKQQIEELKQFKSEAYQQQIEMERLNHQAELLLKKVTEESDKHTVQDPLMELKLIWDSLEERIINRQHKLEGALLALGQFQHALDELLAWLTHTEGLLSEQKPVGGDPKAIEIELAKHHVLQNDVLAHQSTVEAVNKAGNDLIESSAGEEASNLQNKLEVLNQRWQNVLEKTEQRKQQLDGALRQAKGFHGEIEDLQQWLTDTERHLLASKPLGGLPETAKEQLNVHMEVCAAFEAKEETYKSLMQKGQQMLARCPKSAETNIDQDINNLKEKWESVETKLNERKTKLEEALNLAMEFHNSLQDFINWLTQAEQTLNVASRPSLILDTVLFQIDEHKVFANEVNSHREQIIELDKTGTHLKYFSQKQDVVLIKNLLISVQSRWEKVVQRLVERGRSLDDARKRAKQFHEAWSKLMEWLEESEKSLDSELEIANDPDKIKTQLAQHKEFQKSLGAKHSVYDTTNRTGRSLKEKTSLADDNLKLDDMLSELRDKWDTICGKSVERQNKLEEALLFSGQFTDALQALIDWLYRVEPQLAEDQPVHGDIDLVMNLIDNHKAFQKELGKRTSSVQALKRSARELIEGSRDDSSWVKVQMQELSTRWETVCALSISKQTRLEAALRQAEEFHSVVHALLEWLAEAEQTLRFHGVLPDDEDALRTLIDQHKEFMKKLEEKRAELNKATTMGDTVLAICHPDSITTIKHWITIIRARFEEVLAWAKQHQQRLASALAGLIAKQELLEALLAWLQWAETTLTDKDKEVIPQEIEEVKALIAEHQTFMEEMTRKQPDVDKVTKTYKRRAADPSSLQSHIPVLDKGRAGRKRFPASSLYPSGSQTQIETKNPRVNLLVSKWQQVWLLALERRRKLNDALDRLEELREFANFDFDIWRKKYMRWMNHKKSRVMDFFRRIDKDQDGKITRQEFIDGILSSKFPTSRLEMSAVADIFDRDGDGYIDYYEFVAALHPNKDAYKPITDADKIEDEVTRQVAKCKCAKRFQVEQIGDNKYRFFLGNQFGDSQQLRLVRILRSTVMVRVGGGWMALDEFLVKNDPCRAKGRTNMELREKFILADGASQGMAAFRPRGRRSRPSSRGASPNRSTSVSSQAAQAASPQVPATTTPKILHPLTRNYGKPWLTNSKMSTPCKAAECSDFPVPSAEGTPIQGSKLRLPGYLSGKGFHSGEDSGLITTAAARVRTQFADSKKTPSRPGSRAGSKAGSRASSRRGSDASDFDISEIQSVCSDVETVPQTHRPTPRAGSRPSTAKPSKIPTPQRKSPASKLDKSSKR

SEQ ID NO: 4454 - protein, 1674 aa, Homo Sapiens
MGKPLSRPDCLRQNPPCVGKGEEEEDLNIEDCYVPQRSIYDTVRLNEQIDSGSKGSLSSRHFTDRTLPYSHRTLDVSSLCSNGALTSSSVFELRGREANKLDEKMIFDALKLNSDIIRTTGLPKAKSHAEKKEHRRSWRMFVPANFMDYANKSESSFVEPADMSDAVTKASKCRWGTNSLTSEEDDSGLCSPPAEREEKQGILTGDQSRIKSLSSTEDILVTDQYRPFFSVNSISEQKIPLLSCQSAHPDENFKMILHDVSPLEEAKHVNGQREIHDENCCLQNNLKESPVKCDPLIMPRNRENEHIFNLGEEDETYGPGESQITAQSRELLKDSPQDLDLSHTDLGESDVDCGSTSLVENVTLLTQYDSGECNIASKEEVEAPLSAQESEMLYKKFSLKFVSARKKAAPRKTGAQAGILDTVCNGFQLVQVFQKEEIEPLQGKQQDVNWLGQGLIQSAAKSTSTQGLEHDLDDVNARWKTLNKKVAQRAAQLQEALLHCGRFQDALESLLSWMVDTEELVANQKPPSAEFKVVKAQIQEQKLLQRLLDDRKSTVEVIKREGEKIATTAEPADKVKILKQLSLLDSRWEALLNKAETRNRQLEGISVVAQQFHETLEPLNEWLTTIEKRLVNCEPIGTQASKLEEQIAQHKALEDDIINHNKHLHQAVSIGQSLKVLSSREDKDMVQSKLDFSQVWYIEIQEKSHSRSELLQQALCNAKIFGEDEVELMNWLNEVHDKLSKLSVQDYSTEGLWKQQSELRVLQEDILLRKQNVDQALLNGLELLKQTTGDEVLIIQDKLEAIKARYKDITKLSTDVAKTLEQALQLARRLHSTHEELCTWLDKVEVELLSYETQVLKGEEASQAQMRPKELKKEAKNNKALLDSLNEVSSALLELVPWRAREGLEKMVAEDNERYRLVSDTITQKVEEIDAAILRSQQFDQAADAELSWITETEKKLMSLGDIRLEQDQTSAQLQVQKTFTMEILRHKDIIDDLVKSGHKIMTACSEEEKQSMKKKLDKVLKNYDTICQINSERYLQLERAQSLVNQFWETYEELWPWLTETQSIISQLPAPALEYETLRQQQEEHRQLRELIAEHKPHIDKMNKTGPQLLELSPGEGFSIQEKYVAADTLYSQIKEDVKKRAVALDEAISQSTQFHDKIDQILESLERIVERLRQPPSISAEVEKIKEQISENKNVSVDMEKLQPLYETLKQRGEEMIARSGGTDKDISAKAVQDKLDQMVFIWENIHTLVEEREAKLLDVMELAEKFWCDHMSLIVTIKDTQDFIRDLEDPGIDPSVVKQQQEAAETIREEIDGLQEELDIVINLGSELIAACGEPDKPIVKKSIDELNSAWDSLNKAWKDRIDKLEEAMQAAVQYQDGLQAVFDWVDIAGGKLASMSPIGTDLETVKQQIEELKQFKSEAYQQQIEMERLNHQAELLLKKVTEESDKHTVQDPLMELKLIWDSLEERIINRQHKLEGALLALGQFQHALDELLAWLTHTEGLLSEQKPVGGDPKAIEIELAKHHVLQNDVLAHQSTVEAVNKAGNDLIESSAGEEASNLQNKLEVLNQRWQNVLEKTEQRKQQLDGALRQAKGFHGEIEDLQQWLTDTERHLLASKPLGGLPETAKEQLNVHMEVCAAFEAKEETYKSLMQKGQQMLARCPKSAETNIDQD

SEQ ID NO: 4455 - protein, 304 aa, Homo Sapiens
MGNVCGCVRAEKEEQYVDPAKTPLNPEKYSPGRKYFRRKPIKKTGGDKESVGANNENEGKKKSSSQPSKEQPAPLSRGLVQQESVTLNSALGDGIQQKKTEVVADSVKQKLLPSAVSSWSDCVNTSPAKDSETEVKVSELDERISEKDSTPYCAKRKKHLDDVNTSEITFQEKTDVFSFRKAASLSSIPSGIERSLEKSGFPEDPPKSYSSIQEKQNTERFCPHATQHFQFKKKRCHSLYTSMSSVSKDTDGNEISDIHVTGESEDMSAKERLLLWTQQATEGYAGIRCENFTTCWRDGKLFNA

SEQ ID NO: 4456 - protein, 5171 aa, Homo Sapiens
MHSSSYSYRSSDSVFSNTTSTRTSLDSNENLLLVHCGPTLINSCISFGSESFDGHRLEMLQQIANRVQRDSVICEDKLILAGNALQSDSKRLESGVQFQNEAEIAGYILECENLLRQHVIDVQILIDGKYYQADQLVQRVAKLRDEIMALRNECSSVYSKGRILTTEQTKLMISGITQSLNSGFAQTLHPSLTSGLTQSLTPSLTSSSMTSGLSSGMTSRLTPSVTPAYTPGFPSGLVPNFSSGVEPNSLQTLKLMQIRKPLLKSSLLDQNLTEEEINMKFVQDLLNWVDEMQVQLDRTEWGSDLPSVESHLENHKNVHRAIEEFESSLKEAKISEIQMTAPLKLTYAEKLHRLESQYAKLLNTSRNQERHLDTLHNFVSRATNELIWLNEKEEEEVAYDWSERNTNIARKKDYHAELMRELDQKEENIKSVQEIAEQLLLENHPARLTIEAYRAAMQTQWSWILQLCQCVEQHIKENTAYFEFFNDAKEATDYLRNLKDAIQRKYSCDRSSSIHKLEDLVQESMEEKEELLQYKSTIANLMGKAKTIIQLKPRNSDCPLKTSIPIKAICDYRQIEITIYKDDECVLANNSHRAKWKVISPTGNEAMVPSVCFTVPPPNKEAVDLANRIEQQYQNVLTLWHESHINMKSVVSWHYLINEIDRIRASNVASIKTMLPGEHQQVLSNLQSRFEDFLEDSQESQVFSGSDITQLEKEVNVCKQYYQELLKSAEREEQEESVYNLYISEVRNIRLRLENCEDRLIRQIRTPLERDDLHESVFRITEQEKLKKELERLKDDLGTITNKCEEFFSQAAASSSVPTLRSELNVVLQNMNQVYSMSSTYIDKLKTVNLVLKNTQAAEALVKLYETKLCEEEAVIADKNNIENLISTLKQWRSEVDEKRQVFHALEDELQKAKAISDEMFKTYKERDLDFDWHKEKADQLVERWQNVHVQIDNRLRDLEGIGKSLKYYRDTYHPLDDWIQQVETTQRKIQENQPENSKTLATQLNQQKMLVSEIEMKQSKMDECQKYAEQYSATVKDYELQTMTYRAMVDSQQKSPVKRRRMQSSADLIIQEFMDLRTRYTALVTLMTQYIKFAGDSLKRLEEEEKSLEEEKKEHVEKAKELQKWVSNISKTLKDAEKAGKPPFSKQKISSEEISTKKEQLSEALQTIQLFLAKHGDKMTDEERNELEKQVKTLQESYNLLFSESLKQLQESQTSGDVKVEEKIVAERQQEYKEKLQGICDLLTQTENRLIGHQEAFMIGDGTVELKKYQSKQEELQKDMQGSAQALAEVVKNTENFLKENGEKLSQEDKALIEQKLNEAKIKCEQLNLKAEQSKKELDKVVTTAIKEETEKVAAVKQLEESKTKIENLLDWLSNVDKDSERAGTKHKQVIEQNGTHFQEGDGKSAIGEEDEVNGNLLETDVDGQVGTTQENLNQQYQKVKAQHEKIISQHQAVIIATQSAQVLLEKQGQYLSPEEKEKLQKNMKELKVHYETALAESEKKMKLTHSLQEELEKFDADYTEFEHWLQQSEQELENLEAGADDINGLMTKLKRQKSFSEDVISHKGDLRYITISGNRVLEAAKSCSKRDGGKVDTSATHREVQRKLDHATDRFRSLYSKCNVLGNNLKDLVDKYQHYEDASCGLLAGLQACEATASKHLSEPIAVDPKNLQRQLEETKALQGQISSQQVAVEKLKKTAEVLLDARGSLLPAKNDIQKTLDDIVGRYEDLSKSVNERNEKLQITLTRSLSVQDGLDEMLDWMGNVESSLKEQGQVPLNSTALQDIISKNIMLEQDIAGRQSSINAMNEKVKKFMETTDPSTASSLQAKMKDLSARFSEASHKHKETLAKMEELKTKVELFENLSEKLQTFLETKTQALTEVDVPGKDVTELSQYMQESTSEFLEHKKHLEVLHSLLKEISSHGLPSDKALVLEKTNNLSKKFKEMEDTIKEKKEAVTSCQEQLDAFQVLVKSLKSWIKETTKKVPIVQPSFGAEDLGKSLEDTKKLQEKWSLKTPEIQKVNNSGISLCNLISAVTTPAKAIAAVKSGGAVLNGEGTATNTEEFWANKGLTSIKKDMTDISHGYEDLGLLLKDKIAELNTKLSKLQKAQEESSAMMQWLQKMNKTATKWQQTPAPTDTEAVKTQVEQNKSFEAELKQNVNKVQELKDKLTELLEENPDTPEAPRWKQMLTEIDSKWQELNQLTIDRQQKLEESSNNLTQFQTVEAQLKQWLVEKELMVSVLGPLSIDPNMLNTQRQQVQILLQEFATRKPQYEQLTAAGQGILSRPGEDPSLRGIVKEQLAAVTQKWDSLTGQLSDRCDWIDQAIVKSTQYQSLLRSLSDKLSDLDNKLSSSLAVSTHPDAMNQQLETAQKMKQEIQQEKKQIKVAQALCEDLSALVKEEYLKAELSRQLEGILKSFKDVEQKAENHVQHLQSACASSHQFQQMSRDFQAWLDTKKEEQNKSHPISAKLDVLESLIKDHKDFSKTLTAQSHMYEKTIAEGENLLLKTQGSEKAALQLQLNTIKTNWDTFNKQVKERENKLKESLEKALKYKEQVETLWPWIDKCQNNLEEIKFCLDPAEGENSIAKLKSLQKEMDQHFGMVELLNNTANSLLSVCEIDKEVVTDENKSLIQKVDMVTEQLHSKKFCLENMTQKFKEFQEVSKESKRQLQCAKEQLDIHDSLGSQAYSNKYLTMLQTQQKSLQALKHQVDLAKRLAQDLVVEASDSKGTSDVLLQVETIAQEHSTLSQQVDEKCSFLETKLQGIGHFQNTIREMFSQFAEFDDELDSMAPVGRDAETLQKQKETIKAFLKKLEALMASNDNANKTCKMMLATEETSPDLVGIKRDLEALSKQCNKLLDRAQAREEQVEGTIKRLEEFYSKLKEFSILLQKAEEHEESQGPVGMETETINQQLNMFKVFQKEEIEPLQGKQQDVNWLGQGLIQSAAKSTSTQGLEHDLDDVNARWKTLNKKVAQRAAQLQEALLHCGRFQDALESLLSWMVDTEELVANQKPPSAEFKVVKAQIQEQKLLQRLLDDRKSTVEVIKREGEKIATTAEPADKVKILKQLSLLDSRWEALLNKAETRNRQLEGISVVAQQFHETLEPLNEWLTTIEKRLVNCEPIGTQASKLEEQIAQHKALEDDIINHNKHLHQAVSIGQSLKVLSSREDKDMVQSKLDFSQVWYIEIQEKSHSRSELLQQALCNAKIFGEDEVELMNWLNEVHDKLSKLSVQDYSTEGLWKQQSELRVLQEDILLRKQNVDQALLNGLELLKQTTGDEVLIIQDKLEAIKARYKDITKLSTDVAKTLEQALQLARRLHSTHEELCTWLDKVEVELLSYETQVLKGEEASQAQMRPKELKKEAKNNKALLDSLNEVSSALLELVPWRAREGLEKMVAEDNERYRLVSDTITQKVEEIDAAILRSQQFDQAADAELSWITETEKKLMSLGDIRLEQDQTSAQLQVQKTFTMEILRHKDIIDDLVKSGHKIMTACSEEEKQSMKKKLDKVLKNYDTICQINSERYLQLERAQSLVNQFWETYEELWPWLTETQSIISQLPAPALEYETLRQQQEEHRQLRELIAEHKPHIDKMNKTGPQLLELSPGEGFSIQEKYVAADTLYSQIKEDVKKRAVALDEAISQSTQFHDKIDQILESLERIVERLRQPPSISAEVEKIKEQISENKNVSVDMEKLQPLYETLKQRGEEMIARSGGTDKDISAKAVQDKLDQMVFIWENIHTLVEEREAKLLDVMELAEKFWCDHMSLIVTIKDTQDFIRDLEDPGIDPSVVKQQQEAAETIREEIDGLQEELDIVINLGSELIAACGEPDKPIVKKSIDELNSAWDSLNKAWKDRIDKLEEAMQAAVQYQDGLQAVFDWVDIAGGKLASMSPIGTDLETVKQQIEELKQFKSEAYQQQIEMERLNHQAELLLKKVTEESDKHTVQDPLMELKLIWDSLEERIINRQHKLEGALLALGQFQHALDELLAWLTHTEGLLSEQKPVGGDPKAIEIELAKHHVLQNDVLAHQSTVEAVNKAGNDLIESSAGEEASNLQNKLEVLNQRWQNVLEKTEQRKQQLDGALRQAKGFHGEIEDLQQWLTDTERHLLASKPLGGLPETAKEQLNVHMEVCAAFEAKEETYKSLMQKGQQMLARCPKSAETNIDQDINNLKEKWESVETKLNERKTKLEEALNLAMEFHNSLQDFINWLTQAEQTLNVASRPSLILDTVLFQIDEHKVFANEVNSHREQIIELDKTGTHLKYFSQKQDVVLIKNLLISVQSRWEKVVQRLVERGRSLDDARKRAKQFHEAWSKLMEWLEESEKSLDSELEIANDPDKIKTQLAQHKEFQKSLGAKHSVYDTTNRTGRSLKEKTSLADDNLKLDDMLSELRDKWDTICGKSVERQNKLEEALLFSGQFTDALQALIDWLYRVEPQLAEDQPVHGDIDLVMNLIDNHKAFQKELGKRTSSVQALKRSARELIEGSRDDSSWVKVQMQELSTRWETVCALSISKQTRLEAALRQAEEFHSVVHALLEWLAEAEQTLRFHGVLPDDEDALRTLIDQHKEFMKKLEEKRAELNKATTMGDTVLAICHPDSITTIKHWITIIRARFEEVLAWAKQHQQRLASALAGLIAKQELLEALLAWLQWAETTLTDKDKEVIPQEIEEVKALIAEHQTFMEEMTRKQPDVDKVTKTYKRRAADPSSLQSHIPVLDKGRAGRKRFPASSLYPSGSQTQIETKNPRVNLLVSKWQQVWLLALERRRKLNDALDRLEELREFANFDFDIWRKKYMRWMNHKKSRVMDFFRRIDKDQDGKITRQEFIDGILSSKFPTSRLEMSAVADIFDRDGDGYIDYYEFVAALHPNKDAYKPITDADKIEDEVTRQVAKCKCAKRFQVEQIGDNKYRFFLGNQFGDSQQLRLVRILRSTVMVRVGGGWMALDEFLVKNDPCRAKGRTNMELREKFILADGASQGMAAFRPRGRRSRPSSRGASPNRSTSVSSQAAQAASPQVPATTTPKILHPLTRNYGKPWLTNSKMSTPCKAAECSDFPVPSAEGTPIQGSKLRLPGYLSGKGFHSGEDSGLITTAAARVRTQFADSKKTPSRPGSRAGSKAGSRASSRRGSDASDFDISEIQSVCSDVETVPQTHRPTPRAGSRPSTAKPSKIPTPQRKSPASKLDKSSKR

SEQ ID NO: 4457 - protein, 2649 aa, Homo Sapiens
MHSSSYSYRSSDSVFSNTTSTRTSLDSNENLLLVHCGPTLINSCISFGSESFDGHRLEMLQQIANRVQRDSVICEDKLILAGNALQSDSKRLESGVQFQNEAEIAGYILECENLLRQHVIDVQILIDGKYYQADQLVQRVAKLRDEIMALRNECSSVYSKGRILTTEQTKLMISGITQSLNSGFAQTLHPSLTSGLTQSLTPSLTSSSMTSGLSSGMTSRLTPSVTPAYTPGFPSGLVPNFSSGVEPNSLQTLKLMQIRKPLLKSSLLDQNLTEEEINMKFVQDLLNWVDEMQVQLDRTEWGSDLPSVESHLENHKNVHRAIEEFESSLKEAKISEIQMTAPLKLTYAEKLHRLESQYAKLLNTSRNQERHLDTLHNFVSRATNELIWLNEKEEEEVAYDWSERNTNIARKKDYHAELMRELDQKEENIKSVQEIAEQLLLENHPARLTIEAYRAAMQTQWSWILQLCQCVEQHIKENTAYFEFFNDAKEATDYLRNLKDAIQRKYSCDRSSSIHKLEDLVQESMEEKEELLQYKSTIANLMGKAKTIIQLKPRNSDCPLKTSIPIKAICDYRQIEITIYKDDECVLANNSHRAKWKVISPTGNEAMVPSVCFTVPPPNKEAVDLANRIEQQYQNVLTLWHESHINMKSVVSWHYLINEIDRIRASNVASIKTMLPGEHQQVLSNLQSRFEDFLEDSQESQVFSGSDITQLEKEVNVCKQYYQELLKSAEREEQEESVYNLYISEVRNIRLRLENCEDRLIRQIRTPLERDDLHESVFRITEQEKLKKELERLKDDLGTITNKCEEFFSQAAASSSVPTLRSELNVVLQNMNQVYSMSSTYIDKLKTVNLVLKNTQAAEALVKLYETKLCEEEAVIADKNNIENLISTLKQWRSEVDEKRQVFHALEDELQKAKAISDEMFKTYKERDLDFDWHKEKADQLVERWQNVHVQIDNRLRDLEGIGKSLKYYRDTYHPLDDWIQQVETTQRKIQENQPENSKTLATQLNQQKMLVSEIEMKQSKMDECQKYAEQYSATVKDYELQTMTYRAMVDSQQKSPVKRRRMQSSADLIIQEFMDLRTRYTALVTLMTQYIKFAGDSLKRLEEEEIKRCKETSEHGAYSDLLQRQKATVLENSKLTGKISELERMVAELKKQKSRVEEELPKVREAAENELRKQQRNVEDISLQKIRAESEAKQYRRELETIVREKEAAERELERVRQLTIEAEAKRAAVEENLLNFRNQLEENTFTRRTLEDHLKRKDLSLNDLEQQKNKLMEELRRKRDNEEELLKLIKQMEKDLAFQKQVAEKQLKEKQKIELEARRKITEIQYTCRENALPVCPITQATSCRAVTGLQQEHDKQKAEELKQQVDELTAANRKAEQDMRELTYELNALQLEKTSSEEKARLLKDKLDETNNTLRCLKLELERKDQAEKGYSQQLRELGRQLNQTTGKAEEAMQEASDLKKIKRNYQLELESLNHEKGKLQREVDRITRAHAVAEKNIQHLNSQIHSFRDEKELERLQICQRKSDHLKEQFEKSHEQLLQNIKAEKENNDKIQRLNEELEKSNECAEMLKQKVEELTRQNNETKLMMQRIQAESENIVLEKQTIQQRCEALKIQADGFKDQLRSTNEHLHKQTKTEQDFQRKIKCLEEDLAKSQNLVSEFKQKCDQQNIIIQNTKKEVRNLNAELNASKEEKRRGEQKVQLQQAQVQELNNRLKKVQDELHLKTIEEQMTHRKMVLFQEESGKFKQSAEEFRKKMEKLMESKVITENDISGIRLDFVSLQQENSRAQENAKLCETNIKELERQLQQYREQMQQGQHMEANHYQKCQKLEDELIAQKREVENLKQKMDQQIKEHEHQLVLLQCEIQKKSTAKDCTFKPDFEMTVKECQHSGELSSRNTGHLHPTPRSPLLRWTQEPQPLEEKWQHRVVEQIPKEVQFQPPGAPLEKEKSQQCYSEYFSQTSTELQITFDETNPITRLSEIEKIRDQALNNSRPPVRYQDNACEMELVKVLTPLEIAKNKQYDMHTEVTTLKQEKNPVPSAEEWMLEGCRASGGLKKGDFLKKGLEPETFQNFDGDHACSVRDDEFKFQGLRHTVTARQLVEAKLLDMRTIEQLRLGLKTVEEVQKTLNKFLTKATSIAGLYLESTKEKISFASAAERIIIDKMVALAFLEAQAATGFIIDPISGQTYSVEDAVLKGVVDPEFRIRLLEAEKAAVGYSYSSKTLSVFQAMENRMLDRQKGKHILEAQIASGGVIDPVRGIRVPPEIALQQGLLNNAILQFLHEPSSNTRVFPNPNNKQALYYSELLRMCVFDVESQCFLFPFGERNISNLNVKKTHRISVVDTKTGSELTVYEAFQRNLIEKSIYLELSGQQYQWKEAMFFESYGHSSHMLTDTKTGLHFNINEAIEQGTIDKALVKKYQEGLITLTELADSLLSRLVPKKDLHSPVAGYWLTASGERISVLKASRRNLVDRITALRCLEAQVSTGGIIDPLTGKKYRVAEALHRGLVDEGFAQQLRQCELVITGIGHPITNKMMSVVEAVNANIINKEMGIRCLEFQYLTGGLIEPQVHSRLSIEEALQVGIIDVLIATKLKDQKSYVRNIICPQTKRKLTYKEALEKADFDFHTGLKLLEVSEPLMTGISSLYYSS

SEQ ID NO: 4458 - protein, 3060 aa, Homo Sapiens
MHSSSYSYRSSDSVFSNTTSTRTSLDSNENLLLVHCGPTLINSCISFGSESFDGHRLEMLQQIANRVQRDSVICEDKLILAGNALQSDSKRLESGVQFQNEAEIAGYILECENLLRQHVIDVQILIDGKYYQADQLVQRVAKLRDEIMALRNECSSVYSKGRILTTEQTKLMISGITQSLNSGFAQTLHPSLTSGLTQSLTPSLTSSSMTSGLSSGMTSRLTPSVTPAYTPGFPSGLVPNFSSGVEPNSLQTLKLMQIRKPLLKSSLLDQNLTEEEINMKFVQDLLNWVDEMQVQLDRTEWGSDLPSVESHLENHKNVHRAIEEFESSLKEAKISEIQMTAPLKLTYAEKLHRLESQYAKLLNTSRNQERHLDTLHNFVSRATNELIWLNEKEEEEVAYDWSERNTNIARKKDYHAELMRELDQKEENIKSVQEIAEQLLLENHPARLTIEAYRAAMQTQWSWILQLCQCVEQHIKENTAYFEFFNDAKEATDYLRNLKDAIQRKYSCDRSSSIHKLEDLVQESMEEKEELLQYKSTIANLMGKAKTIIQLKPRNSDCPLKTSIPIKAICDYRQIEITIYKDDECVLANNSHRAKWKVISPTGNEAMVPSVCFTVPPPNKEAVDLANRIEQQYQNVLTLWHESHINMKSVVSWHYLINEIDRIRASNVASIKTMLPGEHQQVLSNLQSRFEDFLEDSQESQVFSGSDITQLEKEVNVCKQYYQELLKSAEREEQEESVYNLYISEVRNIRLRLENCEDRLIRQIRTPLERDDLHESVFRITEQEKLKKELERLKDDLGTITNKCEEFFSQAAASSSVPTLRSELNVVLQNMNQVYSMSSTYIDKLKTVNLVLKNTQAAEALVKLYETKLCEEEAVIADKNNIENLISTLKQWRSEVDEKRQVFHALEDELQKAKAISDEMFKTYKERDLDFDWHKEKADQLVERWQNVHVQIDNRLRDLEGIGKSLKYYRDTYHPLDDWIQQVETTQRKIQENQPENSKTLATQLNQQKMLVSEIEMKQSKMDECQKYAEQYSATVKDYELQTMTYRAMVDSQQKSPVKRRRMQSSADLIIQEFMDLRTRYTALVTLMTQYIKFAGDSLKRLEEEEKSLEEEKKEHVEKAKELQKWVSNISKTLKDAEKAGKPPFSKQKISSEEISTKKEQLSEALQTIQLFLAKHGDKMTDEERNELEKQVKTLQESYNLLFSESLKQLQESQTSGDVKVEEKLDKVIAGTIDQTTGEVLSVFQAVLRGLIDYDTGIRLLETQLMISGLISPELRKCFDLKDAKSHGLIDEQILCQLKELSKAKEIISAASPTTIPVLDALAQSMITESMAIKVLEILLSTGSLVIPATGEQLTLQKAFQQNLVSSALFSKVLERQNMCKDLIDPCTSEKVSLIDMVQRSTLQENTGMWLLPVRPQEGGRITLKCGRNISILRAAHEGLIDRETMFRLLSAQLLSGGLINSNSGQRMTVEEAVREGVIDRDTASSILTYQVQTGGIIQSNPAKRLTVDEAVQCDLITSSSALLVLEAQRGYVGLIWPHSGEIFPTSSSLQQELITNELAYKILNGRQKIAALYIPESSQVIGLDAAKQLGIIDNNTASILKNITLPDKMPDLGDLEACKNARRWLSFCKFQPSTVHDYRQEEDVFDGEEPVTTQTSEETKKLFLSYLMINSYMDANTGQRLLLYDGDLDEAVGMLLEGCHAEFDGNTAIKECLDVLSSSGVFLNNASGREKDECTATPSSFNKCHCGEPEHEETPENRKCAIDEEFNEMRNTVINSEFSQSGKLASTISIDPKVNSSPSVCVPSLISYLTQTELADISMLRSDSENILTNYENQSRVETNERANECSHSKNIQNFPSDLIENPIMKSKMSKFCGVNETENEDNTNRDSPIFDYSPRLSALLSHDKLMHSQGSFNDTHTPESNGNKCEAPALSFSDKTMLSGQRIGEKFQDQFLGIAAINISLPGEQYGQKSLNMISSNPQVQYHNDKYISNTSGEDEKTHPGFQQMPEDKEDESEIEEYSCAVTPGGDTDNAIVSLTCATPLLDETISASDYETSLLNDQQNNTGTDTDSDDDFYDTPLFEDDDHDSLLLDGDDRDCLHPEDYDTLQEENDETASPADVFYDVSKENENSMVPQGAPVGSLSVKNKAHCLQDFLMDVEKDELDSGEKIHLNPVGSDKVNGQSLETGSERECTNILEGDESDSLTDYDIVGGKESFTASLKFDDSGSWRGRKEEYVTGQEFHSDTDHLDSMQSEESYGDYIYDSNDQDDDDDDGIDEEGGGIRDENGKPRCQNVAEDMDIQLCASILNENSDENENINTMILLDKMHSCSSLEKQQRVNVVQLASPSENNLVTEKSNLPEYTTEIAGKSKENLLNHEMVLKDVLPPIIKDTESEKTFGPASISHDNNNISSTSELGTDLANTKVKLIQGSELPELTDSVKGKDEYFKNMTPKVDSSLDHIICTEPDLIGKPAEESHLSLIASVTDKDPQGNGSDLIKGRDGKSDILIEDETSIQKMYLGEGEVLVEGLVEEENRHLKLLPGKNTRDSFKLINSQFPFPQITNNEELNQKGSLKKATVTLKDEPNNLQIIVSKSPVQFENLEEIFDTSVSKEISDDITSDITSWEGNTHFEESFTDGPEKELDLFTYLKHCAKNIKAKDVAKPNEDVPSHVLITAPPMKEHLQLGVNNTKEKSTSTQKDSPLNDMIQSNDLCSKESISGGGTEISQFTPESIEATLSILSRKHVEDVGKNDFLQSERCANGLGNDNSSNTLNTDYSFLEINNKKERIEQQLPKEQALSPRSQEKEVQIPELSQVFVEDVKDILKSRLKEGHMNPQEVEEPSACADTKILIQNLIKRITTSQLVNEASTVPSDSQMSDSSGVSPMTNSSELKPESRDDPFCIGNLKSELLLNILKQDQHSQKITGVFELMRELTHMEYDLEKRGITSKVLPLQLENIFYKLLADGYSEKIEHVGDFNQKACSTSEMMEEKPHILGDIKSKEGNYYSPNLETVKEIGLESSTVWASTLPRDEKLKDLCNDFPSHLECTSGSKEMASGDSSTEQ

SEQ ID NO: 4459 - protein, 1143 aa, Homo Sapiens
MHSSSYSYRSSDSVFSNTTSTRTSLDSNENLLLVHCGPTLINSCISFGSESFDGHRLEMLQQIANRVQRDSVICEDKLILAGNALQSDSKRLESGVQFQNEAEIAGYILECENLLRQHVIDVQILIDGKYYQADQLVQRVAKLRDEIMALRNECSSVYSKGRILTTEQTKLMISGITQSLNSGFAQTLHPSLTSGLTQSLTPSLTSSSMTSGLSSGMTSRLTPSVTPAYTPGFPSGLVPNFSSGVEPNSLQTLKLMQIRKPLLKSSLLDQNLTEEEINMKFVQDLLNWVDEMQVQLDRTEWGSDLPSVESHLENHKNVHRAIEEFESSLKEAKISEIQMTAPLKLTYAEKLHRLESQYAKLLNTSRNQERHLDTLHNFVSRATNELIWLNEKEEEEVAYDWSERNTNIARKKDYHAELMRELDQKEENIKSVQEIAEQLLLENHPARLTIEAYRAAMQTQWSWILQLCQCVEQHIKENTAYFEFFNDAKEATDYLRNLKDAIQRKYSCDRSSSIHKLEDLVQESMEEKEELLQYKSTIANLMGKAKTIIQLKPRNSDCPLKTSIPIKAICDYRQIEITIYKDDECVLANNSHRAKWKVISPTGNEAMVPSVCFTVPPPNKEAVDLANRIEQQYQNVLTLWHESHINMKSVVSWHYLINEIDRIRASNVASIKTMLPGEHQQVLSNLQSRFEDFLEDSQESQVFSGSDITQLEKEVNVCKQYYQELLKSAEREEQEESVYNLYISEVRNIRLRLENCEDRLIRQIRTPLERDDLHESVFRITEQEKLKKELERLKDDLGTITNKCEEFFSQAAASSSVPTLRSELNVVLQNMNQVYSMSSTYIDKLKTVNLVLKNTQAAEALVKLYETKLCEEEAVIADKNNIENLISTLKQWRSEVDEKRQVFHALEDELQKAKAISDEMFKTYKERDLDFDWHKEKADQLVERWQNVHVQIDNRLRDLEGIGKSLKYYRDTYHPLDDWIQQVETTQRKIQENQPENSKTLATQLNQQKMLVSEIEMKQSKMDECQKYAEQYSATVKDYELQTMTYRAMVDSQQKSPVKRRRMQSSADLIIQEFMDLRTRYTALVTLMTQYIKFAGDSLKRLEEEEVIINSEHPVNIKELEMSSNYSVVWESKTCFMINLCGR

SEQ ID NO: 4460 - protein, 689 aa, Homo Sapiens
MIAAAFLVLLRPYSIQCALFLLLLLLGTIATIVFFCCWHRKLQKGRHPMKSVFSGRSRSRDAVLRSHHFRSEGFRASPRHLRRRVAAAAAARLEEVKPVVEVHHQSEQETSVRKRRIKKSSRVQPEFYHSVQGASIRRPSSGNASYRCSMSSSADFSDEDDFSQKSGSASPAPGDTLPWNLPKHERSKRKIQGGSVLDPAERAVLRIADERDKVQKKTFTKWINQHLMKVRKHVNDLYEDLRDGHNLISLLEVLSGDTLPREKGRMRFHRLQNVQIALDYLKRRQVKLVNIRNDDITDGNPKLTLGLIWTIILHFQISDIHVTGESEDMSAKERLLLWTQQATEGYAGIRCENFTTCWRDGKLFNAIIHKYRPDLIDMNTVAVQSNLANLEHAFYVAEKIGVIRLLDPEDVDVSSPDEKSVITYVSSLYDAFPKVPEGGEGIGANDVEVKWIEYQNMVNYLIQWIRHHVTTMSERTFPNNPVELKALYNQYLQFKETEIPPKETEKSKIKRLYKLLEIWIEFGRIKLLQGYHPNDIEKEWGKLIIAMLEREKALRPEVERLEMLQQIANRVQRDSVICEDKLILAGNALQSDSKRLESGVQFQNEAEIAGYILECENLLRQHVIDVQILIDGKYYQADQLVQRVAKLRDEIMALRNECSSVYSKGRILTTEQTKLMISGITQSLNSGFA

SEQ ID NO: 4461 - protein, 133 aa, Homo Sapiens
MKVRKHVNDLYEDLRDGHNLISLLEVLSGDTLPREKGRMRFHRLQNVQIALDYLKRRQVKLVNIRNDDITDGNPKLTLGLIWTIILHFQISDIHVTGESEDMSAKERLLLWTQQATEGYAGIRCENFTTCWRD

SEQ ID NO: 4462 - protein, 154 aa, Homo Sapiens
MMGQLMKNDQDWNAKLVGLMCCMDERDKVQKKTFTKWINQHLMKVRKHVNDLYEDLRDGHNLISLLEVLSGDTLPREKGRMRFHRLQNVQIALDYLKRRQVKLVNIRNDDITDGNPKLTLGLIWTIILHFQISDIHVTGESEDMSAKERLLLWT

SEQ ID NO: 4463 - protein, 5537 aa, Homo Sapiens
MSSGNASYRCSMSSSADFSDEDDFSQKSGSASPAPGDTLPWNLPKHERSKRKIQGGSVLDPAERAVLRIADERDKVQKKTFTKWINQHLMKVRKHVNDLYEDLRDGHNLISLLEVLSGDTLPREKGRMRFHRLQNVQIALDYLKRRQVKLVNIRNDDITDGNPKLTLGLIWTIILHFQISDIHVTGESEDMSAKERLLLWTQQATEGYAGIRCENFTTCWRDGKLFNAIIHKYRPDLIDMNTVAVQSNLANLEHAFYVAEKIGVIRLLDPEDVDVSSPDEKSVITYVSSLYDAFPKVPEGGEGIGANDVEVKWIEYQNMVNYLIQWIRHHVTTMSERTFPNNPVELKALYNQYLQFKETEIPPKETEKSKIKRLYKLLEIWIEFGRIKLLQGYHPNDIEKEWGKLIIAMLEREKALRPEVERLEMLQQIANRVQRDSVICEDKLILAGNALQSDSKRLESGVQFQNEAEIAGYILECENLLRQHVIDVQILIDGKYYQADQLVQRVAKLRDEIMALRNECSSVYSKGRILTTEQTKLMISGITQSLNSGFAQTLHPSLTSGLTQSLTPSLTSSSMTSGLSSGMTSRLTPSVTPAYTPGFPSGLVPNFSSGVEPNSLQTLKLMQIRKPLLKSSLLDQNLTEEEINMKFVQDLLNWVDEMQVQLDRTEWGSDLPSVESHLENHKNVHRAIEEFESSLKEAKISEIQMTAPLKLTYAEKLHRLESQYAKLLNTSRNQERHLDTLHNFVSRATNELIWLNEKEEEEVAYDWSERNTNIARKKDYHAELMRELDQKEENIKSVQEIAEQLLLENHPARLTIEAYRAAMQTQWSWILQLCQCVEQHIKENTAYFEFFNDAKEATDYLRNLKDAIQRKYSCDRSSSIHKLEDLVQESMEEKEELLQYKSTIANLMGKAKTIIQLKPRNSDCPLKTSIPIKAICDYRQIEITIYKDDECVLANNSHRAKWKVISPTGNEAMVPSVCFTVPPPNKEAVDLANRIEQQYQNVLTLWHESHINMKSVVSWHYLINEIDRIRASNVASIKTMLPGEHQQVLSNLQSRFEDFLEDSQESQVFSGSDITQLEKEVNVCKQYYQELLKSAEREEQEESVYNLYISEVRNIRLRLENCEDRLIRQIRTPLERDDLHESVFRITEQEKLKKELERLKDDLGTITNKCEEFFSQAAASSSVPTLRSELNVVLQNMNQVYSMSSTYIDKLKTVNLVLKNTQAAEALVKLYETKLCEEEAVIADKNNIENLISTLKQWRSEVDEKRQVFHALEDELQKAKAISDEMFKTYKERDLDFDWHKEKADQLVERWQNVHVQIDNRLRDLEGIGKSLKYYRDTYHPLDDWIQQVETTQRKIQENQPENSKTLATQLNQQKMLVSEIEMKQSKMDECQKYAEQYSATVKDYELQTMTYRAMVDSQQKSPVKRRRMQSSADLIIQEFMDLRTRYTALVTLMTQYIKFAGDSLKRLEEEEKSLEEEKKEHVEKAKELQKWVSNISKTLKDAEKAGKPPFSKQKISSEEISTKKEQLSEALQTIQLFLAKHGDKMTDEERNELEKQVKTLQESYNLLFSESLKQLQESQTSGDVKVEEKIVAERQQEYKEKLQGICDLLTQTENRLIGHQEAFMIGDGTVELKKYQSKQEELQKDMQGSAQALAEVVKNTENFLKENGEKLSQEDKALIEQKLNEAKIKCEQLNLKAEQSKKELDKVVTTAIKEETEKVAAVKQLEESKTKIENLLDWLSNVDKDSERAGTKHKQVIEQNGTHFQEGDGKSAIGEEDEVNGNLLETDVDGQVGTTQENLNQQYQKVKAQHEKIISQHQAVIIATQSAQVLLEKQGQYLSPEEKEKLQKNMKELKVHYETALAESEKKMKLTHSLQEELEKFDADYTEFEHWLQQSEQELENLEAGADDINGLMTKLKRQKSFSEDVISHKGDLRYITISGNRVLEAAKSCSKRDGGKVDTSATHREVQRKLDHATDRFRSLYSKCNVLGNNLKDLVDKYQHYEDASCGLLAGLQACEATASKHLSEPIAVDPKNLQRQLEETKALQGQISSQQVAVEKLKKTAEVLLDARGSLLPAKNDIQKTLDDIVGRYEDLSKSVNERNEKLQITLTRSLSVQDGLDEMLDWMGNVESSLKEQGQVPLNSTALQDIISKNIMLEQDIAGRQSSINAMNEKVKKFMETTDPSTASSLQAKMKDLSARFSEASHKHKETLAKMEELKTKVELFENLSEKLQTFLETKTQALTEVDVPGKDVTELSQYMQESTSEFLEHKKHLEVLHSLLKEISSHGLPSDKALVLEKTNNLSKKFKEMEDTIKEKKEAVTSCQEQLDAFQVLVKSLKSWIKETTKKVPIVQPSFGAEDLGKSLEDTKKLQEKWSLKTPEIQKVNNSGISLCNLISAVTTPAKAIAAVKSGGAVLNGEGTATNTEEFWANKGLTSIKKDMTDISHGYEDLGLLLKDKIAELNTKLSKLQKAQEESSAMMQWLQKMNKTATKWQQTPAPTDTEAVKTQVEQNKSFEAELKQNVNKVQELKDKLTELLEENPDTPEAPRWKQMLTEIDSKWQELNQLTIDRQQKLEESSNNLTQFQTVEAQLKQWLVEKELMVSVLGPLSIDPNMLNTQRQQVQILLQEFATRKPQYEQLTAAGQGILSRPGEDPSLRGIVKEQLAAVTQKWDSLTGQLSDRCDWIDQAIVKSTQYQSLLRSLSDKLSDLDNKLSSSLAVSTHPDAMNQQLETAQKMKQEIQQEKKQIKVAQALCEDLSALVKEEYLKAELSRQLEGILKSFKDVEQKAENHVQHLQSACASSHQFQQMSRDFQAWLDTKKEEQNKSHPISAKLDVLESLIKDHKDFSKTLTAQSHMYEKTIAEGENLLLKTQGSEKAALQLQLNTIKTNWDTFNKQVKERENKLKESLEKALKYKEQVETLWPWIDKCQNNLEEIKFCLDPAEGENSIAKLKSLQKEMDQHFGMVELLNNTANSLLSVCEIDKEVVTDENKSLIQKVDMVTEQLHSKKFCLENMTQKFKEFQEVSKESKRQLQCAKEQLDIHDSLGSQAYSNKYLTMLQTQQKSLQALKHQVDLAKRLAQDLVVEASDSKGTSDVLLQVETIAQEHSTLSQQVDEKCSFLETKLQGIGHFQNTIREMFSQFAEFDDELDSMAPVGRDAETLQKQKETIKAFLKKLEALMASNDNANKTCKMMLATEETSPDLVGIKRDLEALSKQCNKLLDRAQAREEQVEGTIKRLEEFYSKLKEFSILLQKAEEHEESQGPVGMETETINQQLNMFKVFQKEEIEPLQGKQQDVNWLGQGLIQSAAKSTSTQGLEHDLDDVNARWKTLNKKVAQRAAQLQEALLHCGRFQDALESLLSWMVDTEELVANQKPPSAEFKVVKAQIQEQKLLQRLLDDRKSTVEVIKREGEKIATTAEPADKVKILKQLSLLDSRWEALLNKAETRNRQLEGISVVAQQFHETLEPLNEWLTTIEKRLVNCEPIGTQASKLEEQIAQHKALEDDIINHNKHLHQAVSIGQSLKVLSSREDKDMVQSKLDFSQVWYIEIQEKSHSRSELLQQALCNAKIFGEDEVELMNWLNEVHDKLSKLSVQDYSTEGLWKQQSELRVLQEDILLRKQNVDQALLNGLELLKQTTGDEVLIIQDKLEAIKARYKDITKLSTDVAKTLEQALQLARRLHSTHEELCTWLDKVEVELLSYETQVLKGEEASQAQMRPKELKKEAKNNKALLDSLNEVSSALLELVPWRAREGLEKMVAEDNERYRLVSDTITQKVEEIDAAILRSQQFDQAADAELSWITETEKKLMSLGDIRLEQDQTSAQLQVQKTFTMEILRHKDIIDDLVKSGHKIMTACSEEEKQSMKKKLDKVLKNYDTICQINSERYLQLERAQSLVNQFWETYEELWPWLTETQSIISQLPAPALEYETLRQQQEEHRQLRELIAEHKPHIDKMNKTGPQLLELSPGEGFSIQEKYVAADTLYSQIKEDVKKRAVALDEAISQSTQFHDKIDQILESLERIVERLRQPPSISAEVEKIKEQISENKNVSVDMEKLQPLYETLKQRGEEMIARSGGTDKDISAKAVQDKLDQMVFIWENIHTLVEEREAKLLDVMELAEKFWCDHMSLIVTIKDTQDFIRDLEDPGIDPSVVKQQQEAAETIREEIDGLQEELDIVINLGSELIAACGEPDKPIVKKSIDELNSAWDSLNKAWKDRIDKLEEAMQAAVQYQDGLQAVFDWVDIAGGKLASMSPIGTDLETVKQQIEELKQFKSEAYQQQIEMERLNHQAELLLKKVTEESDKHTVQDPLMELKLIWDSLEERIINRQHKLEGALLALGQFQHALDELLAWLTHTEGLLSEQKPVGGDPKAIEIELAKHHVLQNDVLAHQSTVEAVNKAGNDLIESSAGEEASNLQNKLEVLNQRWQNVLEKTEQRKQQLDGALRQAKGFHGEIEDLQQWLTDTERHLLASKPLGGLPETAKEQLNVHMEVCAAFEAKEETYKSLMQKGQQMLARCPKSAETNIDQDINNLKEKWESVETKLNERKTKLEEALNLAMEFHNSLQDFINWLTQAEQTLNVASRPSLILDTVLFQIDEHKVFANEVNSHREQIIELDKTGTHLKYFSQKQDVVLIKNLLISVQSRWEKVVQRLVERGRSLDDARKRAKQFHEAWSKLMEWLEESEKSLDSELEIANDPDKIKTQLAQHKEFQKSLGAKHSVYDTTNRTGRSLKEKTSLADDNLKLDDMLSELRDKWDTICGKSVERQNKLEEALLFSGQFTDALQALIDWLYRVEPQLAEDQPVHGDIDLVMNLIDNHKAFQKELGKRTSSVQALKRSARELIEGSRDDSSWVKVQMQELSTRWETVCALSISKQTRLEAALRQAEEFHSVVHALLEWLAEAEQTLRFHGVLPDDEDALRTLIDQHKEFMKKLEEKRAELNKATTMGDTVLAICHPDSITTIKHWITIIRARFEEVLAWAKQHQQRLASALAGLIAKQELLEALLAWLQWAETTLTDKDKEVIPQEIEEVKALIAEHQTFMEEMTRKQPDVDKVTKTYKRRAADPSSLQSHIPVLDKGRAGRKRFPASSLYPSGSQTQIETKNPRVNLLVSKWQQVWLLALERRRKLNDALDRLEELREFANFDFDIWRKKYMRWMNHKKSRVMDFFRRIDKDQDGKITRQEFIDGILSSKFPTSRLEMSAVADIFDRDGDGYIDYYEFVAALHPNKDAYKPITDADKIEDEVTRQVAKCKCAKRFQVEQIGDNKYRFFLGNQFGDSQQLRLVRILRSTVMVRVGGGWMALDEFLVKNDPCRAKGRTNMELREKFILADGASQGMAAFRPRGRRSRPSSRGASPNRSTSVSSQAAQAASPQVPATTTPKILHPLTRNYGKPWLTNSKMSTPCKAAECSDFPVPSAEGTPIQGSKLRLPGYLSGKGFHSGEDSGLITTAAARVRTQFADSKKTPSRPGSRAGSKAGSRASSRRGSDASDFDISEIQSVCSDVETVPQTHRPTPRAGSRPSTAKPSKIPTPQRKSPASKLDKSSKR

SEQ ID NO: 4464 - protein, 1479 aa, Homo Sapiens
MSSGNASYRCSMSSSADFSDEDDFSQKSGSASPAPGDTLPWNLPKHERSKRKIQGGSVLDPAERAVLRIADERDKVQKKTFTKWINQHLMKVRKHVNDLYEDLRDGHNLISLLEVLSGDTLPREKGRMRFHRLQNVQIALDYLKRRQVKLVNIRNDDITDGNPKLTLGLIWTIILHFQISDIHVTGESEDMSAKERLLLWTQQATEGYAGIRCENFTTCWRDGKLFNAIIHKYRPDLIDMNTVAVQSNLANLEHAFYVAEKIGVIRLLDPEDVDVSSPDEKSVITYVSSLYDAFPKVPEGGEGIGANDVEVKWIEYQNMVNYLIQWIRHHVTTMSERTFPNNPVELKALYNQYLQFKETEIPPKETEKSKIKRLYKLLEIWIEFGRIKLLQGYHPNDIEKEWGKLIIAMLEREKALRPEVERLEMLQQIANRVQRDSVICEDKLILAGNALQSDSKRLESGVQFQNEAEIAGYILECENLLRQHVIDVQILIDGKYYQADQLVQRVAKLRDEIMALRNECSSVYSKGRILTTEQTKLMISGITQSLNSGFAQTLHPSLTSGLTQSLTPSLTSSSMTSGLSSGMTSRLTPSVTPAYTPGFPSGLVPNFSSGVEPNSLQTLKLMQIRKPLLKSSLLDQNLTEEEINMKFVQDLLNWVDEMQVQLDRTEWGSDLPSVESHLENHKNVHRAIEEFESSLKEAKISEIQMTAPLKLTYAEKLHRLESQYAKLLNTSRNQERHLDTLHNFVSRATNELIWLNEKEEEEVAYDWSERNTNIARKKDYHAELMRELDQKEENIKSVQEIAEQLLLENHPARLTIEAYRAAMQTQWSWILQLCQCVEQHIKENTAYFEFFNDAKEATDYLRNLKDAIQRKYSCDRSSSIHKLEDLVQESMEEKEELLQYKSTIANLMGKAKTIIQLKPRNSDCPLKTSIPIKAICDYRQIEITIYKDDECVLANNSHRAKWKVISPTGNEAMVPSVCFTVPPPNKEAVDLANRIEQQYQNVLTLWHESHINMKSVVSWHYLINEIDRIRASNVASIKTMLPGEHQQVLSNLQSRFEDFLEDSQESQVFSGSDITQLEKEVNVCKQYYQELLKSAEREEQEESVYNLYISEVRNIRLRLENCEDRLIRQIRTPLERDDLHESVFRITEQEKLKKELERLKDDLGTITNKCEEFFSQAAASSSVPTLRSELNVVLQNMNQVYSMSSTYIDKLKTVNLVLKNTQAAEALVKLYETKLCEEEAVIADKNNIENLISTLKQWRSEVDEKRQVFHALEDELQKAKAISDEMFKTYKERDLDFDWHKEKADQLVERWQNVHVQIDNRLRDLEGIGKSLKYYRDTYHPLDDWIQQVETTQRKIQENQPENSKTLATQLNQQKMLVSEIEMKQSKMDECQKYAEQYSATVKDYELQTMTYRAMVDSQQKSPVKRRRMQSSADLIIQEFMDLRTRYTALVTLMTQYIKFAGDSLKRLEEEEKSLEEEK

SEQ ID NO: 4465 - protein, 7 aa, Homo Sapiens
MVDTEEL

SEQ ID NO: 4466 - protein, 177 aa, Homo Sapiens
  misc_feature (1)..(1): Xaa can be any naturally occurring amino acid
XQLNQQKMLVSEIEMKQSKMDECQKYAEQYSATVKDYELQTMTYRAMVDSQQKSPVKRRRMQSSADLIIQEFMDLRTRYTALVTLMTQYIKFAGDSLKRLEEEEIAKNKQYDMHTEVTTLKQEKNPVPSAEEWMLEGCRASGGLKKGDFLKKGLEPETFQNFDGDHACSVRDDEFKF

SEQ ID NO: 4467 - protein, 259 aa, Homo Sapiens
  misc_feature (1)..(1): Xaa can be any naturally occurring amino acid
XTRQVAKCKCAKRFQVEQIGDNKYRFGDSQQLRLVRILRSTVMVRVGGGWMALDEFLVKNDPCRAKGRTNMELREKFILADGASQGMAAFRPRGRRSRPSSRGASPNRSTSVSSQAAQAASPQVPATTTPKGTPIQGSKLRLPGYLSGKGFHSGEDSGLITTAAARVRTQFADSKKTPSRPGSRAGSKAGSRASSRRGSDASDFDISEIQSVCSDVETVPQTHRPTPRAGSRPSTAKPSKIPTPQRKSPASKLDKSSKR

SEQ ID NO: 4468 - protein, 448 aa, Homo Sapiens
  misc_feature (1)..(1): Xaa can be any naturally occurring amino acid
XVVTTAIKEETEKVAAVKQLEESKTKIENLLDWLSNVDKDSERAGTKHKQVIEQNGTHFQEGDGKSAIGEEDEVNGNLLETDVDGQVGTTQENLNQQYQKVKAQHEKIISQHQAVIIATQSAQVLLEKQGQYLSPEEKEKLQKNMKELKVHYETALAESEKKMKLTHSLQEELEKFDADYTEFEHWLQQSEQELENLEAGADDINGLMTKLKRQKSFSEDVISHKGDLRYITISGNRVLEAAKSCSKRDGGKVDTSATHREVQRKLDHATDRFRSLYSKCNVLGNNLKDLVDKYQHYEDASCGLLAGLQACEATASKHLSEPIAVDPKNLQRQLEETKALQGQISSQQVAVEKLKKTAEVLLDARGSLLPAKNDIQKTLDDIVGRYEDLSKSVNERNEKLQITLTRSLSVQDGLDEMLDWMGNVESSLKEQDVGTGYCRSSEQYKCHE

SEQ ID NO: 4469 - protein, 43 aa, Homo Sapiens
MGFCLALAWTLLVGAWTPLGAQNPISWEVQRFDGWYNNLMEHR

SEQ ID NO: 4470 - protein, 1551 aa, Homo Sapiens
MGFCLALAWTLLVGAWTPLGAQNPISWEVQRFDGWYNNLMEHRWGSKGSRLQRLVPASYADGVYQPLGEPHLPNPRDLSNTISRGPAGLASLRNRTVLGVFFGYHVLSDLVSVETPGCPAEFLNIRIPPGDPMFDPDQRGDVVLPFQRSRWDPETGRSPSNPRDPANQVTGWLDGSAIYGSSHSWSDALRSFSRGQLASGPDPAFPRDSQNPLLMWAAPDPATGQNGPRGLYAFGAERGNREPFLQALGLLWFRYHNLWAQRLARQHPDWEDEELFQHARKRVIATYQNIAVYEWLPSFLQKTLPEYTGYRPFLDPSISSEFVAASEQFLSTMVPPGVYMRNASCHFQGVINRNSSVSRALRVCNSYWSREHPSLQSAEDVDALLLGMASQIAEREDHVLVEDVRDFWPGPLKFSRTDHLASCLQRGRDLGLPSYTKARAALGLSPITRWQDINPALSRSNDTVLEATAALYNQDLSWLELLPGGLLESHRDPGPLFSTIVLEQFVRLRDGDRYWFENTRNGLFSKKEIEEIRNTTLQDVLVAVINIDPSALQPNVFVWHKGDPCPQPRQLSTEGLPACAPSVVRDYFEGSGFGFGVTIGTLCCFPLVSLLSAWIVARLRMRNFKRLQGQDRQSIVSEKLVGGMEALEWQGHKEPCRPVLVYLQPGQIRVVDGRLTVLRTIQLQPPQKVNFVLSSNRGRRTLLLKIPKEYDLVLLFNLEEERQALVENLRGALKESGLSIQEWELREQELMRAAVTREQRRHLLETFFRHLFSQVLDINQADAGTLPLDSSQKVREALTCELSRAEFAESLGLKPQDMFVESMFSLADKDGNGYLSFREFLDILVVFMKGSPEEKSRLMFRMYDFDGNGLISKDEFIRMLRSFIEISNNCLSKAQLAEVVESMFRESGFQDKEELTWEDFHFMLRDHNSELRFTQLCVKGVEVPEVIKDLCRRASYISQDMICPSPRVSARCSRSDIETELTPQRLQCPMDTDPPQEIRRRFGKKVTSFQPLLFTEAHREKFQRSCLHQTVQQFKRFIENYRRHIGCVAVFYAIAGGLFLERAYYYAFAAHHTGITDTTRVGIILSRGTAASISFMFSYILLTMCRNLITFLRETFLNRYVPFDAAVDFHRLIASTAIVLTVLHSVGHVVNVYLFSISPLSVLSCLFPGLFHDDGSELPQKYYWWFFQTVPGLTGVVLLLILAIMYVFASHHFRRRSFRGFWLTHHLYILLYVLLIIHGSFALIQLPRFHIFFLVPAIIYGGDKLVSLSRKKVEISVVKAELLPSGVTHLRFQRPQGFEYKSGQWVRIACLALGTTEYHPFTLTSAPHEDTLSLHIRAAGPWTTRLREIYSAPTGDRCARYPKLYLDGPFGEGHQEWHKFEVSVLVGGGIGVTPFASILKDLVFKSSVSCQVFCKKIYFIWVTRTQRQFEWLADIIREVEENDHQDLVSVHIYITQLAEKFDLRTTMLYICERHFQKVLNRSLFTGLRSITHFGRPPFEPFFNSLQEVHPQVRKIGVFSCGPPGMTKNVEKACQLINRQDRTHFSHHYENF

SEQ ID NO: 4471 - protein, 1551 aa, Homo Sapiens; identical to SEQ ID NO: 4470

SEQ ID NO: 4472 - protein, 444 aa, Homo Sapiens
MGFCLALAWTLLVGAWTPLGAQNPISWEVQRFDGWYNNLMEHRWGSKGSRLQRLVPASYADGVYQPLGEPHLPNPRDLSNTISRGPAGLASLRNRTVLGVFFGYHVLSDLVSVETPGCPAEFLNIRIPPGDPMFDPDQRGDVVLPFQRSRWDPETGRSPSNPRDPANQVTGWLDGSAIYGSSHSWSDALRSFSRGQLASGPDPAFPRDSQNPLLMWAAPDPATGQNGPRGLYAFGAERGNREPFLQALGLLWFRYHNLWAQRLARQHPDWEDEELFQHARKRVIATYQNIAVYEWLPSFLQKTLPEYTGYRPFLDPSISSEFVAASEQFLSTMVPPGVYMRNASCHFQGVINRNSSVSRALRVCNSYWSREHPSLQSAEDVDALLLGMASQIAEREDHVLVEDVRGTGGHSCPVQPGLILARAAPWGTPGEPPGPWTSVQHHRP

SEQ ID NO: 4473 - protein, 1197 aa, Homo Sapiens
MWMHCCWAWPPRSQSERTMCWLKMCGVSLRLSLQVVNSWPLGRGSAGLPEPDFWPGPLKFSRTDHLASCLQRGRDLGLPSYTKARAALGLSPITRWQDINPALSRSNDTVLEATAALYNQDLSWLELLPGGLLESHRDPGPLFSTIVLEQFVRLRDGDRYWFENTRNGLFSKKEIEEIRNTTLQDVLVAVINIDPSALQPNVFVWHKGDPCPQPRQLSTEGLPACAPSVVRDYFEGSGFGFGVTIGTLCCFPLVSLLSAWIVARLRMRNFKRLQGQDRQSIVSEKLVGGMEALEWQGHKEPCRPVLVYLQPGQIRVVDGRLTVLRTIQLQPPQKVNFVLSSNRGRRTLLLKIPKEYDLVLLFNLEEERQALVENLRGALKESGLSIQEWELREQELMRAAVTREQRRHLLETFFRHLFSQVLDINQADAGTLPLDSSQKVREALTCELSRAEFAESLGLKPQDMFVESMFSLADKDGNGYLSFREFLDILVVFMKGSPEEKSRLMFRMYDFDGNGLISKDEFIRMLRSFIEISNNCLSKAQLAEVVESMFRESGFQDKEELTWEDFHFMLRDHNSELRFTQLCVKGVEVPEVIKDLCRRASYISQDMICPSPRVSARCSRSDIETELTPQRLQCPMDTDPPQEIRRRFGKKVTSFQPLLFTEAHREKFQRSCLHQTVQQFKRFIENYRRHIGCVAVFYAIAGGLFLERAYYYAFAAHHTGITDTTRVGIILSRGTAASISFMFSYILLTMCRNLITFLRETFLNRYVPFDAAVDFHRLIASTAIVLTVLHSVGHVVNVYLFSISPLSVLSCLFPGLFHDDGSELPQKYYWWFFQTVPGLTGVVLLLILAIMYVFASHHFRRRSFRGFWLTHHLYILLYVLLIIHGSFALIQLPRFHIFFLVPAIIYGGDKLVSLSRKKVEISVVKAELLPSGVTHLRFQRPQGFEYKSGQWVRIACLALGTTEYHPFTLTSAPHEDTLSLHIRAAGPWTTRLREIYSAPTGDRCARYPKLYLDGPFGEGHQEWHKFEVSVLVGGGIGVTPFASILKDLVFKSSVSCQVFCKKIYFIWVTRTQRQFEWLADIIREVEENDHQDLVSVHIYITQLAEKFDLRTTMLYICERHFQKVLNRSLFTGLRSITHFGRPPFEPFFNSLQEVHPQVRKIGVFSCGPPGMTKNVEKACQLINRQDRTHFSHHYENF

SEQ ID NO: 4474 - protein, 122 aa, Homo Sapiens
MARSLGVLVALPFPLPVGFNAEEAHNIVKECVDGVLGGEDYNHNNINQWTASIVEQSLTHLVKLGKAYKYIVTCAVVQKSAYGFHTASSCFWDTTSDGTCTVRWENRTMNCIVNVFAIAIVL

SEQ ID NO: 4475 - protein, 152 aa, Homo Sapiens
MEEYHRHCDEVGFNAEEAHNIVKECVDGVLGGEDYNHNNINQWTASIVEQSLTHLVKLGKAYKYIVTCAVVQKSAYGFHTASSCFWDTTSDGTCTVRWENRTMNCGVLLCRPGWSAVMQFRLTATSASQVQVILLPQPPEYLELQAHAITPG

SEQ ID NO: 4476 - protein, 116 aa, Homo Sapiens
MEEYHRHCDEVGFNAEEAHNIVKECVDGVLGGEDYNHNNINQWTASIVEQSLTHLVKLGKAYKYIVTCAVVQKSAYGFHTASSCFWDTTSDGTCTVRWENRTMNCIVNVFAIAIVL

SEQ ID NO: 4477 - protein, 346 aa, Homo Sapiens
MAAAEPASSGQQAPAGQGQGQRPPPQPPQAQAPQPPPPPQLGGAGGGSSRHEKSLGLLTTKFVSLLQEAKDGVLDLKAAADTLAVRQKRRIYDITNVLEGIDLIEKKSKNSIQWKGVGAGCNTKEVIDRLRYLKAEIEDLELKERELDQQKLWLQQSIKNVMDDSINNRFSYVTHEDICNCFNGDTLLAIQAPSGTQLEVPIPEMGQNGQKKYQINLKSHSGPIHVLLINKESSSSKPVVFPVPPPDDLTQPSSQSLTPVTPQKSSMATQNLPEQHVSERSQALQQTSATDISSAGSISGDIIDELMSSDVFPLLRLSPTPADDYNFNLDDNEGVCDLFDVQILNY

SEQ ID NO: 4478 - protein, 345 aa, Homo Sapiens
MAAAEPASSGQQAPAGQGQGQRPPPQPPQAQAPQPPPPPQLGGAGGGSSRHEKSLGLLTTKFVSLLQEAKDGVLDLKAAADTLAVRQKRRIYDITNVLEGIDLIEKKSKNSIQWKGVGAGCNTKEVIDRLRYLKAEIEDLELKERELDQQKLWLQQSIKNVMDDSINNRFSYVTHEDICNCFNGDTLLAIQAPSGTQLEVPIPEMGQNGQKKYQINLKSHSGPIHVLLINKESSSSKPVVFPVPPPDDLTQPSSQSLTPVTPQKSSMATQNLPEQHVSERSQALQQTSATDISSGSISGDIIDELMSSDVFPLLRLSPTPADDYNFNLDDNEGVCDLFDVQILNY

SEQ ID NO: 4479 - protein, 185 aa, Homo Sapiens
MDDSINNRFSYVTHEDICNCFNGDTLLAIQAPSGTQLEVPIPEMGQNGQKKYQINLKSHSGPIHVLLINKESSSSKPVVFPVPPPDDLTQPSSQSLTPVTPQKSSMATQNLPEQHVSERSQALQQTSATDISSAGSISGDIIDELMSSDVFPLLRLSPTPADDYNFNLDDNEGVCDLFDVQILNY

SEQ ID NO: 4480 - protein, 173 aa, Homo Sapiens
MKTSVIALMVSDTLLAIQAPSGTQLEVPIPEMGQNGQKKYQINLKSHSGPIHVLLINKESSSSKPVVFPVPPPDDLTQPSSQSLTPVTPQKSSMATQNLPEQHVSERSQALQQTSATDISSAGSISGDIIDELMSSDVFPLLRLSPTPADDYNFNLDDNEGVCDLFDVQILNY

SEQ ID NO: 4481 - protein, 182 aa, Homo Sapiens
SYDSTFSYVTHEDICNCFNGDTLLAIQAPSGTQLEVPIPEMGQNGQKKYQINLKSHSGPIHVLLINKESSSSKPVVFPVPPPDDLTQPSSQSLTPVTPQKSSMATQNLPEQHVSERSQALQQTSATDISSAGSISGDIIDELMSSDVFPLLRLSPTPADDYNFNLDDNEGVCDLFDVQILNY

SEQ ID NO: 4482 - protein, 249 aa, Homo Sapiens
  misc_feature (1)..(1): Xaa can be any naturally occurring amino acid
XLLQEAKDGVLDLKAAADTLAVRQKRRIYDITNVLEGIDLIEKKSKNSIQWKGVGAGCNTKEVIDRLRYLKAEIEDLELKERELDQQKLWLQQSIKNVMDDSINNRFSYVTHEDICNCFNGDTLLAIQAPSGTQLEVPIPEMGQNGQKKYQINLKSHSGPIHVLLINKESSSSKPVVFPVPPPDDLTQPSSQSLTPVTPQKSSMATQNLPEQHVSERSQALQQTSATDISSAGSISGDIIDELMSSDGK

SEQ ID NO: 4483 - protein, 130 aa, Homo Sapiens
  misc_feature (1)..(1): Xaa can be any naturally occurring amino acid
XNKESSSSKPVVFPVPPPDDLTQPSSQSLTPVTPQKSSMATQNLPEQHVSERSQALQQTSATDISSAGSISGDIIDELMSSDGGKLKDTTGHQKQVGQGLITCLIFLLPLNCLYFCMSFYPNRRSLPLVK

SEQ ID NO: 4484 - protein, 78 aa, Homo Sapiens
MAITQFRLFKFCTCLATVFSFLKRLICRSGRGRKLSGDQITLPTTVDYSSVPKQTDVEEWTSWDEDAPTSVKIEGGNG

SEQ ID NO: 4485 - protein, 197 aa, Homo Sapiens
MAITQFRLFKFCTCLATVFSFLKRLICRSGRGRKLSGDQITLPTTVDYSSVPKQTDVEEWTSWDEDAPTSVKIEGGNGNVATQQNSLEQLEPDYFKDMTPTIRKTQKIVIKKREPLNFGIPDGSTGFSSRLAATQDLPFIHQSSELGDLDTWQENTNAWEEEEDAAWQAEEVLRQQKLADREKRAAEQQRKKMEKEA

SEQ ID NO: 4486 - protein, 213 aa, Homo Sapiens
MAITQFRLFKFCTCLATVFSFLKRLICRSGRGRKLSGDQITLPTTVDYSSVPKQTDVEEWTSWDEDAPTSVKIEGGNGNVATQQNSLEQLEPDYFKDMTPTIRKTQKIVIKKREPLNFGIPDGSTGFSSRLAATQDLPFIHQSSELGDLDTWQENTNAWEEEEDAAWQAEEVLRQQKLADREKRAAEQQRKKMEKEAQRLMKKEQNKIGVKLS

SEQ ID NO: 4487 - protein, 213 aa, Homo Sapiens; identical to SEQ ID NO: 4486

SEQ ID NO: 4488 - protein, 213 aa, Homo Sapiens; identical to SEQ ID NO: 4486

SEQ ID NO: 4489 - protein, 258 aa, Homo Sapiens
MAITQFRLFKFCTCLATVFSFLKRLICRSGRGRKLSGDQITLPTTVDYSSVPKQTDVEEWTSWDEDAPTSVKIEGGNGNVATQQNSLEQLEPDYFKDMTPTIRKTQKIVIKKREPLNFGIPDGSTGFSSRLAATQDLPFIHQSSELGDLDTWQENTNAWEEEEDAAWQAEEVLRSRTNVCLLCSLLFHHPTPTSTPYINQSVKIERVSLGQWSYGKSKEQQKLADREKRAAEQQRKKMEKEAQRLMKKEQNKIGVKLS

SEQ ID NO: 4490 - protein, 258 aa, Homo Sapiens; identical to SEQ ID NO: 4489

SEQ ID NO: 4491 - protein, 153 aa, Homo Sapiens
MAITQFRLFKFCTCLATVFSFLKRLICRSGRGRKLSGDQITLPTTVDYSSVPKQTDVEEWTSWDEDAPTSVKIEGGNGNVATQQNSLEQLEPDYFKDMTPTIRKTQKIVIKKREPLNFGIPDGSTGFSSRLAATQDLPFIHQSTSHWVGATII

SEQ ID NO: 4492 - protein, 41 aa, Homo Sapiens
MTPTIRKTQKIVIKKREPLNFGIPDGSTGFSSRLAATQDLP

SEQ ID NO: 4493 - protein, 229 aa, Homo Sapiens
MTPQLLLALVLWASCPPCSGRKGPPAALTLPRVQCRASRYPIAVDCSWTLPPAPNSTSPVSFIATYRLGMAARGHSWPCLQQTPTSTSCTITDVQLFSMAPYVLNVTAVHPWGSSSSFVPFITEHIIKPDPPEGVRLSPLAERQLQVQWEPPGSWPFPEIFSLKYWIRYKRQGAARFHRVGPIEATSFILRAVRPRARYYVQVAAQDLTDYGELSDWSLPATATMSLGK

SEQ ID NO: 4494 - protein, 83 aa, Homo Sapiens
MAKSLLKTASLSGRTKLLHQTGLSLYSTSHGFYEEEVKKTLQQFPGGSIDLQKEDNGIGILTLNNPSRMNAFSEFREISLYQC

SEQ ID NO: 4495 - protein, 125 aa, Homo Sapiens
MAKSLLKTASLSGRTKLLHQTGLSLYSTSHGFYEEEVKKTLQQFPGGSIDLQKEDNGIGILTLNNPSRMNAFSGVMMLQLLEKVIELENWTEGKGLIVRGAKNTFSSGSDLNAVKSLGTPEANFL

SEQ ID NO: 4496 - protein, 135 aa, Homo Sapiens
MAKSLLKTASLSGRTKLLHQTGLSLYSTSHGFYEEEVKKTLQQFPGGSIDLQKEDNGIGILTLNNPSRMNAFSGVMMLQLLEKVIELENWTEGKGLIVRGAKNTFSSGSDLNAVKSLGTPEDGMAVCMFMQNTLT

SEQ ID NO: 4497 - protein, 139 aa, Homo Sapiens
MAKSLLKTASLSGRTKLLHQTGLSLYSTSHGFYEEEVKKTLQQFPGGSIDLQKEDNGIGILTLNNPSRMNAFSGVMMLQLLEKVIELENWTEGKGLIVRGAKNTFSSGSDLNAVKSLGTPEDGMAVCMFMQNTLTRFMR

SEQ ID NO: 4498 - protein, 151 aa, Homo Sapiens
MAKSLLKTASLSGRTKLLHQTGLSLYSTSHGFYEEEVKKTLQQFPGGSIDLQKEDNGIGILTLNNPSRMNAFSGVMMLQLLEKVIELENWTEGKGLIVRGAKNTFSSGSDLNAVKSLGTPEDGMAVCMFMQNTLTRFMRLPLISVALVQGW

SEQ ID NO: 4499 - protein, 301 aa, Homo Sapiens
MAKSLLKTASLSGRTKLLHQTGLSLYSTSHGFYEEEVKKTLQQFPGGSIDLQKEDNGIGILTLNNPSRMNAFSGVMMLQLLEKVIELENWTEGKGLIVRGAKNTFSSGSDLNAVKSLGTPEDGMAVCMFMQNTLTRFMRLPLISVALVQGWALGGGAEFTTACDFRLMTPESKIRFVHKEMGIIPSWGGTTRLVEIIGSRQALKVLSGALKLDSKNALNIGMVEEVLQSSDETKSLEEAQEWLKQFIQGPPEVIRALKKSVCSGRELYLEEALQNERDLLGTVWGGPANLEAIAKKGKFNK

SEQ ID NO: 4500 - protein, 301 aa, Homo Sapiens; identical to SEQ ID NO: 4499

SEQ ID NO: 4501 - protein, 301 aa, Homo Sapiens; identical to SEQ ID NO: 4499

SEQ ID NO: 4502 - protein, 179 aa, Homo Sapiens
MAKSLLKTASLSGRTKLLHQTGLSLYSTSHGFYEEEVKKTLQQFPGGSIDLQKEDNGIGILTLNNPSRMNAFSGVMMLQLLEKVIELENWTEGKGLIVRGAKNTFSSGSDLNAVKSLGTPEESCRWNTEFLYTLHPVSPFINILYSYGWNGRMHVHAKHLNKIYETSFNKCCAGSRLGI

SEQ ID NO: 4503 - protein, 125 aa, Homo Sapiens
MAKSLLKTASLSGRTKLLHQTGLSLYSTSHGFYEEEVKKTLQQFPGGSIDLQKEDNGIGILTLNNPSRMNAFSGVMMLQLLEKVIELENWTEGKGLIVRGAKNTFSSGSDLNAVKSLGTPEGDFL

SEQ ID NO: 4504 - protein, 145 aa, Homo Sapiens
MAKSLLKTASLSGRTKLLHQTGLSLYSTSHGFYEEEVKKTLQQFPGGSIDLQKEDNGIGILTLNNPSRMNAFSGVMMLQLLEKVIELENWTEGKGLIVRGAKNTFSSGSDLNAVKSLGTPETSFNKCCAGSRLGIGWRSRIYYSM

SEQ ID NO: 4505 - protein, 145 aa, Homo Sapiens; identical to SEQ ID NO: 4504

SEQ ID NO: 4506 - protein, 307 aa, Homo Sapiens
MALKQEMAKSLLKTASLSGRTKLLHQTGLSLYSTSHGFYEEEVKKTLQQFPGGSIDLQKEDNGIGILTLNNPSRMNAFSGVMMLQLLEKVIELENWTEGKGLIVRGAKNTFSSGSDLNAVKSLGTPEDGMAVCMFMQNTLTRFMRLPLISVALVQGWALGGGAEFTTACDFRLMTPESKIRFVHKEMGIIPSWGGTTRLVEIIGSRQALKVLSGALKLDSKNALNIGMVEEVLQSSDETKSLEEAQEWLKQFIQGPPEVIRALKKSVCSGRELYLEEALQNERDLLGTVWGGPANLEAIAKKGKFNK

SEQ ID NO: 4507 - protein, 226 aa, Homo Sapiens
MMLQLLEKVIELENWTEGKGLIVRGAKNTFSSGSDLNAVKSLGTPEDGMAVCMFMQNTLTRFMRLPLISVALVQGWALGGGAEFTTACDFRLMTPESKIRFVHKEMGIIPSWGGTTRLVEIIGSRQALKVLSGALKLDSKNALNIGMVEEVLQSSDETKSLEEAQEWLKQFIQGPPEVIRALKKSVCSGRELYLEEALQNERDLLGTVWGGPANLEAIAKKGKFNK

SEQ ID NO: 4508 - protein, 70 aa, Homo Sapiens
MMLQLLEKVIELENWTEGKGLIVRGAKNTFSSGSDLNAVKSLGTPETSFNKCCAGSRLGIGWRSRIYYSM

SEQ ID NO: 4509 - protein, 34 aa, Homo Sapiens
  misc_feature (1)..(1): Xaa can be any naturally occurring amino acid
XFMRLPLISVALVQGWALGGGAEFTTACDFSFRH

SEQ ID NO: 4510 - protein, 76 aa, Homo Sapiens
  misc_feature (1)..(1): Xaa can be any naturally occurring amino acid
XMLQLLEKVIELENWTEGKGLIVRGAKNTFSSGSDLNAVKSLGTPEDGMAVCMFMQNTLTRFMSRMCGEVVCIQRR

SEQ ID NO: 4511 - protein, 100 aa, Homo Sapiens
  misc_feature (1)..(1): Xaa can be any naturally occurring amino acid
XTPEVKKQRGKILLGLSRLPLISVALVQGWALGGGAEFTTACDFRLMTPESKIRFVHKEMGIIPSWGGTTRLVEIIGSRQALKVLSGALKLDSKNALNIG

SEQ ID NO: 4512 - protein, 255 aa, Homo Sapiens
  misc_feature (1)..(1): Xaa can be any naturally occurring amino acid
XTSHGFYEEEVKKTLQQFPGGSIDLQKEDNGIGILTLNNPSRMNAFSGVMMLQLLEKVIELENWTEGKGLIVRGAKNTFSSGSDLNAVKSLGTPEESCRWNTEFLYTLHPVSPFINILYSYGWNGRMHVHAKHLNKIYEVKKQRGKILLGLSRLPLISVALVQGWALGGGAEFTTACDFRLMTPESKIRFVHKEMGIIPSWGGTTRLVEIIGSRQALKVLSGALKLDSKNALNIGMVEEVLQSSDETKSLEEAQE

SEQ ID NO: 4513 - protein, 567 aa, Homo Sapiens
MGTTARAALVLTYLAVASAASEGGFTATGQRQLRPEHFQEVGYAAPPSPPLSRSLPMDHPDSSQHGPPFEGQSGKEGRGPRPHSQPWLGERVGCSHIPPSIVQPPPSQEATPLQQEKLLPAQLPAEKEVGPPLPQEAVPLQKELPSLQHPNEQKEGTPAPFGDQSHPEPESWNAAQHCQQDRSQGGWGHRLDGFPPGRPSPDNLNQICLPNRQHVVYGPWNLPQSSYSHLTRQGETLNFLEIGYSRCCHCRSHTNRLECAKLVWEEAMSRFCEAEFSVKTRPHWCCTRQGEARFSCFQEEAPQPHYQLRACPSHQPDISSGLELPFPPGVPTLDNIKNICHLRRFRSVPRNLPATDPLQRELLALIQLEREFQRCCRQGNNHTCTWKAWEDTLDKYCDREYAVKTHHHLCCRHPPSPTRDECFARRAPYPNYDRDILTIDIGRVTPNLMGHLCGNQRVLTKHKHIPGLIHNMTARCCDLPFPEQACCAEEEKLTFINDLCGPRRNIWRDPALCCYLSPGDEQVNCFNINYLRNVALVSGDTENAKGQGEQGSTGGTNISSTSEPKEE

SEQ ID NO: 4514 - protein, 415 aa, Homo Sapiens
MGTTARAALVLTYLAVASAASEGGFTATGQRQLRPEHFQEVGYAAPPSPPLSRSLPMDHPDSSQHGPPFEGQSQVQPPPSQEATPLQQEKLLPAQLPAEKEVGPPLPQEAVPLQKELPSLQHPNEQKEGTPAPFGDQSHPEPESWNAAQHCQQDRSQGGWGHRLDGFPPGRPSPDNLNQICLPNRQHVVYGPWNLPQSSYSHLTRQGETLNFLEIGYSRCCHCRSHTNRLECAKLVWEDTLDKYCDREYAVKTHHHLCCRHPPSPTRDECFARRAPYPNYDRDILTIDIGRVTPNLMGHLCGNQRVLTKHKHIPGLIHNMTARCCDLPFPEQACCAEEEKLTFINDLCGPRRNIWRDPALCCYLSPGDEQVNCFNINYLRNVALVSGDTENAKGQGEQGSTGGTNISSTSEPKEE

SEQ ID NO: 4515 - protein, 540 aa, Homo Sapiens
MGTTARAALVLTYLAVASAASEGGFTATGQRQLRPEHFQEVGYAAPPSPPLSRSLPMDHPDSSQHGPPFEGQSQVQPPPSQEATPLQQEKLLPAQLPAEKEVGPPLPQEAVPLQKELPSLQHPNEQKEGTPAPFGDQSHPEPESWNAAQHCQQDRSQGGWGHRLDGFPPGRPSPDNLNQICLPNRQHVVYGPWNLPQSSYSHLTRQGETLNFLEIGYSRCCHCRSHTNRLECAKLVWEEAMSRFCEAEFSVKTRPHWCCTRQGEARFSCFQEEAPQPHYQLRACPSHQPDISSGLELPFPPGVPTLDNIKNICHLRRFRSVPRNLPATDPLQRELLALIQLEREFQRCCRQGNNHTCTWKAWEDTLDKYCDREYAVKTHHHLCCRHPPSPTRDECFARRAPYPNYDRDILTIDIGRVTPNLMGHLCGNQRVLTKHKHIPGLIHNMTARCCDLPFPEQACCAEEEKLTFINDLCGPRRNIWRDPALCCYLSPGDEQVNCFNINYLRNVALVSGDTENAKGQGEQGSTGGTNISSTSEPKEE

SEQ ID NO: 4516 - protein, 160 aa, Homo Sapiens
MKIAVLFCFFLLIIFQTDFGKNEEIPRKQRRKIYHRRLRKSSTSHKHRSNRQLGIQQTTVFTPVARLPIVNFDYSMEEKFESFSSFPGVESSYNVLPGKKGHCLVKGITMYNKAVWSPEPCTTCLCSDGRVLCDETMCHPQRCPQTVIPEGECCPVCSAT

SEQ ID NO: 4517 - protein, 643 aa, Homo Sapiens
MKIAVLFCFFLLIIFQTDFGKNEEIPRKQRRKIYHRRLRKSSTSHKHRSNRQLGIQQTTVFTPVARLPIVNFDYSMEEKFESFSSFPGVESSYNVLPGKKGHCLVKGITMYNKAVWSPEPCTTCLCSDGRVLCDETMCHPQRCPQTVIPEGECCPVCSATEQREPTNLLHKQLPPPQVGMDRIVRKEALQSEEDEEVKEEDTEQKRETPESRNQGQLYSEGDSRGGDRKQRPGEERRLAHQQQRQGREEEEDEEEEGEEGEEDEEDEEDPVRGDMFRMPSRSPLPAPPRGTLRLPSGCSLSYRTISCINAMLTQIPPLTAPQITSLELTGNSIASIPDEAFNGLPNLERLDLSKNNITSSGIGPKAFKLLKKLMRLNMDGNNLIQIPSQLPSTLEELKVNENNLQAIDEESLSDLNQLVTLELEGNNLSEANVNPLAFKPLKSLAYLRLGKNKFRIIPQGLPGSIEELYLENNQIEEITEICFNHTRKINVIVLRYNKIEENRIAPLAWINQENLESIDLSYNKLYHVPSYLPKSLLHLVLLGNQIERIPGYVFGHMEPGLEYLYLSFNKLADDGMDRVSFYGAYHSLRELFLDHNDLKSIPPGIQEMKALHFLRLNNNKIRCVSDAVLETVTNRSDVAFPLW

SEQ ID NO: 4518 - protein, 164 aa, Homo Sapiens
MKIAVLFCFFLLIIFQTDFGKNEEIPRKQRRKIYHRRLRKSSTSHKHRSNRQLGIQQTTVFTPVARLPIVNFDYSMEEKFESFSSFPGVESSYNVLPGKKGHCLVKGITMYNKAVWSPEPCTTCLCSDGRVLCDETMCHPQRCPQTVIPEGECCPVCSATGTEI

SEQ ID NO: 4519 - protein, 699 aa, Homo Sapiens
MKIAVLFCFFLLIIFQTDFGKNEEIPRKQRRKIYHRRLRKSSTSHKHRSNRQLGIQQTTVFTPVARLPIVNFDYSMEEKFESFSSFPGVESSYNVLPGKKGHCLVKGITMYNKAVWSPEPCTTCLCSDGRVLCDETMCHPQRCPQTVIPEGECCPVCSATVSYSLLSGIALNDRNEFSGDSSEQREPTNLLHKQLPPPQVGMDRIVRKEALQSEEDEEVKEEDTEQKRETPESRNQGQLYSEGDSRGGDRKQRPGEERRLAHQQQRQGREEEEDEEEEGEEGEEDEEDEEDPVRGDMFRMPSRSPLPAPPRGTLRLPSGCSLSYRTISCINAMLTQIPPLTAPQITSLELTGNSIASIPDEAFNGLPNLERLDLSKNNITSSGIGPKAFKLLKKLMRLNMDGNNLIQIPSQLPSTLEELKVNENNLQAIDEESLSDLNQLVTLELEGNNLSEANVNPLAFKPLKSLAYLRLGKNKFRIIPQGLPGSIEELYLENNQIEEITEICFNHTRKINVIVLRYNKIEENRIAPLAWINQENLESIDLSYNKLYHVPSYLPKSLLHLVLLGNQIERIPGYVFGHMEPGLEYLYLSFNKLADDGMDRVSFYGAYHSLRELFLDHNDLKSIPPGIQEMKALHFLRLNNNKIRNILPEEICNAEEDDDSNLEHLHLENNYIKIREIPSYTFSCIRSYSSIVLKPQNIK

SEQ ID NO: 4520 - protein, 102 aa, Homo Sapiens
MREYGVERDLAVYNQLLNIFPKEVFRPRNIIQRIFVHYPRQQECGIAVLEQMENHGVMPNKETEFLLIQIFGRKSYPMLKLVRLKLWFPRFMNVNPFPVPRD

SEQ ID NO: 4521 - protein, 223 aa, Homo Sapiens
MREYGVERDLAVYNQLLNIFPKEVFRPRNIIQRIFVHYPRQQECGIAVLEQMENHGVMPNKETEFLLIQIFGRKSYPMLKLVRLKLWFPRFMNVNPFPVPRDLPQDPVELAMFGLRHMEPDLSARVTIYQVPLPKDSTGAADPPQPHIVGIQSPDQQAALARHNPARPVFVEGPFSLWLRNKCVYYHILRADLLPPEEREVEETPEEWNLYYPMQLDLEYVRS

SEQ ID NO: 4522 - protein, 267 aa, Homo Sapiens
MREYGVERDLAVYNQLLNIFPKEVFRPRNIIQRIFVHYPRQQECGIAVLEQMENHGVMPNKETEFLLIQIFGRKSYPMLKLVRLKLWFPRFMNVNPFPVPRDLPQDPVELAMFGLRHMEPDLSARVTIYQVPLPKDSTGAADPPQPHIVGKSESMGAAKSLTLPRPCQVLAGPRLGSLGLWAESLAGHRACMSPHQESRVPISRPPWPATIQPGLSLLRAPSPCGSATSVCITTSSELTCCPRRRGKWKRRRRSGTSTTRCSWTWSM

SEQ ID NO: 4523 - protein, 25 aa, Homo Sapiens
MSWVQATLLARGLCRAWGGTCGAAL

SEQ ID NO: 4524 - protein, 217 aa, Homo Sapiens
MSWVQATLLARGLCRAWGGTCGAALTGTSISQVPLPKDSTGAADPPQPHIVGIQSPDQQAALARHNPARPVFVEGPFSLWLRNKCVYYHILRADLLPPEEREVEETPEEWNLYYPMQLDLEYVRSGWDNYEFDINEVEEGPVFAMCMAGAHDQATMAKWIQGLQETNPTLAQIPVVFRLAGSTRELQTSSAGLEEPPLPEDHQEEDDNLQRQQQGQS

SEQ ID NO: 4525 - protein, 82 aa, Homo Sapiens
MSWVQATLLARGLCRAWGGTCGAALTGTSISQVPLPKDSTGAADPPQPHIVGSGRDAGGVEPLLPDAAGPGVCEEWLGQLRV

SEQ ID NO: 4526 - protein, 227 aa, Homo Sapiens
MSWVQATLLARGLCRAWGGTCGAALTGTSISQVPRRLPRGLHCSAAAHSSEQSLVPSPPEPRQRPTKALVPFEDLFGQAPGGERDKASFLQTVQKFAEHSVRKRGHIDFIYLALRKMREYGVERDLAVYNQLLNIFPKEVFRPRNIIQRIFVHYPRQQECGIAVLEQMENHGVMPNKETEFLLIQIFGRKSYPMLKLVRLKLWFPRFMNVNPFPVPRDLPQDPVELA

SEQ ID NO: 4527 - protein, 296 aa, Homo Sapiens
MSWVQATLLARGLCRAWGGTCGAALTGTSISQVPRRLPRGLHCSAAAHSSEQSLVPSPPEPRQRPTKALVPFEDLFGQAPGGERDKASFLQTVQKFAEHSVRKRGHIDFIYLALRKMREYGVERDLAVYNQLLNIFPKEVFRPRNIIQRIFVHYPRQQECGIAVLEQMENHGVMPNKETEFLLIQIFGRKSYPMLKLVRLKLWFPRFMNVNPFPVPRDLPQDPVELAMFGLRHMEPDLSARVTIYQVPLPKDSTGAADPPQPHIVGSGRDAGGVEPLLPDAAGPGVCEEWLGQLRV

SEQ ID NO: 4528 - protein, 431 aa, Homo Sapiens
MSWVQATLLARGLCRAWGGTCGAALTGTSISQVPRRLPRGLHCSAAAHSSEQSLVPSPPEPRQRPTKALVPFEDLFGQAPGGERDKASFLQTVQKFAEHSVRKRGHIDFIYLALRKMREYGVERDLAVYNQLLNIFPKEVFRPRNIIQRIFVHYPRQQECGIAVLEQMENHGVMPNKETEFLLIQIFGRKSYPMLKLVRLKLWFPRFMNVNPFPVPRDLPQDPVELAMFGLRHMEPDLSARVTIYQVPLPKDSTGAADPPQPHIVGIQSPDQQAALARHNPARPVFVEGPFSLWLRNKCVYYHILRADLLPPEEREVEETPEEWNLYYPMQLDLEYVRSGWDNYEFDINEVEEGPVFAMCMAGAHDQATMAKWIQGLQETNPTLAQIPVVFRLAGSTRELQTSSAGLEEPPLPEDHQEEDDNLQRQQQGQS

SEQ ID NO: 4529 - protein, 296 aa, Homo Sapiens
MSWVQATLLARGLCRAWGGTCGAALTGTSISQVPRRLPRGLHCSAAAHSSEQSLVPSPPEPRQRPTKALVPFEDLFGQAPGGERDKASFLQTVQKFAEHSVRKRGHIDFIYLALRKMREYGVERDLAVYNQLLNIFPKEVFRPRNIIQRIFVHYPRQQECGIAVLEQMENHGVMPNKETEFLLIQIFGRKSYPMLKLVRLKLWFPRFMNVNPFPVPRDLPQDPVELAMFGLRHMEPDLSARVTIYQVPLPKDSTGAADPPQPHIVELTCCPRRRGKWKRRRRSGTSTTRCSWTWSM

SEQ ID NO: 4530 - protein, 59 aa, Homo Sapiens
  misc_feature (1)..(1): Xaa can be any naturally occurring amino acid
XMREYGVERDLAVYNQLLNIFPKEVFRPRNIIQRIFVHYPRQQECGIAVLEQMENHAQV

SEQ ID NO: 4531 - protein, 71 aa, Homo Sapiens
  misc_feature (1)..(1): Xaa can be any naturally occurring amino acid
XVNPFPVPRDLPQDPVELAMFGLRHMEPDLSARVTIYQAPCAAPDAARLPPQRFLCPKTQQVQQIPPSPTS

SEQ ID NO: 4532 - protein, 147 aa, Homo Sapiens
MTSSLKIWGILLALLCILCRLCVYSNNIYWREFIKLHYLSPSREFKEYKCDVLMREKEALKGKSFHMFIYSLWFKIQRACINEKGSDRYRNAYVWAPGALKVLECHWEKYNNRYTESRSFSYIEFHCGVDGYVDNIEDLRIIEPISN

SEQ ID NO: 4533 - protein, 147 aa, Homo Sapiens
MASSLKIWGTLLALLCILCTLLVQSKEVSWREFMKQHYLSPSREFREYKCDVLMRENEALKDKSSHMFIYISWYKIEHICTSDNWMDRFRNAYVWVQNPLKVLKCHQENSKNSYTESRSFNYIEFHCSMDGYVDSIEDLKMVEPIGN

SEQ ID NO: 4534 - protein, 578 aa, Homo Sapiens
MPFRLLIPLGLLCALLPQHHGAPGPDGSAPDPAHYRERVKAMFYHAYDSYLENAFPFDELRPLTCDGHDTWGSFSLTLIDALDTLLILGNVSEFQRVVEVLQDSVDFDIDVNASVFETNIRVVGGLLSAHLLSKKAGVEVEAGWPCSGPLLRMAEEAARKLLPAFQTPTGMPYGTVNLLHGVNPGETPVTCTAGIGTFIVEFATLSSLTGDPVFEDVARVALMRLWESRSDIGLVGNHIDVLTGKWVAQDAGIGAGVDSYFEYLVKGAILLQDKKLMAMFLEYNKAIRNYTRFDDWYLWVQMYKGTVSMPVFQSLEAYWPGLQSLIGDIDNAMRTFLNYYTVWKQFGGLPEFYNIPQGYTVEKREGYPLRPELIESAMYLYRATGDPTLLELGRDAVESIEKISKVECGFATIKDLRDHKLDNRMESFFLAETVKYLYLLFDPTNFIHNNGSTFDAVITPYGECILGAGGYIFNTEAHPIDPAALHCCQRLKEEQWEVEDLMREFYSLKRSRSKFQKNTVSSGPWEPPARPGTLFSPENHDQARERKPAKQKVPLLSCPSQPFTSKLALLGQVFLDSS

SEQ ID NO: 4535 - protein, 541 aa, Homo Sapiens
MPFRLLIPLGLLCALLPQHHGAPGPDGSAPDPAHYSFSLTLIDALDTLLILGNVSEFQRVVEVLQDSVDFDIDVNASVFETNIRVVGGLLSAHLLSKKAGVEVEAGWPCSGPLLRMAEEAARKLLPAFQTPTGMPYGTVNLLHGVNPGETPVTCTAGIGTFIVEFATLSSLTGDPVFEDVARVALMRLWESRSDIGLVGNHIDVLTGKWVAQDAGIGAGVDSYFEYLVKGAILLQDKKLMAMFLEYNKAIRNYTRFDDWYLWVQMYKGTVSMPVFQSLEAYWPGLQSLIGDIDNAMRTFLNYYTVWKQFGGLPEFYNIPQGYTVEKREGYPLRPELIESAMYLYRATGDPTLLELGRDAVESIEKISKVECGFATIKDLRDHKLDNRMESFFLAETVKYLYLLFDPTNFIHNNGSTFDAVITPYGECILGAGGYIFNTEAHPIDPAALHCCQRLKEEQWEVEDLMREFYSLKRSRSKFQKNTVSSGPWEPPARPGTLFSPENHDQARERKPAKQKVPLLSCPSQPFTSKLALLGQVFLDSS

SEQ ID NO: 4536 - protein, 932 aa, Homo Sapiens
MSEAGGRGCGSPVPQRARWRLVAATAAFCLVSATSVWTAGAEPMSREEKQKLGNQVLEMFDHAYGNYMEHAYPADELMPLTCRGRVRGQEPSRGDVDDALGKFSLTLIDSLDTLVVLNKTKEFEDAVRKVLRDVNLDNDVVVSVFETNIRVLGGLLGGHSLAIMLKEKGEYMQWYNDELLQMAKQLGYKLLPAFNTTSGLPYPRINLKFGIRKPEARTGTETDTCTACAGTLILEFAALSRFTGATIFEEYARKALDFLWEKRQRSSNLVGVTINIHTGDWVRKDSGVGAGIDSYYEYLLKAYVLLGDDSFLERFNTHYDAIMRYISQPPLLLDVHIHKPMLNARTWMDALLAFFPGLQVLKGDIRPAIETHEMLYQVIKKHNFLPEAFTTDFRVHWAQHPLRPEFAESTYFLYKATGDPYYLEVGKTLIENLNKYARVPCGFAAMKDVRTGSHEDRMDSFFLAEMFKYLYLLFADKEDIIFDIEDYIFTTEAHLLPLWLSTTNQSISKKNTTSEYTELDDSNFDWTCPNTQILFPNDPLYAQSIREPLKNVVDKSCPRGIIRVEESFRSGAKPPLRARDFMATNPEHLEILKKMGVSLIHLKDGRVQLVQHAIQAASSIDAEDGLRFMQEMIELSSQQQKEQQLPPRAVQIVSHPFFGRVVLTAGPAQFGLDLSKHKETRGFVASSKPSNGCSELTNPEAVMGKIALIQRGQCMFAEKARNIQNAGAIGGIVIDDNEGSSSDTAPLFQMAGDGKDTDDIKIPMLFLFSKEGSIILDAIREYEEVEVLLSDKAKDRDPEMENEEQPSSENDSQNQSGEQISSSSQEVDLVDQESSEENSLNSHPESLSLADMDNAASISPSEQTSNPTENHETTNLNGECTDLDNQLQEQSETEEDSNPNVSWGKKVQPIDSILADWNEDIEAFEMMEKDEL

SEQ ID NO: 4537 - protein, 905 aa, Homo Sapiens
MSREEKQKLGNQVLEMFDHAYGNYMEHAYPADELMPLTCRGRVRGQEPSRGDVDDALGKFSLTLIDSLDTLVVLNKTKEFEDAVRKVLRDVNLDNDVVVSVFETNIRVLGGLLGGHSLAIMLKEKGEYMQWYNDELLQMAKQLGYKLLPAFNTTSGLPYPRINLKFGIRKPEARTGTETDTCTACAGTLILEFAALSRFTGATIFEEYARKALDFLWEKRQRSSNLVGVTINIHTGDWVRKDSGVGAGIDSYYEYLLKAYVLLGDDSFLERFNTHYDAIMRYISQPPLLLDVHIHKPMLNARTWMDALLAFFPGLQVLKGDIRPAIETHEMLYQVIKKHNFLPEAFTTDFRVHWAQHPLRPEFAESTYFLYKATGDPYYLEVGKTLIENLNKYARVPCGFAAMKDVRTGSHEDRMDSFFLAEMFKYLYLLFADKEDIIFDIEDYIFTTEAHLLPLWLSTTNQSISKKNTTSEYTELDDSNFDWTCPNTQILFPNDPLYAQSIREPLKNVVDKSCPRGIIRVEESFRSGAKPPLRARDFMATNPEHLEILKKMGVSLIHLKDGRVQLVQHAIQAASSIDAEDGLRFMQEMIELSSQQQKEQQLPPRAVQIVSHPFFGRVVLTAGPAQFGLDLSKHKETRGFVASSKPSNGCSELTNPEAVMGKIALIQRGQCMFAEKARNIQNAGAIGGIVIDDNEGSSSDTAPLFQMAGDGKDTDDIKIPMLFLFSKEGSIILDAIREYEEVEVLLSDKAKDRAAILKGKMIPSYIINSNPEMENEEQPSSENDSQNQSGEQISSSSQEVDLVDQESSEENSLNSHPESLSLADMDNAASISPSEQTSNPTENHETTNLNGECTDLDNQLQEQSETEEDSNPNVSWGKKVQPIDSILADWNEDIEAFEMMEKDEL

SEQ ID NO: 4538 - protein, 380 aa, Homo Sapiens
VDKSCPRGIIRVEESFRSGAKPPLRARDFMATNPEHLEILKKMGVSLIHLKDGRVQLVQHAIQAASSIDAEDGLRFMQEMIELSSQQQKEQQLPPRAVQIVSHPFFGRVVLTAGPAQFGLDLSKHKETRGFVASSKPSNGCSELTNPEAVMGKIALIQRGQCMFAEKARNIQNAGAIGGIVIDDNEGSSSDTAPLFQMAGDGKDTDDIKIPMLFLFSKEGSIILDAIREYEEVEVLLSDKAKDRDPEMENEEQPSSENDSQNQSGEQISSSSQEVDLVDQESSEENSLNSHPESLSLADMDNAASISPSEQTSNPTENHETTNLNGECTDLDNQLQEQSETEEDSNPNVSWGKKVQPIDSILADWNEDIEAFEMMEKDEL

SEQ ID NO: 4539 - protein, 480 aa, Homo Sapiens
MKRSVAVWLLVGLSLGVPQFGKGDICDPNPCENGGICLPGLADGSFSCECPDGFTDPNCSSVVEVASDEEEPTSAGPCTPNPCHNGGTCEISEAYRGDTFIGYVCKCPRGFNGIHCQHNINECEVEPCKNGGICTDLVANYSCECPGEFMGRNCQYKCSGPLGIEGGIISNQQITASSTHRALFGLQKWYPYYARLNKKGLINAWTAAENDRWPWIQINLQRKMRVTGVITQGAKRIGSPEYIKSYKIAYSNDGKTWAMYKVKGTNEDMVFRGNIDNNTPYANSFTPPIKAQYVRLYPQVCRRHCTLRMELLGCELSGCSEPLGMKSGHIQDYQITASSIFRTLNMDMFTWEPRKARLDKQGKVNAWTSGHNDQSQWLQVDLLVPTKVTGIITQGAKDFGHVQFVGSYKLAYSNDGEHWTVYQDEKQRKDKVFQGNFDNDTHRKNVIDPPIYARHIRILPWSWYGRITLRSELLGCTEEE

SEQ ID NO: 4540 - protein, 470 aa, Homo Sapiens
MKRSVAVWLLVGLSLGVPQFGKGDICDPNPCENGGICLPGLADGSFSCECPDGFTDPNCSSVVEVGPCTPNPCHNGGTCEISEAYRGDTFIGYVCKCPRGFNGIHCQHNINECEVEPCKNGGICTDLVANYSCECPGEFMGRNCQYKCSGPLGIEGGIISNQQITASSTHRALFGLQKWYPYYARLNKKGLINAWTAAENDRWPWIQINLQRKMRVTGVITQGAKRIGSPEYIKSYKIAYSNDGKTWAMYKVKGTNEDMVFRGNIDNNTPYANSFTPPIKAQYVRLYPQVCRRHCTLRMELLGCELSGCSEPLGMKSGHIQDYQITASSIFRTLNMDMFTWEPRKARLDKQGKVNAWTSGHNDQSQWLQVDLLVPTKVTGIITQGAKDFGHVQFVGSYKLAYSNDGEHWTVYQDEKQRKDKVFQGNFDNDTHRKNVIDPPIYARHIRILPWSWYGRITLRSELLGCTEEE

SEQ ID NO: 4541 - protein, 212 aa, Homo Sapiens
MDYLLMIFSLLFVACQGAPETAVLGAELSAVGENGGEKPTPSPPWRLRRSKRCSCSSLMDKECVYFCHLDIIWVNTPEHVVPYGLGSPRSKRALENLLPTKATDRENRCQCASQKDKKCWNFCQAGKELRAEDIMEKDWNNHKKGKDCSKLGKKCIYQQLVRGRKIRRSSEEHLRQTRSETMRNSVKSSFHDPKLKGKPSRERYVTHNRAHW

SEQ ID NO: 4542 - protein, 178 aa, Homo Sapiens
MVSVPTTWCSVALALLVALHEGKGQAAATLEQPASSSHAQGTHLRLRRCSCSSWLDKECVYFCHLDIIWVNTPEQTAPYGLGNPPRRRRRSLPRRCQCSSARDPACATFCLRRPWTEAGAVPSRKSPADVFQTGKTGATTGELLQRLRDISTVKSLFAKRQQEAMREPRSTHSRWRKR

SEQ ID NO: 4543 - protein, 192 aa, Homo Sapiens
MEPGLWLLFGLTVTSAAGFVPCSQSGDAGRRGVSQAPTAARSEGDCEETVAGPGEETVAGPGEGTVAPTALQGPSPGSPGQEQAAEGAPEHHRSRRCTCFTYKDKECVYYCHLDIIWINTPEQTVPYGLSNYRGSFRGKRSAGPLPGNLQLSHRPHLRCACVGRYDKACLHFCTQTLDVSRLKSRTNKASRL

SEQ ID NO: 4544 - protein, 224 aa, Homo Sapiens
MEPGLWLLFGLTVTSAAGFVPCSQSGDAGRRGVSQAPTAARSEGDCEETVAGPGEETVAGPGEGTVAPTALQGPSPGSPGQEQAAEGAPEHHRSRRCTCFTYKDKECVYYCHLDIIWINTPEQTVPYGLSNYRGSFRGKRSAGPLPGNLQLSHRPHLRCACVGRYDKACLHFCTQTLDVSRQVEVKDQQSKQALDLHHPKLMPGSGLALAPSTCPRCLFQEGAP

SEQ ID NO: 4545 - protein, 238 aa, Homo Sapiens
MEPGLWLLFGLTVTSAAGFVPCSQSGDAGRRGVSQAPTAARSEGDCEETVAGPGEETVAGPGEGTVAPTALQGPSPGSPGQEQAAEGAPEHHRSRRCTCFTYKDKECVYYCHLDIIWINTPEQTVPYGLSNYRGSFRGKRSAGPLPGNLQLSHRPHLRCACVGRYDKACLHFCTQTLDVSSNSRTAEKTDKEEEGKVEVKDQQSKQALDLHHPKLMPGSGLALAPSTCPRCLFQEGAP

SEQ ID NO: 4546 - protein, 238 aa, Homo Sapiens; identical to SEQ ID NO: 4545

SEQ ID NO: 4547 - protein, 219 aa, Homo Sapiens
MEPGLWLLFGLTVTSAAGFVPCSQSGDAGRRGVSQAPTAARSEGDCEETVAGPGEETVAGPGEGTVAPTALQGPSPGSPGQEQAAEGAPEHHRSRRCTCFTYKDKECVYYCHLDIIWINTPEQTVPYGLSNYRGSFRGKRSAGPLPGNLQLSHRPHLRCACVGRYDKACLHFCTQTLDVSSNSRTAEKTDKEEEGKVRGANRGLCQRRLKSRTNKASRL

SEQ ID NO: 4548 - protein, 198 aa, Homo Sapiens
MEPGLWLLFGLTVTSAAGFVPCSQSGDAGRRGVSQAPTAARSEGDCEETVAGPGEETVAGPGEGTVAPTALQGPSPGSPGQEQAAEGAPEHHRSRRCTCFTYKDKECVYYCHLDIIWINTPEQTVPYGLSNYRGSFRGKRSAGPLPGNLQLSHRPHLRCACVGRYDKACLHFCTQTLDVSSNSRTAEKTDKEEEGKVT

SEQ ID NO: 4549 - protein, 162 aa, Homo Sapiens
KLVPFIQKASVGITVLSLCALSIDRYRAVASWSRIKGIGVPKWTAVEIVLIWVVSVVLAVPEAIGFDIITMDYKGSYLRICLLHPVQKTAFMQFYKTAKDWWLFSFYFCLPLAITAFFYTLMTCEMLRKKSGMQIALNDHLKQLSVGIGLYWYQHGFTEFLH

SEQ ID NO: 4550 - protein, 532 aa, Homo Sapiens
MNKSTCLMAAETPSKRWRLHCLAFSQRFVRAGPACSSREACSSPRAGWNPAGFRLPGRWSPFVALHLVCQIREALKLRSGHRTPSGAGSSMQPPPSLCGRALVALVLACGLSRIWGEERGFPPDRATPLLQTAEIMTPPTKTLWPKGSNASLARSLAPAEVPKGDRTAGSPPRTISPPPCQGPIEIKETFKYINTVVSCLVFVLGIIGNSTLLRIIYKNKCMRNGPNILIASLALGDLLHIVIDIPINVYKLLAEDWPFGAEMCKLVPFIQKASVGITVLSLCALSIDRYRAVASWSRIKGIGVPKWTAVEIVLIWVVSVVLAVPEAIGFDIITMDYKGSYLRICLLHPVQKTAFMQFYKTAKDWWLFSFYFCLPLAITAFFYTLMTCEMLRKKSGMQIALNDHLKQRREVAKTVFCLVLVFALCWLPLHLSRILKLTLYNQNDPNRCELLSFLLVLDYIGINMASLNSCINPIALYLVSKRFKNCFKSCLCCWCQSFEEKQSLEEKQSCLKFKANDHGYDNFRSSNKYSSS

SEQ ID NO: 4551 - protein, 442 aa, Homo Sapiens
MQPPPSLCGRALVALVLACGLSRIWGEERGFPPDRATPLLQTAEIMTPPTKTLWPKGSNASLARSLAPAEVPKGDRTAGSPPRTISPPPCQGPIEIKETFKYINTVVSCLVFVLGIIGNSTLLRIIYKNKCMRNGPNILIASLALGDLLHIVIDIPINVYKLLAEDWPFGAEMCKLVPFIQKASVGITVLSLCALSIDRYRAVASWSRIKGIGVPKWTAVEIVLIWVVSVVLAVPEAIGFDIITMDYKGSYLRICLLHPVQKTAFMQFYKTAKDWWLFSFYFCLPLAITAFFYTLMTCEMLRKKSGMQIALNDHLKQRREVAKTVFCLVLVFALCWLPLHLSRILKLTLYNQNDPNRCELLSFLLVLDYIGINMASLNSCINPIALYLVSKRFKNCFKSCLCCWCQSFEEKQSLEEKQSCLKFKANDHGYDNFRSSNKYSSS

SEQ ID NO: 4552 - protein, 409 aa, Homo Sapiens
MQPPPSLCGRALVALVLACGLSRIWGEERGFPPDRATPLLQTAEIMTPPTKTLWPKGSNASLARSLAPAEVPKGDRTAGSPPRTISPPPCQGPIEIKETFKYINTVVSCLVFVLGIIGNSTLLRIIYKNKCMRNGPNILIASLALGDLLHIVIDIPINVYKLLAEDWPFGAEMCKLVPFIQKASVGITVLSLCALSIDRYRAVASWSRIKGIGVPKWTAVEIVLIWVVSVVLAVPEAIGFDIITMDYKGSYLRICLLHPVQKTAFMQFYKTAKDWWLFSFYFCLPLAITAFFYTLMTCEMLRKKSGMQIALNDHLKQRREVAKTVFCLVLVFALCWLPLHLSRILKLTLYNQNDPNRCELLSFLLVLDYIGINMASLNSCINPIALYLVSKRFKNCFKVRDYPKIKSSL

SEQ ID NO: 4553 - protein, 442 aa, Homo Sapiens; identical to SEQ ID NO: 4551

SEQ ID NO: 4554 - protein, 436 aa, Homo Sapiens
MQPPPSLCGRALVALVLACGLSRIWGEERGFPPDRATPLLQTAEIMTPPTKTLWPKGSNASLARSLAPAEVPKGDRTAGSPPRTISPPPCQGPIEIKETFKYINTVVSCLVFVLGIIGNSTLLRIIYKNKCMRNGPNILIASLALGDLLHIVIDIPINVYKLLAEDWPFGAEMCKLVPFIQKASVGITVLSLCALSIDRYRAVASWSRIKGIGVPKWTAVEIVLIWVVSVVLAVPEAIGFDIITMDYKGSYLRICLLHPVQKTAFMQFYKTAKDWWLFSFYFCLPLAITAFFYTLMTCEMLRKKSGMQIALNDHLKQRREVAKTVFCLVLVFALCWLPLHLSRILKLTLYNQNDPNRCELLSFLLVLDYIGINMASLNSCINPIALYLVSKRFKNCFKAGPHVGNKLVMLFSVNIECDGTVNQNPTMWPERKSNNN

SEQ ID NO: 4555 - protein, 442 aa, Homo Sapiens; identical to SEQ ID NO: 4551

SEQ ID NO: 4556 - protein, 442 aa, Homo Sapiens; identical to SEQ ID NO: 4551

SEQ ID NO: 4557 - protein, 442 aa, Homo Sapiens; identical to SEQ ID NO: 4551

SEQ ID NO: 4558 - protein, 27 aa, Homo Sapiens
MLKALFLTMLTLALVKSQDTEETITYT

SEQ ID NO: 4559 - protein, 52 aa, Homo Sapiens
MLKALFLTMLTLALVKSQDTEETITYTQCTDGYEWDPVRQQCKDIDECDIVP

SEQ ID NO: 4560 - protein, 62 aa, Homo Sapiens
MLKALFLTMLTLALVKSQDTEETITYTQCTDGYEWDPVRQQCKDIDECDIVPDACKGGMKCV

SEQ ID NO: 4561 - protein, 87 aa, Homo Sapiens
MLKALFLTMLTLALVKSQDTEETITYTQCTDGYEWDPVRQQCKDIDECDIVPDACKGGMKCVNHYGGYLCLPKTAQIIVNNEQPQQE

SEQ ID NO: 4562 - protein, 106 aa, Homo Sapiens
MLKALFLTMLTLALVKSQDTEETITYTQCTDGYEWDPVRQQCKDIDECDIVPDACKGGMKCVNHYGGYLCLPKTAQIIVNNEQPQQETQPAEGTSGATTGVVAASS

SEQ ID NO: 4563 - protein, 119 aa, Homo Sapiens
MLKALFLTMLTLALVKSQDTEETITYTQCTDGYEWDPVRQQCKDIDECDIVPDACKGGMKCVNHYGGYLCLPKTAQIIVNNEQPQQETQPAEGTSGATTGVVAASSMATSGVLPGGGFV

SEQ ID NO: 4564 - protein, 172 aa, Homo Sapiens
MLKALFLTMLTLALVKSQDTEETITYTQCTDGYEWDPVRQQCKDIDECDIVPDACKGGMKCVNHYGGYLCLPKTAQIIVNNEQPQQETQPAEGTSGATTGVVAASSMATSGVLPGGGFVASAAAVAGPEMQTGRNNFVIRRNPADPQRIPSNPSHRIQCAAGYEQSEHNVCQ

SEQ ID NO: 4565 - protein, 493 aa, Homo Sapiens
MLKALFLTMLTLALVKSQDTEETITYTQCTDGYEWDPVRQQCKDIDECDIVPDACKGGMKCVNHYGGYLCLPKTAQIIVNNEQPQQETQPAEGTSGATTGVVAASSMATSGVLPGGGFVASAAAVAGPEMQTGRNNFVIRRNPADPQRIPSNPSHRIQCAAGYEQSEHNVCQDIDECTAGTHNCRADQVCINLRGSFACQCPPGYQKRGEQCVDIDECTIPPYCHQRCVNTPGSFYCQCSPGFQLAANNYTCVDINECDASNQCAQQCYNILGSFICQCNQGYELSSDRLNCEDIDECRTSSYLCQYQCVNEPGKFSCMCPQGYQVVRSRTCQDINECETTNECREDEMCWNYHGGFRCYPRNPCQDPYILTPENRCVCPVSNAMCRELPQSIVYKYMSIRSDRSVPSDIFQIQATTIYANTINTFRIKSGNENGEFYLRQTSPVSAMLVLVKSLSGPREHIVDLEMLTVSSIGTFRTSSVLRLTIIVGPFSF

SEQ ID NO: 4566 - protein, 493 aa, Homo Sapiens; identical to SEQ ID NO: 4565

SEQ ID NO: 4567 - protein, 46 aa, Homo Sapiens
MLKALFLTMLTLALVKSQDTEETITYTQCTDGYEWDPVRQQCKEDS

SEQ ID NO: 4568 - protein, 280 aa, Homo Sapiens
  misc_feature (1)..(1): Xaa can be any naturally occurring amino acid
XNNFVIRRNPADPQRIPSNPSHRIQCAAGYEQSEHNVCQDIDECTAGTHNCRADQVCINLRGSFACQCPPGYQKRGEQCVDIDECRTSSYLCQYQCVNEPGKFSCMCPQGYQVVRSRTCQDINECETTNECREDEMCWNYHGGFRCYPRNPCQDPYILTPENRCVCPVSNAMCRELPQSIVYKYMSIRSDRSVPSDIFQIQATTIYANTINTFRIKSGNENGEFYLRQTSPVSAMLVLVKSLSGPREHIVDLEMLTVSSIGTFRTSSVLRLTIIVGPFSF

SEQ ID NO: 4569 - protein, 182 aa, Homo Sapiens
DECESGAHQCSEAQTCVNFHGGYRCVDTNRCVEPYIQVSENRCLCPASNPLCREQPSSIVHRYMTITSERSVPADVFQIQATSVYPGAYNAFQIRAGNSQGDFYIRGPTPSEEQEGATLPAATLAEEPVVRGRMRKAQGPPLTGAGSSAPRASVTPRGEEVTRRADSRPRPRDLDLAGLQGS

SEQ ID NO: 4570 - protein, 183 aa, Homo Sapiens
MLPCASCLPGSLLLWALLLLLLGSASPQDSEEPDSYTECTDGYEWDPDSQHCRDVNECLTIPEACKGEMKCINHYGGYLCLPRSAAVINDLHGEGPPPPVPPAQHPNPCPPGYEPDDQDSCVDVDECAQALHDCRPSQDCHNLPGSYQCTCPDGYRKIGPECVDIDECRYRYCQHRCVNLPGS

SEQ ID NO: 4571 - protein, 202 aa, Homo Sapiens
MLPCASCLPGSLLLWALLLLLLGSASPQDSEEPDSYTECTDGYEWDPDSQHCRDVNECLTIPEACKGEMKCINHYGGYLCLPRSAAVINDLHGEGPPPPVPPAQHPNPCPPGYEPDDQDSCVDVDECAQALHDCRPSQDCHNLPGSYQCTCPDGYRKIGPECVDIDECRYRYCQHRCVNLPGSFRCQCEPGFQLGPNNRSCV

SEQ ID NO: 4572 - protein, 443 aa, Homo Sapiens
MLPCASCLPGSLLLWALLLLLLGSASPQDSEEPDSYTECTDGYEWDPDSQHCRDVNECLTIPEACKGEMKCINHYGGYLCLPRSAAVINDLHGEGPPPPVPPAQHPNPCPPGYEPDDQDSCVDVDECAQALHDCRPSQDCHNLPGSYQCTCPDGYRKIGPECVDIDECRYRYCQHRCVNLPGSFRCQCEPGFQLGPNNRSCVDVNECDMGAPCEQRCFNSYGTFLCRCHQGYELHRDGFSCSDIDECSYSSYLCQYRCINEPGRFSCHCPQGYQLLATRLCQDIDECESGAHQCSEAQTCVNFHGGYRCVDTNRCVEPYIQVSENRCLCPASNPLCREQPSSIVHRYMTITSERSVPADVFQIQATSVYPGAYNAFQIRAGNSQGDFYIRQINNVSAMLVLARPVTGPREYVLDLEMVTMNSLMSYRASSVLRLTVFVGAYTF

SEQ ID NO: 4573 - protein, 443 aa, Homo Sapiens; identical to SEQ ID NO: 4572

SEQ ID NO: 4574 - protein, 436 aa, Homo Sapiens
MLPCASCLPGSLLLWALLLLLLGSASPQDSEEPDSYTECTDGYEWDPDSQHCRDVNECLTIPEACKGEMKCINHYGGYLCLPRSAAVINDLHGEGPPPPVPPAQHPNPCPPGYEPDDQDSCVDVDECAQALHDCRPSQDCHNLPGSYQCTCPDGYRKIGPECVDIDECRYRYCQHRCVNLPGSFRCQCEPGFQLGPNNRSCVDVNECDMGAPCEQRCFNSYGTFLCRCHQGYELHRDGFSCSDIDECSYSSYLCQYRCINEPGRFSCHCPQGYQLLATRLCQDIDECESGAHQCSEAQTCVNFHGGYRCVDTNRCVEPYIQVSENRCLCPASNPLCREQPSSIVHRYMTITSERSVPADVFQIQATSVYPGAYNAFQIRAGNSQGDFYIRAQGPPLTGAGSSAPRASVTPRGEEVTRRADSRPRPRDLDLAGLQGS

SEQ ID NO: 4575 - protein, 77 aa, Homo Sapiens
MLPCASCLPGSLLLWALLLLLLGSASPQDSEEPDSYTECTDGYEWDPDSQHCRGPAQETGCAQQAPLCRCQRVSDHP

SEQ ID NO: 4576 - protein, 58 aa, Homo Sapiens
MLPCASCLPGSLLLWALLLLLLGSASPQDSEEPDSYTVGTVRAAGLGQEGCQRVSDHP

SEQ ID NO: 4577 - protein, 76 aa, Homo Sapiens
MTITSERSVPADVFQIQATSVYPGAYNAFQIRAGNSQGDFYIRQINNVSAMLVLARPVTGPREYVLDLEMVTMNSL

SEQ ID NO: 4578 - protein, 74 aa, Homo Sapiens
SIVHRYMTITSERSVPADVFQIQATSVYPGAYNAFQIRAGNSQGDFYIRQINNVSAMLVLARPVTGPREPRGPH

SEQ ID NO: 4579 - protein, 69 aa, Homo Sapiens
  misc_feature (1)..(1): Xaa can be any naturally occurring amino acid
XFQIRAGNSQGDFYIRQINNVSAMLVLARPVTGPREYVLDLEMVTMNSLMSYRASSVLRLTVFVGAYTF

SEQ ID NO: 4580 - protein, 54 aa, Homo Sapiens
  misc_feature (1)..(1): Xaa can be any naturally occurring amino acid
XQINNVSAMLVLARPVTGPREYVLDLEMVTMNSLMSYRASSVLRLTVFVGAYTF

SEQ ID NO: 4581 - protein, 183 aa, Homo Sapiens
MEFLWAPLLGLCCSLAAADRHTVFWNSSNPKFRNEDYTIHVQLNDYVDIICPHYEDHSVADAAMEQYILYLVEHEEYQLCQPQSKDQVRWQCNRPSAKHGPEKLSEKFQRFTPFTLGKEFKEGHSYYYISHSPQAHDNPQEKRLAADDPEVRVLHSIGHSAAPRLFPLAWTVLLLPLLLLQTP

SEQ ID NO: 4582 - protein, 205 aa, Homo Sapiens
MEFLWAPLLGLCCSLAAADRHTVFWNSSNPKFRNEDYTIHVQLNDYVDIICPHYEDHSVADAAMEQYILYLVEHEEYQLCQPQSKDQVRWQCNRPSAKHGPEKLSEKFQRFTPFTLGKEFKEGHSYYYISKPIHQHEDRCLRLKVTVSGKITHSPQAHDNPQEKRLAADDPEVRVLHSIGHSAAPRLFPLAWTVLLLPLLLLQTP

SEQ ID NO: 4583 - protein, 213 aa, Homo Sapiens
MAPAQRPLLPLLLLLLPLPPPPFARAEDAARANSDRYAVYWNRSNPRFHAGAGDDGGGYTVEVSINDYLDIYCPHYGAPLPPAERMEHYVLYMVNGEGHASCDHRQRGFKRWECNRPAAPGGPLKFSEKFQLFTPFSLGFEFRPGHEYYYISATPPNAVDRPCLRLKVYVRPTNETLYEAPEPIFTSNNSCSSPGGCRLFLSTIPVLWTLLGS

SEQ ID NO: 4584 - protein, 201 aa, Homo Sapiens
MRLLPLLRTVLWAAFLGSPLRGGSSLRHVVYWNSSNPRLLRGDAVVELGLNDYLDIVCPHYEGPGPPEGPETFALYMVDWPGYESCQAEGPRAYKRWVCSLPFGHVQFSEKIQRFTPFSLGFEFLPGETYYYISVPTPESSGQCLRLQVSVCCKERKSESAHPVGSPGESGTSGWRGGDTPSPLCLLLLLLLLILRLLRIL

SEQ ID NO: 4585 - protein, 193 aa, Homo Sapiens
MRLLPLLRTVLWAAFLGSPLRGGSSLRHVVYWNSSNPRLLRGDAVVELGLNDYLDIVCPHYEGPGPPEGPETFALYMVDWPGYESCQAEGPRAYKRWVCSLPFGHVQFSEKIQRFTPFSLGFEFLPGETYYYISVPTPESSGQCLRLQVSVCCKERNLPSHPKEPESSQDPLEEEGSLLPALGVPIQTDKMEH

SEQ ID NO: 4586 - protein, 207 aa, Homo Sapiens
MRLLPLLRTVLWAAFLGSPLRGGSSLRHVVYWNSSNPRLLRGDAVVELGLNDYLDIVCPHYEGPGPPEGPETFALYMVDWPGYESCQAEGPRAYKRWVCSLPFGHVQFSEKIQRFTPFSLGFEFLPGETYYYISVPTPESSGQCLRLQVSVCCKERRARVLPRSPGGGGIPAACTGGANSDRQDGALMGEIRGSEVTLAGACPLITG

SEQ ID NO: 4587 - protein, 553 aa, Homo Sapiens
MPLPWSLALPLLLSWVAGGFGNAASARHHGLLASARQPGVCHYGTKLACCYGWRRNSKGVCEATCEPGCKFGECVGPNKCRCFPGYTGKTCSQDVNECGMKPRPCQHRCVNTHGSYKCFCLSGHMLMPDATCVNSRTCAMINCQYSCEDTEEGPQCLCPSSGLRLAPNGRDCLDIDECASGKVICPYNRRCVNTFGSYYCKCHIGFELQYISGRYDCIDINECTMDSHTCSHHANCFNTQGSFKCKCKQGYKGNGLRCSAIPENSVKEVLRAPGTIKDRIKKLLAHKNSMKKKAKIKNVTPEPTRTPTPKVNLQPFNYEEIVSRGGNSHGGKKGNEEKMKEGLEDEKREEKALKNDIEERSLRGDVFFPKVNEAGEFGLILVQRKALTSKLEHKDLNISVDCSFNHGICDWKQDREDDFDWNPADRDNAIGFYMAVPALAGHKKDIGRLKLLLPDLQPQSNFCLLFDYRLAGDKVGKLRVFVKNSNNALAWEKTTSEDEKWKTGKIQLYQGTDATKSIIFEAERGKGKTGEIAVDGVLLVSGLCPDSLLSVDD

SEQ ID NO: 4588 - protein, 554 aa, Homo Sapiens
MPLPWSLALPLLLSWVAGGFGNAASARHHGLLASARQPGVCHYGTKLACCYGWRRNSKGVCEATCEPGCKFGECVGPNKCRCFPGYTGKTCSQDVNECGMKPRPCQHRCVNTHGSYKCFCLSGHMLMPDATCVNSRTCAMINCQYSCEDTEEGPQCLCPSSGLRLAPNGRDCLDIDECASGKVICPYNRRCVNTFGSYYCKCHIGFELQYISGRYDCIDINECTMDSHTCSHHANCFNTQGSFKCKCKQGYKGNGLRCSAIPENSVKEVLRAPGTIKDRIKKLLAHKNSMKKKAKIKNVTPEPTRTPTPKVNLQPFNYEEIVSRGGNSHGGKKGNEEKMKEGLEDEKREEKALKNDIEERSLRGDVFFPKVNEAGEFGLILVQRKALTSKLEHKADLNISVDCSFNHGICDWKQDREDDFDWNPADRDNAIGFYMAVPALAGHKKDIGRLKLLLPDLQPQSNFCLLFDYRLAGDKVGKLRVFVKNSNNALAWEKTTSEDEKWKTGKIQLYQGTDATKSIIFEAERGKGKTGEIAVDGVLLVSGLCPDSLLSVDD

SEQ ID NO: 4589 - protein, 66 aa, Homo Sapiens
MRGSQEVLLMWLLVLAVGGTEHAYRPGRRVCAVRAHGDPVSESFVQRVYQPFLTTCDGHRACSTYR

SEQ ID NO: 4590 - protein, 273 aa, Homo Sapiens
MRGSQEVLLMWLLVLAVGGTEHAYRPGRRVCAVRAHGDPVSESFVQRVYQPFLTTCDGHRACSTYRTIYRTAYRRSPGLAPARPRYACCPGWKRTSGLPGACGAAICQPPCRNGGSCVQPGRCRCPAGWRGDTCQSDVDECSARRGGCPQRCVNTAGSYWCQCWEGHSLSADGTLCVPKGGPPRVAPNPTGVDSAMKEEVQRLQSRVDLLEEKLQLVLAPLHSLASQALEHGLPDPGSLLVHSFQQLGRIDSLSEQISFLEEQLGSCSCKKDS

SEQ ID NO: 4591 - protein, 273 aa, Homo Sapiens; identical to SEQ ID NO: 4590

SEQ ID NO: 4592 - protein, 273 aa, Homo Sapiens; identical to SEQ ID NO: 4590

SEQ ID NO: 4593 - protein, 273 aa, Homo Sapiens; identical to SEQ ID NO: 4590

SEQ ID NO: 4594 - protein, 293 aa, Homo Sapiens
MGSRAELCTLLGGFSFLLLLIPGEGAKGGSLRESQGVCSKQTLVVPLHYNESYSQPVYKPYLTLCAGRRICSTYRTMYRVMWREVRREVQQTHAVCCQGWKKRHPGALTCEAICAKPCLNGGVCVRPDQCECAPGWGGKHCHVDVDECRTSITLCSHHCFNTAGSFTCGCPHDLVLGVDGRTCMEGSPEPPTSASILSVAVREAEKDERALKQEIHELRGRLERLEQWAGQAGAWVRAVLPVPPEELQPEQVAELWGRGDRIESLSDQVLLLEERLGACSCEDNSLGLGVNHR

SEQ ID NO: 4595 - protein, 293 aa, Homo Sapiens; identical to SEQ ID NO: 4594

SEQ ID NO: 4596 - protein, 258 aa, Homo Sapiens
MGSRAELCTLLGGFSFLLLLIPGEGAKGGSLRESQGVCSKQTLVVPLHYNESYSQPVYKPYLTLCAGRRICSTYRTMYRVMWREVRREVQQTHAVCCQGWKKRHPGALTCEAICAKPCLNGGVCVRPDQCECAPGWGGKHCHVGSFTCGCPHDLVLGVDGRTCMEGSPEPPTSASILSVAVREAEKDERALKQEIHELRGRLERLEQWAGQAGAWVRAVLPVPPEELQPEQVAELWGRGDRIESLSDQVLLLEERLGA

SEQ ID NO: 4597 - protein, 1009 aa, Homo Sapiens
MDLIRGVLLRLLLLASSLGPGAVSLRAAIRKPGKVGPPLDIKLGALNCTAFSIQWKMPRHPGSPILGYTVFYSEVGADKSLQEQLHSVPLSRDIPTTEEVIGDLKPGTEYRVSIAAYSQAGKGRLSSPRHVTTLSQDSCLPPAAPQQPHVIVVSDSEVALSWKPGASEGSAPIQYYSVEFIRPDFDKKWTSIHERIQMDSMVIKGLDPDTNYQFAVRAMNSHGPSPRSWPSDIIRTLCPEEAGSGRYGPRYITDMGAGEDDEGFEDDLDLDISFEEVKPLPATKGGNKKFLVESKKMSISNPKTISRLIPPTSASLPVTTVAPQPIPIQRKGKNGVAIMSRLFDMPCDETLCSADSFCVNDYTWGGSRCQCTLGKGGESCSEDIVIQYPQFFGHSYVTFEPLKNSYQAFQITLEFRAEAEDGLLLYCGENEHGRGDFMSLAIIRRSLQFRFNCGTGVAIIVSETKIKLGGWHTVMLYRDGLNGLLQLNNGTPVTGQSQGQYSKITFRTPLYLGGAPSAYWLVRATGTNRGFQGCVQSLAVNGRRIDMRPWPLGKALSGADVGECSSGICDEASCIHGGTCTAIKADSYICLCPLGFKGRHCEDAFTLTIPQFRESLRSYAATPWPLEPQHYLSFMEFEITFRPDSGDGVLLYSYDTGSKDFLSINLAGGHVEFRFDCGSGTGVLRSEDPLTLGNWHELRVSRTAKNGILQVDKQKIVEGMAEGGFTQIKCNTDIFIGGVPNYDDVKKNSGVLKPFSGSIQKIILNDRTIHVKHDFTSGVNVENAAHPCVRAPCAHGGSCRPRKEGYDCDCPLGFEGLHCQKAIIEAIEIPQFIGRSYLTYDNPDILKRVSGSRSNVFMRFKTTAKDGLLLWRGDSPMRPNSDFISLGLRDGALVFSYNLGSGVASIMVNGSFNDGRWHRVKAVRDGQSGKITVDDYGARTGKSPGMMRQLNINGALYVGGMKEIALHTNRQYMRGLVGCISHFTLSTDYHISLVEDAVDGKNINTCGAK

SEQ ID NO: 4598 - protein, 1017 aa, Homo Sapiens
MDLIRGVLLRLLLLASSLGPGAVSLRAAIRKPGKVGPPLDIKLGALNCTAFSIQWKMPRHPGSPILGYTVFYSEVGADKSLQEQLHSVPLSRDIPTTEEVIGDLKPGTEYRVSIAAYSQAGKGRLSSPRHVTTLSQDSCLPPAAPQQPHVIVVSDSEVALSWKPGASEGSAPIQYYSVEFIRPDFDKKWTSIHERIQMDSMVIKGLDPDTNYQFAVRAMNSHGPSPRSWPSDIIRTLCPEEAGSGRYGPRYITDMGAGEDDEGFEDDLDLDISFEEVKPLPATKGGNKKFLVESKKMSISNPKTISRLIPPTSASLPVTTVAPQPIPIQRKGKNGVAIMSRLFDMPCDETLCSADSFCVNDYTWGGSRCQCTLGKGGESCSEDIVIQYPQFFGHSYVTFEPLKNSYQAFQITLEFRAEAEDGLLLYCGENEHGRGDFMSLAIIRRSLQFRFNCGTGVAIIVSETKIKLGGWHTVMLYRDGLNGLLQLNNGTPVTGQSQGQYSKITFRTPLYLGGAPSAYWLVRATGTNRGFQGCVQSLAVNGRRIDMRPWPLGKALSGADVGECSSGICDEASCIHGGTCTAIKADSYICLCPLGFKGRHCEDAFTLTIPQFRESLRSYAATPWPLEPQHYLSFMEFEITFRPDSGDGVLLYSYDTGSKDFLSINLAGGHVEFRFDCGSGTGVLRSEDPLTLGNWHELRVSRTAKNGILQVDKQKIVEGMAEGGFTQIKCNTDIFIGGVPNYDDVKKNSGVLKPFSGSIQKIILNDRTIHVKHDFTSGVNVENAAHPCVRAPCAHGGSCRPRKEGYDCDCPLGFEGLHCQKECGNYCLNTIIEAIEIPQFIGRSYLTYDNPDILKRVSGSRSNVFMRFKTTAKDGLLLWRGDSPMRPNSDFISLGLRDGALVFSYNLGSGVASIMVNGSFNDGRWHRVKAVRDGQSGKITVDDYGARTGKSPGMMRQLNINGALYVGGMKEIALHTNRQYMRGLVGCISHFTLSTDYHISLVEDAVDGKNINTCGAK

SEQ ID NO: 4599 - protein, 47 aa, Homo Sapiens
MDLIRGVLLRLLLLASSLGPGAVSLRAAIRKPGRCWRMTVTKTWTEP

SEQ ID NO: 4600 - protein, 375 aa, Homo Sapiens
MEFEITFRPDSGDGVLLYSYDTGSKDFLSINLAGGHVEFRFDCGSGTGVLRSEDPLTLGNWHELRVSRTAKNGILQVDKQKIVEGMAEGGFTQIKCNTDIFIGGVPNYDDVKKNSGVLKPFSGSIQKIILNDRTIHVKHDFTSGVNVENAAHPCVRAPCAHGGSCRPRKEGYDCDCPLGFEGLHCQKAIIEAIEIPQFIGRSYLTYDNPDILKRVSGSRSNVFMRFKTTAKDGLLLWRGDSPMRPNSDFISLGLRDGALVFSYNLGSGVASIMVNGSFNDGRWHRVKAVRDGQSGKITVDDYGARTGKSPGMMRQLNINGALYVGGMKEIALHTNRQYMRGLVGCISHFTLSTDYHISLVEDAVDGKNINTCGAK

SEQ ID NO: 4601 - protein, 775 aa, Homo Sapiens
MHPGPEEAGSGRYGPRYITDMGAGEDDEGFEDDLDLDISFEEVKPLPATKGGNKKFLVESKKMSISNPKTISRLIPPTSASLPVTTVAPQPIPIQRKGKNGVAIMSRLFDMPCDETLCSADSFCVNDYTWGGSRCQCTLGKGGESCSEDIVIQYPQFFGHSYVTFEPLKNSYQAFQITLEFRAEAEDGLLLYCGENEHGRGDFMSLAIIRRSLQFRFNCGTGVAIIVSETKIKLGGWHTVMLYRDGLNGLLQLNNGTPVTGQSQGQYSKITFRTPLYLGGAPSAYWLVRATGTNRGFQGCVQSLAVNGRRIDMRPWPLGKALSGADVGECSSGICDEASCIHGGTCTAIKADSYICLCPLGFKGRHCEDAFTLTIPQFRESLRSYAATPWPLEPQHYLSFMEFEITFRPDSGDGVLLYSYDTGSKDFLSINLAGGHVEFRFDCGSGTGVLRSEDPLTLGNWHELRVSRTAKNGILQVDKQKIVEGMAEGGFTQIKCNTDIFIGGVPNYDDVKKNSGVLKPFSGSIQKIILNDRTIHVKHDFTSGVNVENAAHPCVRAPCAHGGSCRPRKEGYDCDCPLGFEGLHCQKAIIEAIEIPQFIGRSYLTYDNPDILKRVSGSRSNVFMRFKTTAKDGLLLWRGDSPMRPNSDFISLGLRDGALVFSYNLGSGVASIMVNGSFNDGRWHRVKAVRDGQSGKITVDDYGARTGKSPGMMRQLNINGALYVGGMKEIALHTNRQYMRGLVGCISHFTLSTDYHISLVEDAVDGKNINTCGAK

SEQ ID NO: 4602 - protein, 112 aa, Homo Sapiens
MRFKTTAKDGLLLWRGDSPMRPNSDFISLGLRDGALVFSYNLGSGVASIMVNGSFNDGRWHRVKAVRDGQSGKITVDDYGARTGKSPGMMRQLNINGALYVGGMKEIALHTN

SEQ ID NO: 4603 - protein, 152 aa, Homo Sapiens
MRFKTTAKDGLLLWRGDSPMRPNSDFISLGLRDGALVFSYNLGSGVASIMVNGSFNDGRWHRVKAVRDGQSGKITVDDYGARTGKSPGMMRQLNINGALYVGGMKEIALHTNRQYMRGLVGCISHFTLSTDYHISLVEDAVDGKNINTCGAK

SEQ ID NO: 4604 - protein, 152 aa, Homo Sapiens; identical to SEQ ID NO: 4603

SEQ ID NO: 4605 - protein, 152 aa, Homo Sapiens; identical to SEQ ID NO: 4603

SEQ ID NO: 4606 - protein, 128 aa, Homo Sapiens
MFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQ

SEQ ID NO: 4607 - protein, 1210 aa, Homo Sapiens [sequence omitted]

SEQ ID NO: 4608 - protein, 628 aa, Homo Sapiens
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGS

SEQ ID NO: 4609 - protein, 705 aa, Homo Sapiens
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGPGNESLKAMLFCLFKLSSCNQSNDGSVSHQSGSPAAQESCLGWIPSLLPSEFQLGWGGCSHLHAWPSASVIITASSCH

SEQ ID NO: 4610 - protein, 405 aa, Homo Sapiens
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGLS

SEQ ID NO: 4611 - protein, 1091 aa, Homo Sapiens
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQGQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFMRRRHIVRKRTLRRLLQERELVEPLTPSGEAPNQALLRILKETEFKKIKVLGSGAFGTVYKGLWIPEGEKVKIPVAIKELREATSPKANKEILDEAYVMASVDNPHVCRLLGICLTSTVQLITQLMPFGCLLDYVREHKDNIGSQYLLNWCVQIAKGMNYLEDRRLVHRDLAARNVLVKTPQHVKITDFGLAKLLGAEEKEYHAEGGKVPIKWMALESILHRIYTHQSDVWSYGVTVWELMTFGSKPYDGIPASEISSILEKGERLPQPPICTIDVYMIMVKCWMIDADSRPKFRELIIEFSKMARDPQRYLVIQGDERMHLPSPTDSNFYRALMDEEDMDDVVDADEYLIPQQGFFSSPSTSRTPLLSSLSATSNNSTVACIDRNGLQSCPIKEDSFLQRYSSDPTGALTEDSIDDTFLPVPGEWLVWKQSCSSTSSTHSAAASLQCPSQVLPPASPEGETVADLQTQ

SEQ ID NO: 4612 - protein, 1165 aa, Homo Sapiens
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQGQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFMRRRHIVRKRTLRRLLQERELVEPLTPSGEAPNQALLRILKETEFKKIKVLGSGAFGTVYKGLWIPEGEKVKIPVAIKELREATSPKANKEILDEAYVMASVDNPHVCRLLGICLTSTVQLITQLMPFGCLLDYVREHKDNIGSQYLLNWCVQIAKGMNYLEDRRLVHRDLAARNVLVKTPQHVKITDFGLAKLLGAEEKEYHAEGGKVPIKWMALESILHRIYTHQSDVWSYGVTVWELMTFGSKPYDGIPASEISSILEKGERLPQPPICTIDVYMIMVKCWMIDADSRPKFRELIIEFSKMARDPQRYLVIQGDERMHLPSPTDSNFYRALMDEEDMDDVVDADEYLIPQQGFFSSPSTSRTPLLSSLSATSNNSTVACIDRNGLQSCPIKEDSFLQRYSSDPTGALTEDSIDDTFLPVPEYINQSVPKRPAGSVQNPVYHNQPLNPAPSRDPHYQDPHSTAVGNPEYLNTVQPTCVNSTFDSPAHWAQKGSHQISLDNPDYQQDFFPKEAKPNGIFKGSTAENAEYLRVAPQSSEFIGA

SEQ ID NO: 4613 - protein, 464 aa, Homo Sapiens
MSSLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFMRR

SEQ ID NO: 4614 - protein, 77 aa, Homo Sapiens
MASVWKRLQRVGKHASKFQFVASYQELMVECTKKWQPDKLVVVWTRRSRRKSSKAHSWQPGIKNPYRGVVVWPVPEN

SEQ ID NO: 4615 - protein, 1231 aa, Homo Sapiens
MASVWKRLQRVGKHASKFQFVASYQELMVECTKKWQPDKLVVVWTRRSRRKSSKAHSWQPGIKNPYRGVVVWPVPENIEITVTLFKDPHAEEFEDKEWTFVIENESPSGRRKALATSSINMKQYASPMPTQTDVKLKFKPLSKKVVSAALQFSLSCIFLREGKATDEDMQSLASLMSMKQADIGNLDDFEEDNEDDDENRVNQEEKAAKITEIVNQLNALSSLDEDQDDCIKQANMRSAKSASSSEELINKLNFLDEAEKDLATVNSNPFDDPDAAELNPFGDPDSEEPITETASPRKTEDSFYNNSYNPFKEVQTPQYLNPFDEPEAFVTIKDSPPQSTKRKNIRPVDMSKYLYADSSKTEEEELDESNPFYEPKSTPPPNNLVNPVQELETERRVKRKAPAPPVLSPKTGVLNENTVSAGKDLSTSPKPSPIPSPVLGRKPNASQSLLVWCKEVTKNYRGVKITNFTTSWRNGLSFCAILHHFRPDLIDYKSLNPQDIKENNKKAYDGFASIGISRLLEPSDMVLLAIPDKLTVMTYLYQIRAHFSGQELNVVQIEENSSKSTYKVGNYETDTNSSVDQEKFYAELSDLKREPELQQPISGAVDFLSQDDSVFVNDSGVGESESEHQTPDDHLSPSTASPYCRRTKSDTEPQKSQQSSGRTSGSDDPGICSNTDSTQAQVLLGKKRLLKAETLELSDLYVSDKKKDMSPPFICEETDEQKLQTLDIGSNLEKEKLENSRSLECRSDPESPIKKTSLSPTSKLGYSYSRDLDLAKKKHASLRQTESDPDADRTTLNHADHSSKIVQHRLLSRQEELKERARVLLEQARRDAALKAGNKHNTNTATPFCNRQLSDQQDEERRRQLRERARQLIAEARSGVKMSELPSYGEMAAEKLKERSKASGDENDNIEIDTNEEIPEGFVVGGGDELTNLENDLDTPEQNSKLVDLKLKKLLEVQPQVANSPSSAAQKAVTESSEQDMKSGTEDLRTERLQKTTERFRNPVVFSKDSTVRKTQLQSFSQYIENRPEMKRQRSIQEDTKKGNEEKAAITETQRKPSEDEVLNKGFKDTSQYVVGELAALENEQKQIDTRAALVEKRLRYLMDTGRNTEEEEAMMQEWFMLVNKKNALIRRMNQLSLLEKEHDLERRYELLNRELRAMLAIEDWQKTEAQKRREQLLLDELVALVNKRDALVRDLDAQEKQAEEEDEHLERTLEQNKGKMAKKEEKCVLQ

SEQ ID NO: 4616 - protein, 1160 aa, Homo Sapiens
MASVWKRLQRVGKHASKFQFVASYQELMVECTKKWQPDKLVVVWTRRSRRKSSKAHSWQPGIKNPYRGVVVWPVPENIEITVTLFKDPHAEEFEDKEWTFVIENESPSGRRKALATSSINMKQYASPMPTQTDVKLKFKPLSKKVVSAALQFSLSCIFLREGKATDEDMQSLASLMSMKQADIGNLDDFEEDNEDDDENRVNQEEKAAKITELINKLNFLDEAEKDLATVNSNPFDDPDAAELNPFGDPDSEEPITETASPRKTEDSFYNNSYNPFKEVQTPQYLNPFDEPEAFVTIKDSPPQSTKRKNIRPVDMSKYLYADSSKTEEEELDESNPFYEPKSTPPPNNLVNPVQELETERRVKRKAPAPPVLSPKTGVLNENTVSAGKDLSTSPKPSPIPSPVLGRKPNASQSLLVWCKEVTKNYRGVKITNFTTSWRNGLSFCAILHHFRPDLIDYKSLNPQDIKENNKKAYDGFASIGISRLLEPSDMVLLAIPDKLTVMTYLYQIRAHFSGQELNVVQIEENSSKSTYKVGNYETDTNSSVDQEKFYAELSDLKREPELQQPISGAVDFLSQDDSVFVNDSGVGESESEHQTPDDHLSPSTASPYCRRTKSDTEPQKSQQSSGRTSGSDDPGICSNTDSTQAQVLLGKKRLLKAETLELSDLYVSDKKKDMSPPFICEETDEQKLQTLDIGSNLEKEKLENSRSLECRSDPESPIKKTSLSPTSKLGYSYSRDLDLAKKKHASLRQTESDPDADRTTLNHADHSSKIVQHRLLSRQEELKERARVLLEQARRDAALKAGNKHNTNTATPFCNRQLSDQQDEERRRQLRERARQLIAEARSGVKMSELPSYGEMAAEKLKERSKASGEQNSKLVDLKLKKLLEVQPQVANSPSSAAQKAVTESSEQDMKSGTEDLRTERLQKTTERFRNPVVFSKDSTVRKTQLQSFSQYIENRPEMKRQRSIQEDTKKGNEEKAAITETQRKPSEDEVLNKGFKDTSQYVVGELAALENEQKQIDTRAALVEKRLRYLMDTGRNTEEEEAMMQEWFMLVNKKNALIRRMNQLSLLEKEHDLERRYELLNRELRAMLAIEDWQKTEAQKRREQLLLDELVALVNKRDALVRDLDAQEKQAEEEDEHLERTLEQNKGKMAKKEEKCVLQ

SEQ ID NO: 4617 - protein, 310 aa, Homo Sapiens
MASVWKRLQRVGKHASKFQFVASYQELMVECTKKWQPDKLVVVWTRRSRRKSSKAHSWQPGIKNPYRGVVVWPVPENIEITVTLFKDPHAEEFEDKEWTFVIENESPSGRRKALATSSINMKQYASPMPTQTDVKLKFKPLSKKVVSAALQFSLSCIFLREGKATDEDMQSLASLMSMKQADIGNLDDFEEDNEDDDENRVNQEEKAAKITELINKLNFLDEAEKDLATVNSNPFDDPDAAELNPFGDPDSEEPITETASPRKTEDSFYNNSYNPFKEVQTPQYLNPFDEPEAFVTIKDSPPQSTKRKNI

SEQ ID NO: 4618 - protein, 1196 aa, Homo Sapiens
MASVWKRLQRVGKHASKFQFVASYQELMVECTKKWQPDKLVVVWTRRSRRKSSKAHSWQPGIKNPYRGVVVWPVPENIEITVTLFKDPHAEEFEDKEWTFVIENESPSGRRKALATSSINMKQYASPMPTQTDVKLKFKPLSKKVVSAALQFSLSCIFLREGKATDEDMQSLASLMSMKQADIGNLDDFEEDNEDDDENRVNQEEKAAKITELINKLNFLDEAEKDLATVNSNPFDDPDAAELNPFGDPDSEEPITETASPRKTEDSFYNNSYNPFKEVQTPQYLNPFDEPEAFVTIKDSPPQSTKRKNIRPVDMSKYLYADSSKTEEEELDESNPFYEPKSTPPPNNLVNPVQELETERRVKRKAPAPPVLSPKTGVLNENTVSAGKDLSTSPKPSPIPSPVLGRKPNASQSLLVWCKEVTKNYRGVKITNFTTSWRNGLSFCAILHHFRPDLIDYKSLNPQDIKENNKKAYDGFASIGISRLLEPSDMVLLAIPDKLTVMTYLYQIRAHFSGQELNVVQIEENSSKSTYKVGNYETDTNSSVDQEKFYAELSDLKREPELQQPISGAVDFLSQDDSVFVNDSGVGESESEHQTPDDHLSPSTASPYCRRTKSDTEPQKSQQSSGRTSGSDDPGICSNTDSTQAQVLLGKKRLLKAETLELSDLYVSDKKKDMSPPFICEETDEQKLQTLDIGSNLEKEKLENSRSLECRSDPESPIKKTSLSPTSKLGYSYSRDLDLAKKKHASLRQTESDPDADRTTLNHADHSSKIVQHRLLSRQEELKERARVLLEQARRDAALKAGNKHNTNTATPFCNRQLSDQQDEERRRQLRERARQLIAEARSGVKMSELPSYGEMAAEKLKERSKASGDENDNIEIDTNEEIPEGFVVGGGDELTNLENDLDTPEQNSKLVDLKLKKLLEVQPQVANSPSSAAQKAVTESSEQDMKSGTEDLRTERLQKTTERFRNPVVFSKDSTVRKTQLQSFSQYIENRPEMKRQRSIQEDTKKGNEEKAAITETQRKPSEDEVLNKGFKDTSQYVVGELAALENEQKQIDTRAALVEKRLRYLMDTGRNTEEEEAMMQEWFMLVNKKNALIRRMNQLSLLEKEHDLERRYELLNRELRAMLAIEDWQKTEAQKRREQLLLDELVALVNKRDALVRDLDAQEKQAEEEDEHLERTLEQNKGKMAKKEEKCVLQ

SEQ ID NO: 4619 - protein, 1160 aa, Homo Sapiens; identical to SEQ ID NO: 4616

SEQ ID NO: 4620 - protein, 41 aa, Homo Sapiens
MKQYASPMPTQTDVKLKFKPLSKKVVSAALQFSLSCIFLRE

SEQ ID NO: 4621 - protein, 95 aa, Homo Sapiens
MKQYASPMPTQTDVKLKFKPLSKKVVSAALQFSLSCIFLREGKATDEDMQSLASLMSMKQADIGNLDDFEEDNEDDDENRVNQEEKAAKITEIVN

SEQ ID NO: 4622 - protein, 108 aa, Homo Sapiens
MNWQPDKLVVVWTRRSRRKSSKAHSWQPGIKNPYRGVVVWPVPENIEITVTLFKDPHAEEFEDKEWTFVIENESPSGRRKALATSSINMKQYASPMPTQTDVKLKFKP

SEQ ID NO: 4623 - protein, 110 aa, Homo Sapiens
  misc_feature (1)..(1): Xaa can be any naturally occurring amino acid
XLEKEKLENSRSLECRSDPESPIKKTSLSPTSKLGYSYSRDLDLAKKKHASLRQTESDPDADRTTLNHADHSSKIVQQQDEERRRQLRERARQLIAEARSGVKMSELPSY

SEQ ID NO: 4624 - protein, 223 aa, Homo Sapiens
  misc_feature (1)..(1): Xaa can be any naturally occurring amino acid
XNTNTATPFCNRQLSDQDEERRRQLRERARQLIAEARSGVKMSELPSYGEMAAEKLKERSKASGDENDNIEIDTNEEIPEGFVVGGGDELTNLENDLDTPEQNSKLVDLKLKKLLEVQPQVANSPSSAAQKAVTESSEQDMKSGTEDLRTERLQKTTERFRNPVVFSKDSTVRKTQLQSFSQYIENRPEMKRQRSIQEDTKKGNEEKAAITETQRKPSEDEVL

SEQ ID NO: 4625 - protein, 154 aa, Homo Sapiens
  misc_feature (1)..(1): Xaa can be any naturally occurring amino acid
XRLLEPSDMTESDPDADRTTLNHADHSSKIVQHRLLSRQEELKERARVLLEQARRDAALKAGNKHNTNTATPFCNRQLSDQQDEERRRQLRERARQLIAEARSGVKMSELPSYGEMAAEKLKERSKASGDENDNIEIDTNEEIPEGFVVGGGDE

SEQ ID NO: 4626 - protein, 322 aa, Homo Sapiens
MGLPERRGLVLLLSLAEILFKIMILEGGGVMNLNPGNNLLHQPPAWTDSYSTCNVSSGFFGGQWHEIHPQYWTKYQVWEWLQHLLDTNQLDANCIPFQEFDINGEHLCSMSLQEFTRAAGTAGQLLYSNLQHLKWNGQCSSDLFQSTHNVIVKTEQTEPSIMNTWKDENYLYDTNYGSTVDLLDSKTFCRAQISMTTTSHLPVAESPDMKKEQDPPAKCHTKKHNPRGTHLWEFIRDILLNPDKNPGLIKWEDRSEGVFRFLKSEAVAQLWGKKKNNSSMTYEKLSRAMRYYYKREILERVDGRRLVYKFGKNARGWRENEN

SEQ ID NO: 4627 - protein, 126 aa, Homo Sapiens
MILEGGGVMNLNPGNNLLHQPPAWTDSYSTCNVSSGFFGGQWHEIHPQYWTKYQVWEWLQHLLDTNQLDANCIPFQEFDINGEHLCSMSLQEFTRAAGTAGQLLYSNLQHLKWNGDSLFLCLSLPC

SEQ ID NO: 4628 - protein, 126 aa, Homo Sapiens; identical to SEQ ID NO: 4627

SEQ ID NO: 4629 - protein, 158 aa, Homo Sapiens
MILEGGGVMNLNPGNNLLHQPPAWTDSYSTCNVSSGFFGGQWHEIHPQYWTKYQVWEWLQHLLDTNQLDANCIPFQEFDINGEHLCSMSLQEFTRAAGTAGQLLYSNLQHLKWNGQCSSDLFQSTHNVIVKTEQTEPSIMNTWKDENYLYDTNYGSTV

SEQ ID NO: 4630 - protein, 166 aa, Homo Sapiens
MILEGGGVMNLNPGNNLLHQPPAWTDSYSTCNVSSGFFGGQWHEIHPQYWTKYQVWEWLQHLLDTNQLDANCIPFQEFDINGEHLCSMSLQEFTRAAGTAGQLLYSNLQHLKWNGQCSSDLFQSTHNVIVKTEQTEPSIMNTWKDENYLYDTNYGSTVAESPDMKK

SEQ ID NO: 4631 - protein, 277 aa, Homo Sapiens
MILEGGGVMNLNPGNNLLHQPPAWTDSYSTCNVSSGFFGGQWHEIHPQYWTKYQVWEWLQHLLDTNQLDANCIPFQEFDINGEHLCSMSLQEFTRAAGTAGQLLYSNLQHLKWNGQCSSDLFQSTHNVIVKTEQTEPSIMNTWKDENYLYDTNYGSTVAESPDMKKEQDPPAKCHTKKHNPRGTHLWEFIRDILLNPDKNPGLIKWEDRSEGVFRFLKSEAVAQLWGKKKNNSSMTYEKLSRAMRYYYKREILERVDGRRLVYKFGKNARGWRENEN

SEQ ID NO: 4632 - protein, 173 aa, Homo Sapiens
MILEGGGVMNLNPGNNLLHQPPAWTDSYSTCNVSSGFFGGQWHEIHPQYWTKYQVWEWLQHLLDTNQLDANCIPFQEFDINGEHLCSMSLQEFTRAAGTAGQLLYSNLQHLKWNGQCSSDLFQSTHNVIVKTEQTEPSIMNTWKDENYLYDTNYGSTVDLLDSKTFCRAQISM

SEQ ID NO: 4633 - protein, 300 aa, Homo Sapiens
MILEGGGVMNLNPGNNLLHQPPAWTDSYSTCNVSSGFFGGQWHEIHPQYWTKYQVWEWLQHLLDTNQLDANCIPFQEFDINGEHLCSMSLQEFTRAAGTAGQLLYSNLQHLKWNGQCSSDLFQSTHNVIVKTEQTEPSIMNTWKDENYLYDTNYGSTVDLLDSKTFCRAQISMTTTSHLPVAESPDMKKEQDPPAKCHTKKHNPRGTHLWEFIRDILLNPDKNPGLIKWEDRSEGVFRFLKSEAVAQLWGKKKNNSSMTYEKLSRAMRYYYKREILERVDGRRLVYKFGKNARGWRENEN

SEQ ID NO: 4634 - protein, 300 aa, Homo Sapiens; identical to SEQ ID NO: 4633

SEQ ID NO: 4635 - protein, 300 aa, Homo Sapiens; identical to SEQ ID NO: 4633

SEQ ID NO: 4636 - protein, 370 aa, Homo Sapiens
GLGRPTPGLSQGPGKETLESALIALDSEKPKKLRFHPKQLYFSARQGELQKVLLMLVDGIDPNFKMEHQNKRSPLHAAAEAGHVDICHMLVQAGANIDTCSEDQRTPLMEAAENNHLEAVKYLIKAGALVDPKDAEGSTCLHLAAKKGHYEVVQYLLSNGQMDVNCQDDGGWTPMIWATEYKHVDLVKLLLSKGSDINIRDNEENICLHWAAFSGCVDIAEILLAAKCDLHAVNIHGDSPLHIAARENRYDCVVLFLSRDSDVTLKNKEGETPLQCASLNSQVWSALQMSKALQDSAPDRPSPVERIVSRDIARGYERIPIPCVNAVDSEPCPSNYKYVSQNCVTSPMNIDRNITHLQALDMFLPAQPSP

SEQ ID NO: 4637 - protein, 1298 aa, Homo Sapiens
MAAADAEAVPARGEPQQDCCVKTELLGEETPMAADEGSAEKQAGEAHMAADGETNGSCENSDASSHANAAKHTQDSARVNPQDGTNTLTRIAENGVSERDSEAAKQNHVTADDFVQTSVIGSNGYILNKPALQAQPLRTTSTLASSLPGHAAKTLPGGAGKGRTPSAFPQTPAAPPATLGEGSADTEDRKLPAPGADVKVHRARKTMPKSVVGLHAASKDPREVREARDHKEPKEEINKNISDFGRQQLLPPFPSLHQSLPQNQCYMATTKSQTACLPFVLAAAVSRKKKRRMGTYSLVPKKKTKVLKQRTVIEMFKSITHSTVGSKGEKDLGASSLHVNGESLEMDSDEDDSEELEEDDGHGAEQAAAFPTEDSRTSKESMSEADRAQKMDGESEEEQESVDTGEEEEGGDESDLSSESSIKKKFLKRKGKTDSPWIKPARKRRRRSRKKPSGALGSESYKSSAGSAEQTAPGDSTGYMEVSLDSLDLRVKGILSSQAEGLANGPDVLETDGLQEVPLCSCRMETPKSREITTLANNQCMATESVDHELGRCTNSVVKYELMRPSNKAPLLVLCEDHRGRMVKHQCCPGCGYFCTAGNFMECQPESSISHRFHKDCASRVNNASYCPHCGEESSKAKEVTIAKADTTSTVTPVPGQEKGSALEGRADTTTGSAAGPPLSEDDKLQGAASHVPEGFDPTGPAGLGRPTPGLSQGPGKETLESALIALDSEKPKKLRFHPKQLYFSARQGELQKVLLMLVDGIDPNFKMEHQNKRSPLHAAAEAGHVDICHMLVQAGANIDTCSEDQRTPLMEAAENNHLEAVKYLIKAGALVDPKDAEGSTCLHLAAKKGHYEVVQYLLSNGQMDVNCQDDGGWTPMIWATEYKHVDLVKLLLSKGSDINIRDNEENICLHWAAFSGCVDIAEILLAAKCDLHAVNIHGDSPLHIAARENRYDCVVLFLSRDSDVTLKNKEGETPLQCASLNSQVWSALQMSKALQDSAPDRPSPVERIVSRDIARGYERIPIPCVNAVDSEPCPSNYKYVSQNCVTSPMNIDRNITHLQYCVCIDDCSSSNCMCGQLSMRCWYDKDGRLLPEFNMAEPPLIFECNHACSCWRNCRNRVVQNGLRARLQLYRTRDMGWGVRSLQDIPPGTFVCEYVGELISDSEADVREEDSYLFDLDNKDGEVYCIDARFYGNVSRFINHHCEPNLVPVRVFMAHQDLRFPRIAFFSTRLIEAGEQLGFDYGERFWDIKGKLFSCRCGSPKCRHSSAALAQRQASAAQEAQEDGLPDTSSAAAADPL

SEQ ID NO: 4638 - protein, 808 aa, Homo Sapiens
MAAADAEAVPARGEPQQDCCVKTELLGEETPMAADEGSAEKQAGEAHMAADGETNGSCENSDASSHANAAKHTQDSARVNPQDGTNTLTRIAENGVSERDSEAAKQNHVTADDFVQTSVIGSNGYILNKPALQAQPLRTTSTLASSLPGHAAKTLPGGAGKGRTPSAFPQTPAAPPATLGEGSADTEDRKLPAPGADVKVHRARKTMPKSVVGLHAASKDPREVREARDHKEPKEEINKNISDFGRQQLLPPFPSLHQSLPQNQCYMATTKSQTACLPFVLAAAVSRKKKRRMGTYSLVPKKKTKVLKQRTVIEMFKSITHSTVGSKGEKDLGASSLHVNGESLEMDSDEDDSEELEEDDGHGAEQAAAFPTEDSRTSKESMSEADRAQKMDGESEEEQESVDTGEEEEGGDESDLSSESSIKKKFLKRKGKTDSPWIKPARKRRRRSRKKPSGALGSESYKSSAGSAEQTAPGDSTGYMEVSLDSLDLRVKGILSSQAEGLANGPDVLETDGLQEVPLCSCRMETPKSREITTLANNQCMATESVDHELGRCTNSVVKYELMRPSNKAPLLVLCEDHRGRMVKHQCCPGCGYFCTAGNFMECQPESSISHRFHKDCASRVNNASYCPHCGEESSKAKEVTIAKADTTSTVTPVPGQEKGSALEGRADTTTGSAAGPPLSEDDKLQGAASHVPEGFDPTGPAGLGRPTPGLSQGPGKETLESALIALDSEKPKKLRFHPKQLYFSARQGELQKVLLMLVDGIDPNFKMEHQNKRSPLHAAAEAGHVDICHMLVQFCRLGSPRSRGCLW

SEQ ID NO: 4639 - protein, 556 aa, Homo Sapiens
MAAADAEAVPARGEPQQDCCVKTELLGEETPMAADEGSAEKQAGEAHMAADGETNGSCENSDASSHANAAKHTQDSARVNPQDGTNTLTRIAENGVSERDSEAAKQNHVTADDFVQTSVIGSNGYILNKPALQAQPLRTTSTLASSLPGHAAKTLPGGAGKGRTPSAFPQTPAAPPATLGEGSADTEDRKLPAPGADVKVHRARKTMPKSVVGLHAASKDPREVREARDHKEPKEEINKNISDFGRQQLLPPFPSLHQSLPQNQCYMATTKSQTACLPFVLAAAVSRKKKRRMGTYSLVPKKKTKVLKQRTVIEMFKSITHSTVGSKGEKDLGASSLHVNGESLEMDSDEDDSEELEEDDGHGAEQAAAFPTEDSRTSKESMSEADRAQKMDGESEEEQESVDTGEEEEGGDESDLSSESSIKKKFLKRKGKTDSPWIKPARKRRRRSRKKPSGALGSESYKSSAGSAEQTAPGDSTGYMEVSLDSLDLRVKGILSSQAEGLANGPDVLETDGLQEVPLCSCRMETPKSREITTLANNQCMATESVDHEVSTFVFI

SEQ ID NO: 4640 - protein, 66 aa, Homo Sapiens
MAAADAERHLWLPMKAQQRNRQERPTWLRTVRPMGLVKTAMPAVMQMLQSTLRTAQGSTPRMAPTH

SEQ ID NO: 4641 - protein, 106 aa, Homo Sapiens
MAADEGSAEKQAGEAHMAADGETNGSCENSDASSHANAAKHTQDSARVNPQDGTNTLTRIAENGVSERDSEAAKQNHVTADDFVQTSVIGSNGYILNKPALQAQPL

SEQ ID NO: 4642 - protein, 134 aa, Homo Sapiens
MAADEGSAEKQAGEAHMAADGETNGSCENSDASSHANAAKHTQDSARVNPQDGTNTLTRIAENGVSERDSEAAKQNHVTADDFVQTSVIGSNGYILNKPALQAQPLRTTSTLASSLPGHAAKTLPGGAGKGRTP

SEQ ID NO: 4643 - protein, 137 aa, Homo Sapiens
MAADEGSAEKQAGEAHMAADGETNGSCENSDASSHANAAKHTQDSARVNPQDGTNTLTRIAENGVSERDSEAAKQNHVTADDFVQTSVIGSNGYILNKPALQAQPLRTTSTLASSLPGHAAKTLPGGAGKGRTPSAF

SEQ ID NO: 4644 - protein, 139 aa, Homo Sapiens
MAADEGSAEKQAGEAHMAADGETNGSCENSDASSHANAAKHTQDSARVNPQDGTNTLTRIAENGVSERDSEAAKQNHVTADDFVQTSVIGSNGYILNKPALQAQPLRTTSTLASSLPGHAAKTLPGGAGKGRTPSAFPQ

SEQ ID NO: 4645 - protein, 982 aa, Homo Sapiens
MAADEGSAEKQAGEAHMAADGETNGSCENSDASSHANAAKHTQDSARVNPQDGTNTLTRIAENGVSERDSEAAKQNHVTADDFVQTSVIGSNGYILNKPALQAQPLRTTSTLASSLPGHAAKTLPGGAGKGRTPSAFPQTPAAPPATLGEGSADTEDRKLPAPGADVKVHRARKTMPKSVVGLHAASKDPREVREARDHKEPKEEINKNISDFGRQQLLPPFPSLHQSLPQNQCYMATTKSQTAAAVSRKKKRRMGTYSLVPKKKTKVLKQRTVIEMFKSITHSTVGSKGEKDLGASSLHVNGESLEMDSDEDDSEELEEDDGHGAEQAAAFPTEDSRTSKESMSEADRAQKMDGESEEEQESVDTGEEEEGGDESDLSSESSIKKKFLKRKGKTDSPWIKPARKRRRRSRKKPSGALGSESYKSSAGSAEQTAPGDSTGYMEVSLDSLDLRVKGILSSQAEGLANGPDVLETDGLQEVPLCSCRMETPKSREITTLANNQCMATESVDHELGRCTNSVVKYELMRPSNKAPLLVLCEDHRGRMVKHQCCPGCGYFCTAGNFMECQPESSISHRFHKDCASRVNNASYCPHCGEESSKAKEVTIAKADTTSTVTPVPGQEKGSALEGRADTTTGSAAGPPLSEDDKLQGAASHVPEGFDPTGPAGLGRPTPGLSQGPGKETLESALIALDSEKPKKLRFHPKQLYFSARQGELQKVLLMLVDGIDPNFKMEHQNKRSPLHAAAEAGHVDICHMLVQAGANIDTCSEDQRTPLMEAAENNHLEAVKYLIKAGALVDPKDAEGSTCLHLAAKKGHYEVVQYLLSNGQMDVNCQDDGGWTPMIWATEYKHVDLVKLLLSKGSDINIRDNEENICLHWAAFSGCVDIAEILLAAKCDLHAVNIHGDSPLHIAARENRYDCVVLFLSRDSDVTLKNKEGETPLQCASLNSQVWSALQMSKALQDSAPDRPSPVERIVSRDIARGYER

SEQ ID NO: 4646 - protein, 1267 aa, Homo Sapiens
MAADEGSAEKQAGEAHMAADGETNGSCENSDASSHANAAKHTQDSARVNPQDGTNTLTRIAENGVSERDSEAAKQNHVTADDFVQTSVIGSNGYILNKPALQAQPLRTTSTLASSLPGHAAKTLPGGAGKGRTPSAFPQTPAAPPATLGEGSADTEDRKLPAPGADVKVHRARKTMPKSVVGLHAASKDPREVREARDHKEPKEEINKNISDFGRQQLLPPFPSLHQSLPQNQCYMATTKSQTACLPFVLAAAVSRKKKRRMGTYSLVPKKKTKVLKQRTVIEMFKSITHSTVGSKGEKDLGASSLHVNGESLEMDSDEDDSEELEEDDGHGAEQAAAFPTEDSRTSKESMSEADRAQKMDGESEEEQESVDTGEEEEGGDESDLSSESSIKKKFLKRKGKTDSPWIKPARKRRRRSRKKPSGALGSESYKSSAGSAEQTAPGDSTGYMEVSLDSLDLRVKGILSSQAEGLANGPDVLETDGLQEVPLCSCRMETPKSREITTLANNQCMATESVDHELGRCTNSVVKYELMRPSNKAPLLVLCEDHRGRMVKHQCCPGCGYFCTAGNFMECQPESSISHRFHKDCASRVNNASYCPHCGEESSKAKEVTIAKADTTSTVTPVPGQEKGSALEGRADTTTGSAAGPPLSEDDKLQGAASHVPEGFDPTGPAGLGRPTPGLSQGPGKETLESALIALDSEKPKKLRFHPKQLYFSARQGELQKVLLMLVDGIDPNFKMEHQNKRSPLHAAAEAGHVDICHMLVQAGANIDTCSEDQRTPLMEAAENNHLEAVKYLIKAGALVDPKDAEGSTCLHLAAKKGHYEVVQYLLSNGQMDVNCQDDGGWTPMIWATEYKHVDLVKLLLSKGSDINIRDNEENICLHWAAFSGCVDIAEILLAAKCDLHAVNIHGDSPLHIAARENRYDCVVLFLSRDSDVTLKNKEGETPLQCASLNSQVWSALQMSKALQDSAPDRPSPVERIVSRDIARGYERIPIPCVNAVDSEPCPSNYKYVSQNCVTSPMNIDRNITHLQYCVCIDDCSSSNCMCGQLSMRCWYDKDGRLLPEFNMAEPPLIFECNHACSCWRNCRNRVVQNGLRARLQLYRTRDMGWGVRSLQDIPPGTFVCEYVGELISDSEADVREEDSYLFDLDNKDGEVYCIDARFYGNVSRFINHHCEPNLVPVRVFMAHQDLRFPRIAFFSTRLIEAGEQLGFDYGERFWDIKGKLFSCRCGSPKCRHSSAALAQRQASAAQEAQEDGLPDTSSAAAADPL

SEQ ID NO: 4647 - protein, 117 aa, Homo Sapiens
MEAAENNHLEAVKYLIKAGALVDPKDAEGSTCLHLAAKKGHYEVVQYLLSNGQMDVNCQDDGGWTPMIWATEYKHVDLVKLLLSKGSDINIRDNDDGTMKRGALSRQKEEKREAEEP

SEQ ID NO: 4648 - protein, 107 aa, Homo Sapiens
MEAAENNHLEAVKYLIKAGALVDPKDAEGSTCLHLAAKKGHYEVVQYLLSNGQMDVNCQDDGGWTPMIWATEYKHVDLVKLLLSKGSDINIRDNRVPEARNGKSSHK

SEQ ID NO: 4649 - protein, 394 aa, Homo Sapiens
MGFAAAAVSRKKKRRMGTYSLVPKKKTKVLKQRTVIEMFKSITHSTVGSKGEKDLGASSLHVNGESLEMDSDEDDSEELEEDDGHGAEQAAAFPTEDSRTSKESMSEADRAQKMDGESEEEQESVDTGEEEEGGDESDLSSESSIKKKFLKRKGKTDSPWIKPARKRRRRSRKKPSGALGSESYKSSAGSAEQTAPGDSTGYMEVSLDSLDLRVKGILSSQAEGLANGPDVLETDGLQEVPLCSCRMETPKSREITTLANNQCMATESVDHELGRCTNSVVKYELMRPSNKAPLLVLCEDHRGRMVKHQCCPGCGYFCTAGNFMECQPESSISHRFHKDCASRVNNASYCPHCGEESSKAKEVTIAKADTTSTVTPVPGQEKGSALEGRADTTT

SEQ ID NO: 4650 - protein, 126 aa, Homo Sapiens
MGTYSLVPKKKTKVLKQRTVIEMFKSITHSTVGSKGEKDLGASSLHVNGESLEMDSDEDDSEELEEDDGHGAEQAAAFPTEDSRTSKESMSEADRAQKKHEEENTASSPHCPGGSGTLKQSLQELP

SEQ ID NO: 4651 - protein, 126 aa, Homo Sapiens; identical to SEQ ID NO: 4650

SEQ ID NO: 4652 - protein, 268 aa, Homo Sapiens
MLYFSRSHFPRPCGGQVSAGSGLTLLLLLLPALWRGWLEGDGQQAVPARGEPQQDCCVKTELLGEETPMAADEGSAEKQAGEAHMAADGETNGSCENSDASSHANAAKHTQDSARVNPQDGTNTLTRIAENGVSERDSEAAKQNHVTADDFVQTSVIGSNGYILNKPALQAQPLRTTSTLASSLPGHAAKTLPGGAGKGRTPSAFPQTPAAPPATLGEGSADTEDRKLPAPGADVKVHRARKTMPKSVVGLHAASKDPREVREARDHK

SEQ ID NO: 4653 - protein, 803 aa, Homo Sapiens
MSEADRAQKMDGESEEEQESVDTGEEEEGGDESDLSSESSIKKKFLKRKGKTDSPWIKPARKRRRRSRKKPSGALGSESYKSSAGSAEQTAPGDSTGYMEVSLDSLDLRVKGILSSQAEGLANGPDVLETDGLQEVPLCSCRMETPKSREITTLANNQCMATESVDHELGRCTNSVVKYELMRPSNKAPLLVLCEDHRGRMVKHQCCPGCGYFCTAGNFMECQPESSISHRFHKDCASRVNNASYCPHCGEESSKAKEVTIAKADTTSTVTPVPGQEKGSALEGRADTTTGSAAGPPLSEDDKLQGAASHVPEGFDPTGPAGLGRPTPGLSQGPGKETLESALIALDSEKPKKLRFHPKQLYFSARQGELQKVLLMLVDGIDPNFKMEHQNKRSPLHAAAEAGHVDICHMLVQAGANIDTCSEDQRTPLMEAAENNHLEAVKYLIKAGALVDPKDAEGSTCLHLAAKKGHYEVVQYLLSNGQMDVNCQDDGGWTPMIWATEYKHVDLVKLLLSKGSDINIRDNEENICLHWAAFSGCVDIAEILLAAKCDLHAVNIHGDSPLHIAARENRYDCVVLFLSRDSDVTLKNKEGETPLQCASLNSQVWSALQMSKALQDSAPDRPSPVERIVSRDIARGYERIPIPCVNAVDSEPCPSNYKYVSQNCVTSPMNIDRNITHLQYCVCIDDCSSSNCMCGQLSMRCWYDKDGRLLPEFNMAEPPLIFECNHACSCWRNCRNRVVQNGLRARLQLYRTRDMGWGVRSLQDIPPGTFVCEYVGELISDSEADVREEDSYLFDLDNKISSA

SEQ ID NO: 4654 - protein, 153 aa, Homo Sapiens
SPLHAAAEAGHVDICHMLVQAGANIDTCSEDQRTPLMEAAENNHLEAVKYLIKAGALVDPKDAEGSTCLHLAAKKGHYEVVQYLLSNGQMDVNCQDDGGWTPMIWATEYKHVDLVKLLLSKGSDINIRDNDDGTMKRGALSRQKEEKREAEEP

SEQ ID NO: 4655 - protein, 277 aa, Homo Sapiens
VPARGEPQQDCCVKTELLGEETPMAADEGSAEKQAGEAHMAADGETNGSCENSDASSHANAAKHTQDSARVNPQDGTNTLTRIAENGVSERDSEAAKQNHVTADDFVQTSVIGSNGYILNKPALQAQPLRTTSTLASSLPGHAAKTLPGGAGKGRTPSAFPQTPAAPPATLGEGSADTEDRKLPAPGADVKVHRARKTMPKSVVGLHAASKDPREVREARDHKEPKEEINKNISDFGRQQLLPPFPSLHQSLPQNQCYMATTKSQTGKEDPATVSAL

SEQ ID NO: 4656 - protein, 168 aa, Homo Sapiens
WIKPARKRRRRSRKKPSGALGSESYKSSAGSAEQTAPGDSTGYMEVSLDSLDLRVKGILSSQAEGLANGPDVLETDGLQEVPLCSCRMETPKSREITTLANNQCMATESVDHEGNFMECQPESSISHRFHKDCASRVNNASYCPHCGEESSKAKEVTIAKADTTSTVT

SEQ ID NO: 4657 - protein, 543 aa, Homo Sapiens
  misc_feature (1)..(1): Xaa can be any naturally occurring amino acid
XCVKTELLGEETPMAADEGSAEKQAGEAHMAADGETNGSCENSDASSHANAAKHTQDSARVNPQDGTNTLTRIAENGVSERDSEAAKQNHVTADDFVQTSVIGSNGYILNKPALQAQPLRTTSTLASSLPGHAAKTLPGGAGKGRTPSAFPQTPAAPPATLGEGSADTEDRKLPAPGADVKVHRARKTMPKSVVGLHAASKDPREVREARDHKEPKEEINKNISDFGRQQLLPPFPSLHQSLPQNQCYMATTKSQTACLPFVLAAAVSRKKKRRMGTYSLVPKKKTKVLKQRTVIEMFKSITHSTVGSKGEKDLGASSLHVNGESLEMDSDEDDSEELEEDDGHGAEQAAAFPTEDSRTSKESMSEADRAQKMDGESEEEQESVDTGEEEEGGDESDLSSESSIKKKFLKRKGKTDSPWIKPARKRRRRSRKKPSGALGSESYKSSAGSAEQTAPGDSTGYMEVSLDSLDLRVKGILSSQAEGLANGPDVLETDGLQEVPLCSCRMETPKSREITTLANNQCMATESVDHEVLNRIQWSQIPV

SEQ ID NO: 4658 - protein, 433 aa, Homo Sapiens
  misc_feature (1)..(1): Xaa can be any naturally occurring amino acid
XGEETPMAADEGSAEKQAGEAHMAADGETNGSCENSDASSHANAAKHTQDSARVNPQDGTNTLTRIAENGVSERDSEAAKQNHVTADDFVQTSVIGSNGYILNKPALQAQPLRTTSTLASSLPGHAAKTLPGGAGKGRTPSAFPQTPAAPPATLGEGSADTEDRKLPAPGADVKVHRARKTMPKSVVGLHAASKDPREVREARDHKEPKEEINKNISDFGRQQLLPPFPSLHQSLPQNQCYMATTKSQTAAAVSRKKKRRMGTYSLVPKKKTKVLKQRTVIEMFKSITHSTVGSKGEKDLGASSLHVNGESLEMDSDEDDSEELEEDDGHGAEQAAAFPTEDSRTSKESMSEADRAQKMDGESEEEQESVDTGEEEEGGDESDLSSESSIKKKFLKRKGKTDSPWIKPARKRRRRSRKKPSGALGSESYKSSA

SEQ ID NO: 4659 - protein, 112 aa, Homo Sapiens
  misc_feature (1)..(1): Xaa can be any naturally occurring amino acid
XPALQAQPLRTTSTLASSLPGHAAKTLPGGAGKGRTPSAFPQTPAAPPATLGEGSADTEDRKLPAPGADVKVHRARKTMPKSVVGLVILCLLLLFPFSHLFCFNNGKWTLVH

SEQ ID NO: 4660 - protein, 230 aa, Homo Sapiens
  misc_feature (1)..(1): Xaa can be any naturally occurring amino acid
XPFVLAAAVSRKKKRRMGTYSLVPKKKTKVLKQRTVIEMFKSITHSTVGSKGEKDLGASSLHVNGESLEMDSDEDDSEELEEDDGHGAEQAAAFPTEDSRTSKESMSEADRAQKSSESSIKKKFLKRKGKTDSPWIKPARKRRRRSRKKPSGALGSESYKSSAGSAEQTAPGDSTGYMEVSLDSLDLRVKGILSSQAEGLANGPDVLETDGLQEVPLCSCRMETPKSREI

SEQ ID NO: 4661 - protein, 108 aa, Homo Sapiens
  misc_feature (1)..(1): Xaa can be any naturally occurring amino acid
XPLMEAAENNHLEAVKYLIKAGALVDPKDAEGSTCLHLAAKKGHYEVVQYLLSNGQMDVNCQDDGGWTPMIWATEYKHVDLVKLLLSKGSDINIRDNVGCIYSKYTLG

SEQ ID NO: 4662 - protein, 1176 aa, Homo Sapiens
MAAAAGAAAAAAAEGEAPAEMGALLLEKETRGATERVHGSLGDTPRSEETLPKATPDSLEPAGPSSPASVTVTVGDEGADTPVGATPLIGDESENLEGDGDLRGGRILLGHATKSFPSSPSKGGSCPSRAKMSMTGAGKSPPSVQSLAMRLLSMPGAQGAAAAGSEPPPATTSPEGQPKVHRARKTMSKPGNGQPPVPEKRPPEIQHFRMSDDVHSLGKVTSDLAKRRKLNSGGGLSEELGSARRSGEVTLTKGDPGSLEEWETVVGDDFSLYYDSYSVDERVDSDSKSEVEALTEQLSEEEEEEEEEEEEEEEEEEEEEEEEDEESGNQSDRSGSSGRRKAKKKWRKDSPWVKPSRKRRKREPPRAKEPRGVSNDTSSLETERGFEELPLCSCRMEAPKIDRISERAGHKCMATESVDGELSGCNAAILKRETMRPSSRVALMVLCETHRARMVKHHCCPGCGYFCTAGTFLECHPDFRVAHRFHKACVSQLNGMVFCPHCGEDASEAQEVTIPRGDGVTPPAGTAAPAPPPLSQDVPGRADTSQPSARMRGHGEPRRPPCDPLADTIDSSGPSLTLPNGGCLSAVGLPLGPGREALEKALVIQESERRKKLRFHPRQLYLSVKQGELQKVILMLLDNLDPNFQSDQQSKRTPLHAAAQKGSVEICHVLLQAGANINAVDKQQRTPLMEAVVNNHLEVARYMVQRGGCVYSKEEDGSTCLHHAAKIGNLEMVSLLLSTGQVDVNAQDSGGWTPIIWAAEHKHIEVIRMLLTRGADVTLTDNEENICLHWASFTGSAAIAEVLLNARCDLHAVNYHGDTPLHIAARESYHDCVLLFLSRGANPELRNKEGDTAWDLTPERSDVWFALQLNRKLRLGVGNRAIRTEKIICRDVARGYENVPIPCVNGVDGEPCPEDYKYISENCETSTMNIDRNITHLQHCTCVDDCSSSNCLCGQLSIRCWYDKDGRLLQEFNKIEPPLIFECNQACSCWRNCKNRVVQSGIKVRLQLYRTAKMGWGVRALQTIPQGTFICEYVGELISDAEADVREDDSYLFDLDNKDGEVYCIDARYYGNISRFINHLCDPNIIPVRVFMLHQDLRFPRIAFFSSRDIRTGEELGFDYGDRFWDIKSKYFTCQCGSEKCKHSAEAIALEQSRLARLDPHPELLPELGSLPPVNT

SEQ ID NO: 4663 - protein, 1210 aa, Homo Sapiens
MAAAAGAAAAAAAEGEAPAEMGALLLEKETRGATERVHGSLGDTPRSEETLPKATPDSLEPAGPSSPASVTVTVGDEGADTPVGATPLIGDESENLEGDGDLRGGRILLGHATKSFPSSPSKGGSCPSRAKMSMTGAGKSPPSVQSLAMRLLSMPGAQGAAAAGSEPPPATTSPEGQPKVHRARKTMSKPGNGQPPVPEKRPPEIQHFRMSDDVHSLGKVTSDLAKRRKLNSGGGLSEELGSARRSGEVTLTKGDPGSLEEWETVVGDDFSLYYDSYSVDERVDSDSKSEVEALTEQLSEEEEEEEEEEEEEEEEEEEEEEEEDEESGNQSDRSGSSGRRKAKKKWRKDSPWVKPSRKRRKREPPRAKEPRGVNGVGSSGPSEYMEVPLGSLELPSEGTLSPNHAGVSNDTSSLETERGFEELPLCSCRMEAPKIDRISERAGHKCMATESVDGELSGCNAAILKRETMRPSSRVALMVLCETHRARMVKHHCCPGCGYFCTAGTFLECHPDFRVAHRFHKACVSQLNGMVFCPHCGEDASEAQEVTIPRGDGVTPPAGTAAPAPPPLSQDVPGRADTSQPSARMRGHGEPRRPPCDPLADTIDSSGPSLTLPNGGCLSAVGLPLGPGREALEKALVIQESERRKKLRFHPRQLYLSVKQGELQKVILMLLDNLDPNFQSDQQSKRTPLHAAAQKGSVEICHVLLQAGANINAVDKQQRTPLMEAVVNNHLEVARYMVQRGGCVYSKEEDGSTCLHHAAKIGNLEMVSLLLSTGQVDVNAQDSGGWTPIIWAAEHKHIEVIRMLLTRGADVTLTDNEENICLHWASFTGSAAIAEVLLNARCDLHAVNYHGDTPLHIAARESYHDCVLLFLSRGANPELRNKEGDTAWDLTPERSDVWFALQLNRKLRLGVGNRAIRTEKIICRDVARGYENVPIPCVNGVDGEPCPEDYKYISENCETSTMNIDRNITHLQHCTCVDDCSSSNCLCGQLSIRCWYDKDGRLLQEFNKIEPPLIFECNQACSCWRNCKNRVVQSGIKVRLQLYRTAKMGWGVRALQTIPQGTFICEYVGELISDAEADVREDDSYLFDLDNKDGEVYCIDARYYGNISRFINHLCDPNIIPVRVFMLHQDLRFPRIAFFSSRDIRTGEELGFDYGDRFWDIKSKYFTCQCGSEKCKHSAEAIALEQSRLARLDPHPELLPELGSLPPVNT

SEQ ID NO: 4664 - protein, 1233 aa, Homo Sapiens
MRGLPRGRGLMRARGRGRAAPPGSRGRGRGGPHRGRGRPRSLLSLPRAQASWTPQLSTGLTSPPVPCLPSQGEAPAEMGALLLEKETRGATERVHGSLGDTPRSEETLPKATPDSLEPAGPSSPASVTVTVGDEGADTPVGATPLIGDESENLEGDGDLRGGRILLGHATKSFPSSPSKGGSCPSRAKMSMTGAGKSPPSVQSLAMRLLSMPGAQGAAAAGSEPPPATTSPEGQPKVHRARKTMSKPGNGQPPVPEKRPPEIQHFRMSDDVHSLGKVTSDLAKRRKLNSGGGLSEELGSARRSGEVTLTKGDPGSLEEWETVVGDDFSLYYDSYSVDERVDSDSKSEVEALTEQLSEEEEEEEEEEEEEEEEEEEEEEEEDEESGNQSDRSGSSGRRKAKKKWRKDSPWVKPSRKRRKREPPRAKEPRGVSNDTSSLETERGFEELPLCSCRMEAPKIDRISERAGHKCMATESVDGELSGCNAAILKRETMRPSSRVALMVLCETHRARMVKHHCCPGCGYFCTAGTFLECHPDFRVAHRFHKACVSQLNGMVFCPHCGEDASEAQEVTIPRGDGVTPPAGTAAPAPPPLSQDVPGRADTSQPSARMRGHGEPRRPPCDPLADTIDSSGPSLTLPNGGCLSAVGLPLGPGREALEKALVIQESERRKKLRFHPRQLYLSVKQGELQKVILMLLDNLDPNFQSDQQSKRTPLHAAAQKGSVEICHVLLQAGANINAVDKQQRTPLMEAVVNNHLEVARYMVQRGGCVYSKEEDGSTCLHHAAKIGNLEMVSLLLSTGQVDVNAQDSGGWTPIIWAAEHKHIEVIRMLLTRGADVTLTDNEENICLHWASFTGSAAIAEVLLNARCDLHAVNYHGDTPLHIAARESYHDCVLLFLSRGANPELRNKEGDTAWDLTPERSDVWFALQLNRKLRLGVGNRAIRTEKIICRDVARGYENVPIPCVNGVDGEPCPEDYKYISENCETSTMNIDRNITHLQHCTCVDDCSSSNCLCGQLSIRCWYDKDGRLLQEFNKIEPPLIFECNQACSCWRNCKNRVVQSGIKVRLQLYRTAKMGWGVRALQTIPQGTFICEYVGELISDAEADVREDDSYLFDLDNKDGEVYCIDARYYGNISRFINHLCDPNIIPVRVFMLHQDLRFPRIAFFSSRDIRTGEELGFDYGDRFWDIKSKYFTCQCGSEKCKHSAEAIALEQSRLARLDPHPELLPELGSLPPVNT

SEQ ID NO: 4665 - protein, 1267 aa, Homo Sapiens
MRGLPRGRGLMRARGRGRAAPPGSRGRGRGGPHRGRGRPRSLLSLPRAQASWTPQLSTGLTSPPVPCLPSQGEAPAEMGALLLEKETRGATERVHGSLGDTPRSEETLPKATPDSLEPAGPSSPASVTVTVGDEGADTPVGATPLIGDESENLEGDGDLRGGRILLGHATKSFPSSPSKGGSCPSRAKMSMTGAGKSPPSVQSLAMRLLSMPGAQGAAAAGSEPPPATTSPEGQPKVHRARKTMSKPGNGQPPVPEKRPPEIQHFRMSDDVHSLGKVTSDLAKRRKLNSGGGLSEELGSARRSGEVTLTKGDPGSLEEWETVVGDDFSLYYDSYSVDERVDSDSKSEVEALTEQLSEEEEEEEEEEEEEEEEEEEEEEEEDEESGNQSDRSGSSGRRKAKKKWRKDSPWVKPSRKRRKREPPRAKEPRGVNGVGSSGPSEYMEVPLGSLELPSEGTLSPNHAGVSNDTSSLETERGFEELPLCSCRMEAPKIDRISERAGHKCMATESVDGELSGCNAAILKRETMRPSSRVALMVLCETHRARMVKHHCCPGCGYFCTAGTFLECHPDFRVAHRFHKACVSQLNGMVFCPHCGEDASEAQEVTIPRGDGVTPPAGTAAPAPPPLSQDVPGRADTSQPSARMRGHGEPRRPPCDPLADTIDSSGPSLTLPNGGCLSAVGLPLGPGREALEKALVIQESERRKKLRFHPRQLYLSVKQGELQKVILMLLDNLDPNFQSDQQSKRTPLHAAAQKGSVEICHVLLQAGANINAVDKQQRTPLMEAVVNNHLEVARYMVQRGGCVYSKEEDGSTCLHHAAKIGNLEMVSLLLSTGQVDVNAQDSGGWTPIIWAAEHKHIEVIRMLLTRGADVTLTDNEENICLHWASFTGSAAIAEVLLNARCDLHAVNYHGDTPLHIAARESYHDCVLLFLSRGANPELRNKEGDTAWDLTPERSDVWFALQLNRKLRLGVGNRAIRTEKIICRDVARGYENVPIPCVNGVDGEPCPEDYKYISENCETSTMNIDRNITHLQHCTCVDDCSSSNCLCGQLSIRCWYDKDGRLLQEFNKIEPPLIFECNQACSCWRNCKNRVVQSGIKVRLQLYRTAKMGWGVRALQTIPQGTFICEYVGELISDAEADVREDDSYLFDLDNKDGEVYCIDARYYGNISRFINHLCDPNIIPVRVFMLHQDLRFPRIAFFSSRDIRTGEELGFDYGDRFWDIKSKYFTCQCGSEKCKHSAEAIALEQSRLARLDPHPELLPELGSLPPVNT

SEQ ID NO: 4666 - protein, 298 aa, Homo Sapiens
  misc_feature (1)..(1): Xaa can be any naturally occurring amino acid
XSKRTPLHAAAQKGSVEICHVLLQAGANINAVDKQQRTPLMEAVVNNHLEVARYMVQRGGCVYSKEEDGSTCLHHAAKIGNLEMVSLLLSTGQVDVNAQGQLPPPSLPSHPQDSGGWTPIIWAAEHKHIEVIRMLLTRGADVTLTDNEENICLHWASFTGSAAIAEVLLNARCDLHAVNYHGDTPLHIAARESYHDCVLLFLSRGANPELRNKEGDTAWDLTPERSDVWFALQLNRKLRLGVGNRAIRTEKIICRDVARGYENVPIPCVNGVDGEPCPEDYKYISENCETSTMNIDRN

SEQ ID NO: 4667 - protein, 81 aa, Homo Sapiens
MQGGNSGVRKREEEGDGAGAVAAPPAIDFPAEGPDPEYDEMWSCCVSQAGLERLASSDSPASAFQNAGIIDNLMFQQKSRC

SEQ ID NO: 4668 - protein, 164 aa, Homo Sapiens
MQGGNSGVRKREEEGDGAGAVAAPPAIDFPAEGPDPEYDESDVPAEIQVLKEPLQQPTFPFAVANQLLLVSLLEHLSHVHEPNPLRSRQVFKLLCQTFIKMGLLSSFTCSDEFSSLRLHHNRAITHLMRSAKERVRQDPCEDISRIQKIRDEKFHFSPSFPNQH

SEQ ID NO: 4669 - protein, 630 aa, Homo Sapiens
MQGGNSGVRKREEEGDGAGAVAAPPAIDFPAEGPDPEYDESDVPAEIQVLKEPLQQPTFPFAVANQLLLVSLLEHLSHVHEPNPLRSRQVFKLLCQTFIKMGLLSSFTCSDEFSSLRLHHNRAITHLMRSAKERVRQDPCEDISRIQKIRSREVALEAQTSRYLNEFEELAILGKGGYGRVYKVRNKLDGQYYAIKKILIKGATKTVCMKVLREVKVLAGLQHPNIVGYHTAWIEHVHVIQPRADRAAIELPSLEVLSDQEEDREQCGVKNDESSSSSIIFAEPTPEKEKRFGESDTENQNNKSVKYTTNLVIRESGELESTLELQENGLAGLSASSIVEQQLPLRRNSHLEESFTSTEESSEENVNFLGQTEAQYHLMLHIQMQLCELSLWDWIVERNKRGREYVDESACPYVMANVATKIFQELVEGVFYIHNMGIVHRDLKPRNIFLHGPDQQVKIGDFGLACTDILQKNTDWTNRNGKRTPTHTSRVGTCLYASPEQLEGSEYDAKSDMYSLGVVLLELFQPFGTEMERAEVLTGLRTGQLPESLRKRCPVQAKYIQHLTRRNSSQRPSAIQLLQSELFQNSGNVNLTLQMKIIEQEKEIAELKKQLNLLSQDKGVRDDGKDGGVG

SEQ ID NO: 4670 - protein, 72 aa, Homo Sapiens
  misc_feature (1)..(1): Xaa can be any naturally occurring amino acid
XLAGLTPLGVAAVASAGTGGICWCSQRGAEGWGPTPQRRPVNLTLQMKIIEQEKEIAELKKQLNLLSQDKGA

SEQ ID NO: 4671 - protein, 267 aa, Homo Sapiens
MTLGRRLACLFLACVLPALLLGGTALASEIVGGRRARPHAWPFMVSLQLRGGHFCGATLIAPNFVMSAAHCVANVNVRAVRVVLGAHNLSRREPTRQVFAVQRIFENGYDPVNLLNDIVILQLNGSATINANVQVAQLPAQGRRLGNGVQCLAMGWGLLGRNRGIASVLQELNVTVVTSLCRRSNVCTLVRGRQAGVCFGDSGSPLVCNGLIHGIASFVRGGCASGLYPDAFAPVAQFVNWIDSIIQRSEDNPCPHPRDPDPASRTH

SEQ ID NO: 4672 - protein, 267 aa, Homo Sapiens; identical to SEQ ID NO: 4671

SEQ ID NO: 4673 - protein, 152 aa, Homo Sapiens [sequence omitted]

SEQ ID NO: 4674 - protein, 700 aa, Homo Sapiens
MAGLTAAAPRPGVLLLLLSILHPSRPGGVPGAIPGGVPGGVFYPALGPGGKPLKPVPGGLAGAGLGAGLGAFPAVTFPGALVPGGVADAAAAYKAAKAGAGLGGVPGVGGLGVSAAPSVPGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGAAGLGGVLGGAGQFPLGGVAARPGFGLSPIFPGGACLGKACGRKRK

SEQ ID NO: 4675 - protein, 677 aa, Homo Sapiens
MAGLTAAAPRPGVLLLLLSILHPSRPGGVPGAIPGGVPGGVFYPALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGVAARPGFGLSPIFPGGACLGKACGRKRK

SEQ ID NO: 4676 - protein, 714 aa, Homo Sapiens
MAGLTAAAPRPGVLLLLLSILHPSRPGGVPGAIPGGVPGGVFYPALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGVGTPAAAAAKAAAKAAQFGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGAAGLGGVLGGAGQFPLGGVAARPGFGLSPIFPGGACLGKACGRKRK

SEQ ID NO: 4677 - protein, 617 aa, Homo Sapiens
MAGLTAAAPRPGVLLLLLSILHPSRPGGVPGAIPGGVPGGVFYPALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGAEAQAAAAAKAAKYGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGVAARPGFGLSPIFPGGACLGKACGRKRK

SEQ ID NO: 4678 - protein, 294 aa, Homo Sapiens
MAGLTAAAPRPGVLLLLLSILHPSRPGGVPGAIPGGVPGGVFYPGAGLGALGGGALGPGGKPLKPGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKY

SEQ ID NO: 4679 - protein, 643 aa, Homo Sapiens
MAGLTAAAPRPGVLLLLLSILHPSRPGGVPGAIPGGVPGGVFYPGAGLGALGGGALGPGGKPLKPGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGPFGGPQPGVPLGYPIKAPKLPGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGAEAQAAAAAKAAKYGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGAAGLGGVLGGAGQFPLGGVAARPGFGLSPIFPGGACLGKACGRKRK

SEQ ID NO: 4680 - protein, 168 aa, Homo Sapiens
MAGLTAAAPRPGVLLLLLSILHPSRPGGVPGAIPGGVPGGVFYPGAGLGALGGGALGPGGKPLKPGVGPFGGPQPGVPLGYPIKAPKLPGYGPGGVAGAAGKAGYPTGTGVGPQAAAAAAAKAAAKFGAGAAGVLPGVGGAGVPGVPGAIPGIGGIAGVGTPAAAAAA

SEQ ID NO: 4681 - protein, 711 aa, Homo Sapiens
MAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAAPSVPGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGVGTPAAAAAKAAAKAAQFGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGVAARPGFGLSPIFPGGACLGKACGRKRK

SEQ ID NO: 4682 - protein, 692 aa, Homo Sapiens
MAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAAPSVPGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGVAARPGFGLSPIFPGGACLGKACGRKRK

SEQ ID NO: 4683 - protein, 176 aa, Homo Sapiens
MAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAGAVVPQPGAGVKPGKVPGVGGAFAGIPGVGPFGGPQPGVPLGYPIKAPKLP

SEQ ID NO: 4684 - protein, 724 aa, Homo Sapiens
MAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGVGTPAAAAAKAAAKAAQFGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGAAGLGGVLGGAGQFPLGGVAARPGFGLSPIFPGGACLGKACGRKRK

SEQ ID NO: 4685 - protein, 757 aa, Homo Sapiens
MAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGVGTPAAAAAKAAAKAAQFGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAGADEGVRRSLSPELREGDPSSSQHLPSTPSSPRVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGAAGLGGVLGGAGQFPLGGVAARPGFGLSPIFPGGACLGKACGRKRK

SEQ ID NO: 4686 - protein, 786 aa, Homo Sapiens
MAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGAAGAGVLGGLVPGAPGAVPGVPGTGGVPGVGTPAAAAAKAAAKAAQFGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAGADEGVRRSLSPELREGDPSSSQHLPSTPSSPRVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGAAGLGGVLGGAGQFPLGGVAARPGFGLSPIFPGGACLGKACGRKRK

SEQ ID NO: 4687 - protein, 706 aa, Homo Sapiens
MAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGVGTPAAAAAKAAAKAAQFGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGVAARPGFGLSPIFPGGACLGKACGRKRK

SEQ ID NO: 4688 - protein, 730 aa, Homo Sapiens
MAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGVGTPAAAAAKAAAKAAQFALLNLAGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGAAGLGGVLGGAGQFPLGGVAARPGFGLSPIFPGGACLGKACGRKRK

SEQ ID NO: 4689 - protein, 705 aa, Homo Sapiens
MAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGAAGLGGVLGGAGQFPLGGVAARPGFGLSPIFPGGACLGKACGRKRK

SEQ ID NO: 4690 - protein, 658 aa, Homo Sapiens
MAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGGAFAGIPGVGPFGGPQPGVPLGYPIKAPKLPGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGLVPGVGVAPGVGVAPGVGVAPGVGLAPGVGVAPGVGVAPGVGVAPGIGPGGVAGAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGVAARPGFGLSPIFPGGACLGKACGRKRK

SEQ ID NO: 4691 - protein, 214 aa, Homo Sapiens
MAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGVGPFGGPQPGVPLGYPIKAPKLPGGYGLPYTTGKLPYGYGPGGVAGAAGKAGYPTGT

SEQ ID NO: 4692 - protein, 167 aa, Homo Sapiens [sequence omitted]

SEQ ID NO: 4693 - protein, 570 aa, Homo Sapiens
MAGLTAAAPRPGVLLLLLSILHPSRPGGVPGAIPGGVPGGVFYPGAGLGALGGGALGPGGKPLKPVPGGLAGAGLGAGVGGAFAGIPGVGPFGGPQPGVPLGYPIKAPKLPGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGVAARPGFGLSPIFPGGACLGKACGRKRK

SEQ ID NO: 4694 - protein, 68 aa, Homo Sapiens
MAGLTAAAPRPGVLLLLLSILHPSRPGGVPGAIPGGVPGGVFYPGNVHETSTHPGHADDADVHNRCTF

SEQ ID NO: 4695 - protein, 60 aa, Homo Sapiens
VTFPGALVPGGVADAAAAYKAAKAGAGLGGVPGVGGLGVSAGAVVPQPGAGVKPGKVPAL

SEQ ID NO: 4696 - protein, 47 aa, Homo Sapiens
DEEELLTSTGFEYQQVAFQPSILTEPPTEDHLLQNTLWPEVQKLASF

SEQ ID NO: 4697 - protein, 57 aa, Homo Sapiens
MCLQTLNFGNGFALALCLSFLPNTDVPILACGNDDCRIHIFAQQNDQFQKVLSLCGH

SEQ ID NO: 4698 - protein, 120 aa, Homo Sapiens
MVAPVLETSHVFCCPNRVRGVLNWSSGPRGLLAFGTSCSVVLYDPLKRVVVTNLNGHTARVNCIQWICKQDGSPSTELVSGGSDNQVIHWEIEDNQAMKDLFMRCMLFTRGGHQILHYVH

SEQ ID NO: 4699 - protein, 101 aa, Homo Sapiens
MVAPVLETSHVFCCPNRVRGVLNWSSGPRGLLAFGTSCSVVLYDPLKRVVVTNLNGHTARVNCIQWICKQDGSPSTELVSGGSDNQVIHWEIEDNQIWARL

SEQ ID NO: 4700 - protein, 756 aa, Homo Sapiens
MVAPVLETSHVFCCPNRVRGVLNWSSGPRGLLAFGTSCSVVLYDPLKRVVVTNLNGHTARVNCIQWICKQDGSPSTELVSGGSDNQVIHWEIEDNQLLKAVHLQGHEGPVYAVHAVYQRRTSDPALCTLIVSAAADSAVRLWSKKGPEGRDLFLASCSQDCLIRIWKLYIKSTSLETQDDDNIRLKENTFTIENESVKIAFAVTLETVLAGHENWVNAVHWQPVFYKDGVLQQPVRLLSASMDKTMILWAPDEESGVWLEQVRVGEVGGNTLGFYDCQFNEDGSMIIAHAFHGALHLWKQNTVNPREWTPEIVISGHFDGVQDLVWDPEGEFIITVGTDQTTRLFAPWKRKDQSQVTWHEIARPQIHGYDLKCLAMINRFQFVSGADEKVLRVFSAPRNFVENFCAITGQSLNHVLCNQDSDLPEGATVPALGLSNKAVFQGDIASQPSDEEELLTSTGFEYQQVAFQPSILTEPPTEDHLLQNTLWPEVQKLYGHGYEIFCVTCNSSKTLLASACKAAKKEHAAIILWNTTSWKQVQNLVFHSLTVTQMAFSPNEKFLLAVSRDRTWSLWKKQDTISPEFEPVFSLFAFTNKITSVHSRIIWSCDWSPDSKYFFTGSRDKKVVVWGECDSTDDCIEHNIGPCSSVLDVGGAVTAVSVCPVLHPSQRYVVAVGLECGKICLYTWKKTDQVPEINDWTHCVETSQSQSHTLAIRKLCWKNCSGKTEQKEAEGAEWLHFASCGEDHTVKIHRVNKCAL

SEQ ID NO: 4701 - protein, 826 aa, Homo Sapiens
MVAPVLETSHVFCCPNRVRGVLNWSSGPRGLLAFGTSCSVVLYDPLKRVVVTNLNGHTARVNCIQWICKQDGSPSTELVSGGSDNQVIHWEIEDNQLLKAVHLQGHEGPVYAVHAVYQRRTSDPALCTLIVSAAADSAVRLWSKKGPEVMCLQTLNFGNGFALALCLSFLPNTDVPILACGNDDCRIHIFAQQNDQFQKVLSLCGHEDWIRGVEWAAFGRDLFLASCSQDCLIRIWKLYIKSTSLETQDDDNIRLKENTFTIENESVKIAFAVTLETVLAGHENWVNAVHWQPVFYKDGVLQQPVRLLSASMDKTMILWAPDEESGVWLEQVRVGEVGGNTLGFYDCQFNEDGSMIIAHAFHGALHLWKQNTVNPREWTPEIVISGHFDGVQDLVWDPEGEFIITVGTDQTTRLFAPWKRKDQSQVTWHEIARPQIHGYDLKCLAMINRFQFVSGADEKVLRVFSAPRNFVENFCAITGQSLNHVLCNQDSDLPEGATVPALGLSNKAVFQGDIASQPSDEEELLTSTGFEYQQVAFQPSILTEPPTEDHLLQNTLWPEVQKLYGHGYEIFCVTCNSSKTLLASACKAAKKEHAAIILWNTTSWKQVQNLVFHSLTVTQMAFSPNEKFLLAVSRDRTWSLWKKQDTISPEFEPVFSLFAFTNKITSVHSRIIWSCDWSPDSKYFFTGSRDKKVVVWGECDSTDDCIEHNIGPCSSVLDVGGAVTAVSVCPVLHPSQRYVVAVGLECGKICLYTWKKTDQVPEINDWTHCVETSQSQSHTLAIRKLCWKNCSGKTEQKEAEGAEWLHFASCGEDHTVKIHRVNKCAL

SEQ ID NO: 4702 - protein, 705 aa, Homo Sapiens
MVAPVLETSHVFCCPNRVRGVLNWSSGPRGLLAFGTSCSVVLYDPLKRVVVTNLNGHTARVNCIQWICKQDGSPSTELVSGGSDNQVIHWEIEDNQLLKAVHLQGHEGPVYAVHAVYQRRTSDPALCTLIVSAAADSAVRLWSKKGPEVMCLQTLNFGNGFALALCLSFLPNTDVPILACGNDDCRIHIFAQQNDQFQKVLSLCGHEDWIRGVEWAAFGRDLFLASCSQDCLIRIWKLYIKSTSLETQDDDNIRLKENTFTIENESVKIAFAVTLETVLAGHENWVNAVHWQPVFYKDGVLQQPVRLLSASMDKTMILWAPDEESGVWLEQVRVGEVGGNTLGFYDCQFNEDGSMIIAHAFHGALHLWKQNTVNPREWTPEIVISGHFDGVQDLVWDPEGEFIITVGTDQTTRLFAPWKRKDQSQVTWHEIARPQIHGYDLKCLAMINRFQFVSGADEKVLRVFSAPRNFVENFCAITGQSLNHVLCNQDSDLPEGATVPALGLSNKAVFQGDIASQPSDEEELLTSTGFEYQQVAFQPSILTEPPTEDHLLQNTLWPEVQKLYGHGYEIFCVTCNSSKTLLASACKAAKKEHAAIILWNTTSWKQVQNLVFHSLTVTQMAFSPNEKFLLAVSRDRTWSLWKKQDTISPEFVELFGLVIGVLTASISSLGVETKRWLSGVSATPLMTVLSTTLAPAPQSWTWVGL

SEQ ID NO: 4703 - protein, 891 aa, Homo Sapiens
MVAPVLETSHVFCCPNRVRGVLNWSSGPRGLLAFGTSCSVVLYDPLKRVVVTNLNGHTARVNCIQWICKQDGSPSTELVSGGSDNQVIHWEIEDNQLLKAVHLQGHEGPVYAVHAVYQRRTSDPALCTLIVSAAADSAVRLWSKKGPEVMCLQTLNFGNGFALALCLSFLPNTDVTWKTGQVERGRAWKPPASLALCSRSCDSMVSCYASILCKALWKEKLHTFWHHNRISFLPSAFRPIPILACGNDDCRIHIFAQQNDQFQKVLSLCGHEDWIRGVEWAAFGRDLFLASCSQDCLIRIWKLYIKSTSLETQDDDNIRLKENTFTIENESVKIAFAVTLETVLAGHENWVNAVHWQPVFYKDGVLQQPVRLLSASMDKTMILWAPDEESGVWLEQVRVGEVGGNTLGFYDCQFNEDGSMIIAHAFHGALHLWKQNTVNPREWTPEIVISGHFDGVQDLVWDPEGEFIITVGTDQTTRLFAPWKRKDQSQVTWHEIARPQIHGYDLKCLAMINRFQFVSGADEKVLRVFSAPRNFVENFCAITGQSLNHVLCNQDSDLPEGATVPALGLSNKAVFQGDIASQPSDEEELLTSTGFEYQQVAFQPSILTEPPTEDHLLQNTLWPEVQKLYGHGYEIFCVTCNSSKTLLASACKAAKKEHAAIILWNTTSWKQVQNLVFHSLTVTQMAFSPNEKFLLAVSRDRTWSLWKKQDTISPEFEPVFSLFAFTNKITSVHSRIIWSCDWSPDSKYFFTGSRDKKVVVWGECDSTDDCIEHNIGPCSSVLDVGGAVTAVSVCPVLHPSQRYVVAVGLECGKICLYTWKKTDQVPEINDWTHCVETSQSQSHTLAIRKLCWKNCSGKTEQKEAEGAEWLHFASCGEDHTVKIHRVNKCAL

SEQ ID NO: 4704 - protein, 800 aa, Homo Sapiens
MVAPVLETSHVFCCPNRVRGVLNWSSGPRGLLAFGTSCSVVLYDPLKRVVVTNLNGHTARVNCIQWICKQDGSPSTELVSGGSDNQVIHWEIEDNQLLKAVHLQGHEGPVYAVHAVYQRRTSDPALCTLIVSAAADSAVRLWSKKGPEVPILACGNDDCRIHIFAQQNDQFQKVLSLCGHEDWIRGVEWAAFGRDLFLASCSQDCLIRIWKLYIKSTSLETQDDDNIRLKENTFTIENESVKIAFAVTLETVLAGHENWVNAVHWQPVFYKDGVLQQPVRLLSASMDKTMILWAPDEESGVWLEQVRVGEVGGNTLGFYDCQFNEDGSMIIAHAFHGALHLWKQNTVNPREWTPEIVISGHFDGVQDLVWDPEGEFIITVGTDQTTRLFAPWKRKDQSQVTWHEIARPQIHGYDLKCLAMINRFQFVSGADEKVLRVFSAPRNFVENFCAITGQSLNHVLCNQDSDLPEGATVPALGLSNKAVFQGDIASQPSDEEELLTSTGFEYQQVAFQPSILTEPPTEDHLLQNTLWPEVQKLYGHGYEIFCVTCNSSKTLLASACKAAKKEHAAIILWNTTSWKQVQNLVFHSLTVTQMAFSPNEKFLLAVSRDRTWSLWKKQDTISPEFEPVFSLFAFTNKITSVHSRIIWSCDWSPDSKYFFTGSRDKKVVVWGECDSTDDCIEHNIGPCSSVLDVGGAVTAVSVCPVLHPSQRYVVAVGLECGKICLYTWKKTDQVPEINDWTHCVETSQSQSHTLAIRKLCWKNCSGKTEQKEAEGAEWLHFASCGEDHTVKIHRVNKCAL

SEQ ID NO: 4705 - protein, 756 aa, Homo Sapiens
MVAPVLETSHVFCCPNRVRGVLNWSSGPRGLLAFGTSCSVVLYDPLKRVVVTNLNGHTARVNCIQWICKQDGSPSTELVSGGSDNQVIHWEIEDNQLLKAVHLQGHEGPVYAVHAVYQRRTSDPALCTLIVSAAADSAVRLWSKKGPEVPILACGNDDCRIHIFAQQNDQFQKVLSLCGHEDWIRGVEWAAFGRDLFLASCSQDCLIRIWKLYIKSTSLETQDDDNIRLKENTFTIENESVKIAFAVTLETVLAGHENWVNAVHWQPVFYKDGVLQQPVRLLSASMDKTMILWAPDEESGVWLEQREWTPEIVISGHFDGVQDLVWDPEGEFIITVGTDQTTRLFAPWKRKDQSQVTWHEIARPQIHGYDLKCLAMINRFQFVSGADEKVLRVFSAPRNFVENFCAITGQSLNHVLCNQDSDLPEGATVPALGLSNKAVFQGDIASQPSDEEELLTSTGFEYQQVAFQPSILTEPPTEDHLLQNTLWPEVQKLYGHGYEIFCVTCNSSKTLLASACKAAKKEHAAIILWNTTSWKQVQNLVFHSLTVTQMAFSPNEKFLLAVSRDRTWSLWKKQDTISPEFEPVFSLFAFTNKITSVHSRIIWSCDWSPDSKYFFTGSRDKKVVVWGECDSTDDCIEHNIGPCSSVLDVGGAVTAVSVCPVLHPSQRYVVAVGLECGKICLYTWKKTDQVPEINDWTHCVETSQSQSHTLAIRKLCWKNCSGKTEQKEAEGAEWLHFASCGEDHTVKIHRVNKCAL

SEQ ID NO: 4706 - protein, 821 aa, Homo Sapiens
MVAPVLETSHVFCCPNRVRGVLNWSSGPRGLLAFGTSCSVVLYDPLKRVVVTNLNGHTARVNCIQWICKQDGSPSTELVSGGSDNQVIHWEIEDNQLLKAVHLQGHEGPVYAVHAVYQRRTSDPALCTLIVSAAADSAVRLWSKKGPEVTWKTGQVERGRAWKPPASLALCSRSCDSMVSCYASILCKALWKEKLHTFWHHNRISFLPSAFRPIPILACGNDDCRIHIFAQQNDQFQKVLSLCGHEDWIRGVEWAAFGRDLFLASCSQDCLIRIWKLYIKSTSLETQDDDNIRLKENTFTIENESVKIAFAVTLETVLAGHENWVNAVHWQPVFYKDGVLQQPVRLLSASMDKTMILWAPDEESGVWLEQREWTPEIVISGHFDGVQDLVWDPEGEFIITVGTDQTTRLFAPWKRKDQSQVTWHEIARPQIHGYDLKCLAMINRFQFVSGADEKVLRVFSAPRNFVENFCAITGQSLNHVLCNQDSDLPEGATVPALGLSNKAVFQGDIASQPSDEEELLTSTGFEYQQVAFQPSILTEPPTEDHLLQNTLWPEVQKLYGHGYEIFCVTCNSSKTLLASACKAAKKEHAAIILWNTTSWKQVQNLVFHSLTVTQMAFSPNEKFLLAVSRDRTWSLWKKQDTISPEFEPVFSLFAFTNKITSVHSRIIWSCDWSPDSKYFFTGSRDKKVVVWGECDSTDDCIEHNIGPCSSVLDVGGAVTAVSVCPVLHPSQRYVVAVGLECGKICLYTWKKTDQVPEINDWTHCVETSQSQSHTLAIRKLCWKNCSGKTEQKEAEGAEWLHFASCGEDHTVKIHRVNKCAL

SEQ ID NO: 4707 - protein, 51 aa, Homo Sapiens
MVAPVLETSHVFCCPNRVRGVLNWSSGPRGLLAFGTSCSVVLYDPLPLLLN

SEQ ID NO: 4708 - protein, 51 aa, Homo Sapiens; identical to SEQ ID NO: 4707

SEQ ID NO: 4709 - protein, 150 aa, Homo Sapiens
MTRWSSYLLGWTTFLLYSYESSGDYPRCIFPFIYRGKAYNSCISQGSFLGSLWCSVTSVFDEKQQWKFCETNEYGGNSLRKPCIFPSIYRNNVVSDCMEDESNKLWCPTTENMDKDGKWSFCADTRISALVPGFPCHFPFNYKNKNYFNC

SEQ ID NO: 4710 - protein, 75 aa, Homo Sapiens
MTRWSSYLLGWTTFLLYSYESSGGISALVPGFPCHFPFNYKNKNYFNCTNEGSKENLVWCATSYNYDQDHTWVYC

SEQ ID NO: 4711 - protein, 223 aa, Homo Sapiens [sequence omitted]

SEQ ID NO: 4712 - protein, 220 aa, Homo Sapiens
MVQLPVGWTTFLLYSYESSGGMHEECVFPFTYKGSVYFTCTHIHSLSPWCATRAVYNGQWKYCQSEDYPRCIFPFIYRGKAYNSCISQGSFLGSLWCSVTSVFDEKQQWKFCETNEYGGNSLRKPCIFPSIYRNNVVSDCMEDESNKLWCPTTENMDKDGKWSFCADTRISALVPGFPCHFPFNYKNKNYFNCTNEGSKENLVWCATSYNYDQDHTWVYC

SEQ ID NO: 4713 - protein, 76 aa, Homo Sapiens
SNKLWCPTTENMDKDGKWSFCADTRISALVPGFPCHFPFNYKNKNYFNCTNEGSKENLVWCATSYNYDQDHTWVYC

SEQ ID NO: 4714 - protein, 154 aa, Homo Sapiens
  misc_feature (1)..(1): Xaa can be any naturally occurring amino acid
XYPRCIFPFIYRGKAYNSCISQGSFLGSLWCSVTSVFDEKQQWKFCETNEYGGNSLRKPCIFPSIYRNNVVSDCMEDESNKLWCPTTENMDKDGKWSFCADTRISALVPGFPCHFPFNYKNKNYFNCTNEGSKENLVWCATSYNYDQDHTWVYC

SEQ ID NO: 4715 - protein, 178 aa, Homo Sapiens
FIGIFLIDGVTGRIIHSSVQKKAKGPVHIVHSENWVVYQYWNTKARRNEFTVLELYEGTEQYNATAFSSLDRPQLPQVLQQSYIFPSSISAMEATITERGITSRHLLSFAGSPPPRDPNRTKQMYRYTQSDSSTITRQFLECEVSTQLPRVWSPLVWLWPMVWTFTKLESTHPSSLTF

SEQ ID NO: 4716 - protein, 75 aa, Homo Sapiens
MAAEWASRFWLWATLLIPAAAVYEDQVGKFDWRQQYVGKVKFASLEFSPGSKKLVVATEKNVIAALNSRTGEICE

SEQ ID NO: 4717 - protein, 992 aa, Homo Sapiens
MAAEWASRFWLWATLLIPAAAVYEDQVGKFDWRQQYVGKVKFASLEFSPGSKKLVVATEKNVIAALNSRTGEILWRHVDKGTAEGAVDAMLLHGQDVITVSNGGRIMRSWETNIGGLNWEITLDSGSFQALGLVGLQESVRYIAVLKKTTLALHHLSSGHLKWVEHLPESDSIHYQMVYSYGSGVVWALGVVPFSHVNIVKFNVEDGEIVQQVRVSTPWLQHLSGACGVVDEAVLVCPDPSSRSLQTLALETEWELRQIPLQSLDLEFGSGFQPRVLPTQPNPVDASRAQFFLHLSPSHYALLQYHYGTLSLLKNFPQTALVSFATTGEKTVAAVMACRNEVKSSSSEDGSMGSFSEKSSSKDSLACFNQTYTINLYLVETGRRLLDTTITFSLEQSGTRPERLYIQVFLKKDDSVGYRALVQTEDHLLLFLQQLAGKVVLWSREESLAEVVCLEMVDLPLTGAQAELEGEFGKKADGLLGMFLKRLSSQLILLQAWTSHLWKMFYDARKPRSQIKNEINIDTLARDEFNLQKMMVMVTASGKLFGIESSSGTILWKQYLPNVKPDSSFKLMVQRTTAHFPHPPQCTLLVKDKESGMSSLYVFNPIFGKWSQVAPPVLKRPILQSLLLPVMDQDYAKVLLLIDDEYKVTAFPATRNVLRQLHELAPSIFFYLVDAEQGRLCGYRLRKDLTTELSWELTIPPEVQRIVKVKGKRSSEHVHSQGRVMGDRSVLYKSLNPNLLAVVTESTDAHHERTFIGIFLIDGVTGRIIHSSVQKKAKGPVHIVHSENWVVYQYWNTKARRNEFTVLELYEGTEQYNATAFSSLDRPQLPQVLQQSYIFPSSISAMEATITERGITSRHLLIGLPSGAILSLPKALLDPRRPEIPTEQSREENLIPYSPDVQIHAERFINYNQTVSRMRGIYTAPSGLESTCLVVAYGLDIYQTRVYPSKQFDVLKDDYDYVLISSVLFGLVFATMITKRLAQVKLLNRAWR

SEQ ID NO: 4718 - protein, 993 aa, Homo Sapiens
MAAEWASRFWLWATLLIPAAAVYEDQVGKFDWRQQYVGKVKFASLEFSPGSKKLVVATEKNVIAALNSRTGEILWRHVDKGTAEGAVDAMLLHGQDVITVSNGGRIMRSWETNIGGLNWEITLDSGSFQALGLVGLQESVRYIAVLKKTTLALHHLSSGHLKWVEHLPESDSIHYQMVYSYGSGVVWALGVVPFSHVNIVKFNVEDGEIVQQVRVSTPWLQHLSGACGVVDEAVLVCPDPSSRSLQTLALETEWELRQIPLQSLDLEFGSGFQPRVLPTQPNPVDASRAQFFLHLSPSHYALLQYHYGTLSLLKNFPQTALVSFATTGEKTVAAVMACRNEVQKSSSSEDGSMGSFSEKSSSKDSLACFNQTYTINLYLVETGRRLLDTTITFSLEQSGTRPERLYIQVFLKKDDSVGYRALVQTEDHLLLFLQQLAGKVVLWSREESLAEVVCLEMVDLPLTGAQAELEGEFGKKADGLLGMFLKRLSSQLILLQAWTSHLWKMFYDARKPRSQIKNEINIDTLARDEFNLQKMMVMVTASGKLFGIESSSGTILWKQYLPNVKPDSSFKLMVQRTTAHFPHPPQCTLLVKDKESGMSSLYVFNPIFGKWSQVAPPVLKRPILQSLLLPVMDQDYAKVLLLIDDEYKVTAFPATRNVLRQLHELAPSIFFYLVDAEQGRLCGYRLRKDLTTELSWELTIPPEVQRIVKVKGKRSSEHVHSQGRVMGDRSVLYKSLNPNLLAVVTESTDAHHERTFIGIFLIDGVTGRIIHSSVQKKAKGPVHIVHSENWVVYQYWNTKARRNEFTVLELYEGTEQYNATAFSSLDRPQLPQVLQQSYIFPSSISAMEATITERGITSRHLLIGLPSGAILSLPKALLDPRRPEIPTEQSREENLIPYSPDVQIHAERFINYNQTVSRMRGIYTAPSGLESTCLVVAYGLDIYQTRVYPSKQFDVLKDDYDYVLISSVLFGLVFATMITKRLAQVKLLNRAWR

SEQ ID NO: 4719 - protein, 971 aa, Homo Sapiens
MAAEWASRFWLWATLLIPAAAVYEDQVGKFDWRQQYVGKVKFASLEFSPGSKKLVVATEKNVIAALNSRTGEIYVITVSNGGRIMRSWETNIGGLNWEITLDSGSFQALGLVGLQESVRYIAVLKKTTLALHHLSSGHLKWVEHLPESDSIHYQMVYSYGSGVVWALGVVPFSHVNIVKFNVEDGEIVQQVRVSTPWLQHLSGACGVVDEAVLVCPDPSSRSLQTLALETEWELRQIPLQSLDLEFGSGFQPRVLPTQPNPVDASRAQFFLHLSPSHYALLQYHYGTLSLLKNFPQTALVSFATTGEKTVAAVMACRNEVQKSSSSEDGSMGSFSEKSSSKDSLACFNQTYTINLYLVETGRRLLDTTITFSLEQSGTRPERLYIQVFLKKDDSVGYRALVQTEDHLLLFLQQLAGKVVLWSREESLAEVVCLEMVDLPLTGAQAELEGEFGKKADGLLGMFLKRLSSQLILLQAWTSHLWKMFYDARKPRSQIKNEINIDTLARDEFNLQKMMVMVTASGKLFGIESSSGTILWKQYLPNVKPDSSFKLMVQRTTAHFPHPPQCTLLVKDKESGMSSLYVFNPIFGKWSQVAPPVLKRPILQSLLLPVMDQDYAKVLLLIDDEYKVTAFPATRNVLRQLHELAPSIFFYLVDAEQGRLCGYRLRKDLTTELSWELTIPPEVQRIVKVKGKRSSEHVHSQGRVMGDRSVLYKSLNPNLLAVVTESTDAHHERTFIGIFLIDGVTGRIIHSSVQKKAKGPVHIVHSENWVVYQYWNTKARRNEFTVLELYEGTEQYNATAFSSLDRPQLPQVLQQSYIFPSSISAMEATITERGITSRHLLIGLPSGAILSLPKALLDPRRPEIPTEQSREENLIPYSPDVQIHAERFINYNQTVSRMRGIYTAPSGLESTCLVVAYGLDIYQTRVYPSKQFDVLKDDYDYVLISSVLFGLVFATMITKRLAQVKLLNRAWR

SEQ ID NO: 4720 - protein, 86 aa, Homo Sapiens
  misc_feature (1)..(1): Xaa can be any naturally occurring amino acid
XNATAFSSLDRPQLPQVLQQSYIFPSSISAMEATITERGITSRHLLIGLPSGAILSLPKALLDPRRPEIPTEQSRCTDTRRAIHQL

SEQ ID NO: 4721 - protein, 191 aa, Homo Sapiens
  misc_feature (1)..(1): Xaa can be any naturally occurring amino acid
XSSKDSLACFNQTYTINLYLVETGRRLLDTTITFSLEQSGTRPERLYIQVFLKKDDSVGYRALVQTEDHLLLFLQQLAGKVVLWSREESLAEVVCLEMVDLPLTGAQAELEGEFGKKAAIQDGLLGMFLKRLSSQLILLQAWTSHLWKMFYDARKPRSQIKNEINIDTLARDEFNLQKMMVMVTASGKVSG

SEQ ID NO: 4722 - protein, 43 aa, Homo Sapiens
MAAASAGATRLLLLLLMAHSFEIDDSANFRKRGSLLWNQQDGT

SEQ ID NO: 4723 - protein, 254 aa, Homo Sapiens
MAAASAGATRLLLLLLMAVAAPSRARGSGCRAGTGARGAGAEGREGEACGTVGLLLEHSFEIDDSANFRKRGSLLWNQQDGTLSLSQRQLSEEERGRLRDVAALNGLYRVRIPRRPGALDGLEAGGYVSSFVPACSLVESHLSDQLTLHVDVAGNVVGVSVVTHPGGCRGHEVEDVDLELFNTSVQLQPPTTAPGPETAAFIERLEMEQAQKAKNPQEQKSFFAKYWHIILGGAVLLTALRPAAPGPAPPPQEA

SEQ ID NO: 4724 - protein, 262 aa, Homo Sapiens
MAAASAGATRLLLLLLMAVAAPSRARGSGCRAGTGARGAGAEGREGEACGTVGLLLEHSFEIDDSANFRKRGSLLWNQQDGTLSLSQRQLSEEERGRLRDVAALNGLYRVRIPRRPGALDGLEAGGYVSSFVPACSLVESHLSDQLTLHVDVAGNVVGVSVVTHPGGCRGHEVEDVDLELFNTSVQLQPPTTAPGPETAAFIERLEMEQAQKAKNPQEQKSFFAKYWMYIIPVVLFLMMSGAPDTGGQGGGGGGGGGGGSGR

SEQ ID NO: 4725 - protein, 371 aa, Homo Sapiens
MAAASAGATRLLLLLLMAVAAPSRARGSGCRAGTGARGAGAEGREGEACGTVGLLLEHSFEIDDSANFRKRGSLLWNQQDGTLSLSQRQLSEEERGRLRDVAALNGLYRVRIPRRPGALDGLEAGGYVSSFVPACSLVESHLSDQLTLHVDVAGNVVGVSVVTHPGGCRGHEVEDVDLELFNTSVQLQPPTTAPGPETAAFIERLEMEQAQKAKNPQEQKSFFAKYWMYIIPVVLFLMMSGAPDTGGQGGGGGGGGGGGSGRPLSSAFCWQRSSWTGAFGTAAGVSCARLPHGPMQPQGLPPCPWSRARDPGHYASSDLASPYPEPMQSGNMPPSLQPLCLCSRWSHPPVPGWARWSCPGSCSAPLTLTLD

SEQ ID NO: 4726 - protein, 42 aa, Homo Sapiens
MAAASAGATRLLLLLLMAVAAPSRARGSGCRAGTGARGVSAL

SEQ ID NO: 4727 - protein, 42 aa, Homo Sapiens; identical to SEQ ID NO: 4726

SEQ ID NO: 4728 - protein, 89 aa, Homo Sapiens [sequence omitted]

SEQ ID NO: 4729 - protein, 94 aa, Homo Sapiens
MGEVEISALAYVKMCLHAARYPHAAVNGLFLAPAPRSGECLCLTDCVPLFHSHLALSVMLEVALNQVDVWGAQAGLVVAGYYHANAAVNDQSNI

SEQ ID NO: 4730 - protein, 208 aa, Homo Sapiens
MGEVEISALAYVKMCLHAARYPHAAVNGLFLAPAPRSGECLCLTDCVPLFHSHLALSVMLEVALNQVDVWGAQAGLVVAGYYHANAAVNDQSPGPLALKIAGRIAEFFPDAVLIMLDNQKLVPQPRVPPVIVLENQGLRWVPKDKNLVMWRDWEESRQMVGALLEDRAHQHLVDFDCHLDDIRQDWTNQRLNTQITQWVGPTNGNGNA

SEQ ID NO: 4731 - protein, 208 aa, Homo Sapiens; identical to SEQ ID NO: 4730

SEQ ID NO: 4732 - protein, 134 aa, Homo Sapiens
MGFAHSWLLTPLIFPLHSPGPLALKIAGRIAEFFPDAVLIMLDNQKLVPQPRVPPVIVLENQGLRWVPKDKNLVMWRDWEESRQMVGALLEDRAHQHLVDFDCHLDDIRQDWTNQRLNTQITQWVGPTNGNGNA

SEQ ID NO: 4733 - protein, 76 aa, Homo Sapiens
LMSTATFLTSKDEGLKATTTDVRKNDSIISNVTVTSVTLPNAVSTLQSSKPKTETQSSIKTTEIPGEHSAQGKTKN

SEQ ID NO: 4734 - protein, 248 aa, Homo Sapiens
MELLQVTILFLLPSICSSNSTGVLEAANNSLVVTTTKPSITTPNTESLQKNVVTPTTGTTPKGTITNELLKMSLMSTATFLTSKDEGLKATTTDVRKNDSIISNVTVTSVTLPNAVSTLQSSKPKSSVLQPDASPSKTGTLTSIPVTIPENTSQSQVIGTEGGKNASTSATSRSYSSIILPVVIALIVITLSVFVLVGLYRMCWKADPGTPENGNDQPQSDKESVKLLTVKTISHESGEHSAQGKTKN

SEQ ID NO: 4735 - protein, 165 aa, Homo Sapiens
MELLQVTILFLLPSICSSNSTGVLEAANNSLVVTTTKPSITTPNTESLQKNVVTPTTGTTPKGTITNELLKMSLMSTATFLTSKDEGLKATTTDVRKNDSIISNVTVTSVTLPNAVSTLQSSKPKTETQSSIKTTEIPGIILPVVIALIVITLSVFVLVGLYRMC

SEQ ID NO: 4736 - protein, 261 aa, Homo Sapiens
MELLQVTILFLLPSICSSNSTGVLEAANNSLVVTTTKPSITTPNTESLQKNVVTPTTGTTPKGTITNELLKMSLMSTATFLTSKDEGLKATTTDVRKNDSIISNVTVTSVTLPNAVSTLQSSKPKTETQSSIKTTEIPGSVLQPDASPSKTGTLTSIPVTIPENTSQSQVIGTEGGKNASTSATSRSYSSIILPVVIALIVITLSVFVLVGLYRMCWKADPGTPENGNDQPQSDKESVKLLTVKTISHESGEHSAQGKTKN

SEQ ID NO: 4737 - protein, 178 aa, Homo Sapiens
MELLQVTILFLLPSICSSNSTGVLEAANNSLVVTTTKPSITTPNTESLQKNVVTPTTGTTPKGTITNELLKMSLMSTATFLTSKDEGLKATTTDVRKNDSIISNVTVTSVTLPNAVSTLQSSKPKTETQSSIKTTEIPGTPENGNDQPQSDKESVKLLTVKTISHESGEHSAQGKTKN

SEQ ID NO: 4738 - protein, 34 aa, Homo Sapiens
MGGPRAWALLCLGLLLPGGGAAWSIGAAPFSGRR

SEQ ID NO: 4739 - protein, 175 aa, Homo Sapiens
MGGPRAWALLCLGLLLPGGGAAWSIGAAPFSGRRNWCSYVVTRTISCHVQNGTYLQRVLQNCPWPMSCPGSSYRTVVRPTYKVMYKIVTAREWRCCPGHSGVSCEEGCLNCSKVSELTERLKVLEAKMTMLTVIEQPVPPTPATPEDPAPLWGPPPAQGSPGDGGLQDQVGAWGL

SEQ ID NO: 4740 - protein, 443 aa, Homo Sapiens
MGGPRAWALLCLGLLLPGGGAAWSIGAAPFSGRRNWCSYVVTRTISCHVQNGTYLQRVLQNCPWPMSCPGSSYRTVVRPTYKVMYKIVTAREWRCCPGHSGVSCEEVAASSASLEPMWSGSTMRRMALRPTAFSGCLNCSKVSELTERLKVLEAKMTMLTVIEQPVPPTPATPEDPAPLWGPPPAQGSPGDGGLQDQVGAWGLPGPTGPKGDAGSRGPMGMRGPPGPQGPPGSPGRAGAVGTPGERGPPGPPGPPGPPGPPAPVGPPHARISQHGDPLLSNTFTETNNHWPQGPTGPPGPPGPMGPPGPPGPTGVPGSPGHIGPPGPTGPKGISGHPGEKGERGLRGEPGPQGSAGQRGEPGPKGDPGEKSHWGEGLHQLREALKILAERVLILETMIGLYEPELGSGAGPAGTGTPSLLRGKRGGHATNYRIVAPRSRDERG

SEQ ID NO: 4741 - protein, 422 aa, Homo Sapiens
MGGPRAWALLCLGLLLPGGGAAWSIGAAPFSGRRNWCSYVVTRTISCHVQNGTYLQRVLQNCPWPMSCPGSSYRTVVRPTYKVMYKIVTAREWRCCPGHSGVSCEEVAASSASLEPMWSGSTMRRMALRPTAFSGCLNCSKVSELTERLKVLEAKMTMLTVIEQPVPPTPATPEDPAPLWGPPPAQGSPGDGGLQDQVGAWGLPGPTGPKGDAGSRGPMGMRGPPGPQGPPGSPGRAGAVGTPGERGPPGPPGPPGPPGPPAPVGPPHARISQHGDPLLSNTFTETNNHWPQGPTGPPGPPGPMGPPGPPGPTGVPGSPGHIGLRGEPGPQGSAGQRGEPGPKGDPGEKSHWGEGLHQLREALKILAERVLILETMIGLYEPELGSGAGPAGTGTPSLLRGKRGGHATNYRIVAPRSRDERG

SEQ ID NO: 4742 - protein, 445 aa, Homo Sapiens
MGGPRAWALLCLGLLLPGGGAAWSIGAAPFSGRRNWCSYVVTRTISCHVQNGTYLQRVLQNCPWPMSCPGSSYRTVVRPTYKVMYKIVTAREWRCCPGHSGVSCEEVAASSASLEPMWSGSTMRRMALRPTAFSGCLNCSKVSELTERLKVLEAKMTMLTVIEQPVPPTPATPEDPAPLWGPPPAQGSPGDGGLQDQVGAWGLPGPTGPKGDAGSRGPMGMRGPPGPQGPPGSPGRAGAVGTPGERGPPGPPGPPGPPGPPAPVGPPHARISQHGDPLLSNTFTETNNHWPQGPTGPPGPPGPMGPPGPPGPTGVPGSPGHIGPPGPTGPKGISGHPGEKGERGLRGEPGPQGSAGQRGEPGPKGDPGEKSHWAPSLQSFLQQQAQLELLARRVTLLEAIIWPEPELGSGAGPAGTGTPSLLRGKRGGHATNYRIVAPRSRDERG

SEQ ID NO: 4743 - protein, 212 aa, Homo Sapiens
MGGPRAWALLCLGLLLPGGGAAWSIGAAPFSGRRNWCSYVVTRTISCHVQNGTYLQRVLQNCPWPMSCPGSSYRTVVRPTYKVMYKIVTAREWRCCPGHSGVSCEEVAASSASLEPMWSGSTMRRMALRPTAFSGCLNCSKVSELTERLKVLEAKMTMLTVIEQPVPPTPATPEDPAPLWGPPPAQGSPGDGGLQGDPLLSNTFTETNNHWP

SEQ ID NO: 4744 - protein, 236 aa, Homo Sapiens
  misc_feature (1)..(1): Xaa can be any naturally occurring amino acid
XMTMLTVIEQPVPPTPATPEDPAPLWGPPPAQGSPGDGGLQGLPGAIESVRVPLLPRNDQVGAWGLPGPTGPKGDAGSRGPMGMRGPPGPQGPPGSPGRAGAVGTPGERGPPGPPGPPGPPGPPAPVGPPHARISQHGDPLLSNTFTETNNHWPQGPTGPPGPPGPMGPPGPPGPTGVPGSPGHIGPPGPTGPKGISGHPGEKGERGLRGEPGPQGSAGQRGEPGPKGDPGEKSHW

SEQ ID NO: 4745 - protein, 1016 aa, Homo Sapiens
MAPRTLWSCYLCCLLTAAAGAASYPPRGFSLYTGSSGALSPGGPQAQIAPRPASRHRNWCAYVVTRTVSCVLEDGVETYVKYQPCAWGQPQCPQSIMYRRFLRPRYRVAYKTVTDMEWRCCQGYGGDDCAESPAPALGPASSTPRPLARPARPNLSGSSAGSPLSGLGGEGPGESEKVQQLEEQVQSLTKELQGLRGVLQGLSGRLAEDVQRAVETAFNGRQQPADAAARPGVHETLNEIQHQLQLLDTRVSTHDQELGHLNNHHGGSSSSGGSRAPAPASAPPGPSEELLRQLEQRLQESCSVCLAGLDGFRRQQQEDRERLRAMEKLLASVEERQRHLAGLAVGRRPPQECCSPELGRRLAELERRLDVVAGSVTVLSGRRGTELGGAAGQGGHPPGYTSLASRLSRLEDRFNSTLGPSEEQEESWPGAPGGLSHWLPAARGRLEQLGGLLANVSGELGGRLDLLEEQVAGAMQACGQLCSGAPGEQDSQVSEILSALERRVLDSEGQLRLVGSGLHTVEAAGEARQATLEGLQEVVGRLQDRVDAQDETAAEFTLRLNLTAARLGQLEGLLQAHGDEGCGACGGVQEELGRLRDGVERCSCPLLPPRGPGAGPGVGGPSRGPLDGFSVFGGSSGSALQALQGELSEVILSFSSLNDSLNELQTTVEGQGADLADLGATKDRIISEINRLQQEATEHATESEERFRGLEEGQAQAGQCPSLEGRLGRLEGVCERLDTVAGGLQGLREGLSRHVAGLWAGLRETNTTSQMQAALLEKLVGGQAGLGRRLGALNSSLQLLEDRLHQLSLKDLTGPAGEAGPPGPPGLQGPPGPAGPPGSPGKDGQEGPIGPPGPQGEQGVEGAPAAPVPQVAFSAALSLPRSEPGTVPFDRVLLNDGGYYDPETGVFTAPLAGRYLLSAVLTGHRHEKVEAVLSRSNQGVARVDSGGYEPEGLENKPVAESQPSPGTLGVFSLILPLQAGDTVCVDLVMGQLAHSEEPLTIFSGALLYGDPELEHA

SEQ ID NO: 4746 - protein, 347 aa, Homo Sapiens
  misc_feature (1)..(1): Xaa can be any naturally occurring amino acid
XADLGATKDRIISEINRLQQEATEHATESEERFRGLEEGQAQAGQCPSLEGRLGRLEGVCERLDTVAGGLQGLREGLSRHVAGLWAGLRETNTTSQMQAALLEKLVGGQAGLGRRLGALNSSLQLLEDRLHQLSLKDLTGEGTKGPAGEAGPPGPPGLQGPPGPAGPPGSPGKDGQEGPIGPPGPQGEQGVEGAPAAPVPQVAFSAALSLPRSEPGTVPFDRVLLNDGGYYDPETGVFTAPLAGRYLLSAVLTGHRHEKVEAVLSRSNQGVARVDSGGYEPEGLENKPVAESQPSPGTLGVFSLILPLQAGDTVCVDLVMGQLAHSEEPLTIFSGALLYGDPELEHA

SEQ ID NO: 4747 - protein, 1053 aa, Homo Sapiens
MWQPRRPWPRVPWRWALALLALVGAGLCHAGPQPGYPARPSARNKNWCAYIVNKNVSCSVLEGSESFIQAQYNCAWNQMPCPSALVYRVNFRPRYVTRYKTVTQLEWRCCPGFRGGDCQEGPKDPVKTLRPTPARPRNSLKKATDNEPSQFSEPRKTLSPTGTAQPSWGVDPKEGPQELQEKKIQVLEEKVLRLTRTVLDLQSSLAGVSENLKHATQDDASRTRAPGLSSQHPKPDTTVSGDTETGQSPGVFNTKESGMKDIKSELAEVKDTLKNKSDKLEELDGKVKGYEGQLRQLQEAAQGPTVTMTTNELYQAYVDSKIDALREELMEGMDRKLADLKNSCEYKLTGLQQQCDDYGSSYLGVIELIGEKETSLRKEINNLRARLQEPSAQANCCDSEKNGDIGQQIKTLDQKIERVAEATRMLNGRLDNEFDRLIVPEPDVDFDAKWNELDARINVTEKNAEEHCFYIEETLRGAINGEVGDLKQLVDQKIQSLEDRLGSVLLQMTNNTGAELSPPGAAALPGVSGSGDERVMMELNHLKDKVQVVEDICLLNIQGKPHGMEGALPNREDRAVRDSLHLLKSLNDTMHRKFQETEQTIQKLQQDFSFLYSQLNHTENDVTHLQKEMSNCRAGENAGMGRFTKVGEQERTVDTLPSPQHPVAHCCSQLEERWQRLQSQVISELDACKECTQGVQREVSMVEGRVSHMEKTCSKLDSISGNLQRIKEGLNKHVSSLWNCVRQMNGTLRSHSRDISGLKNSVQQFYSHVFQISTDLQDLVKFQPSAKAPSPPPPAEAPKEPLQPEPAPPRPSGPATAEDPGRRPVLPQRPPEERPPQPPGSTGVIAETGQAGPPAGAGVSGRGLPRGVDGQTGSGTVPGAEGFAGAPGYPKSPPVASPGAPVPSLVSFSAGLTQKPFPSDGGVVLFNKVLVNDGDVYNPSTGVFTAPYDGRYLITATLTPERDAYVEAVLSVSNASVAQLHTAGYRREFLEYHRPPGALHTCGGPGAFHLIVHLKAGDAVNVVVTGGKLAHTDFDEMYSTFSGVFLYPFLSHL

SEQ ID NO: 4748 - protein, 766 aa, Homo Sapiens
MGRRRLLVWLCAVAALLSGAQARGTPLLARPAPPGASRYSLYTTGWRPRLRPGPHKALCAYVVHRNVTCILQEGAESYVKAEYRQCRWGPKCPGTVTYRTVLRPKYKVGYKTVTDLAWRCCPGFTGKRCPEHLTDHGAASPQLEPEPQIPSGQLDPGPRPPSYSRAAPSPHGRKGPGLFGERLERLEGDVQRLAQTYGTLSGLVASHEDPNRMTGGPRAPAVPVGFGVIPEGLVGPGDRARGPLTPPLDEILSKVTEVSNTLQTKVQLLDKVHGLALGHEAHLQRLREAPPSPLTSLALLEEYVDRRLHRLWGSLLDGFEQKLQGVQSECDLRVQEVRRQCEEGQAASRRLHQSLDGRELALRQELSQLGSQLQGLSVSGRGSCCGQLALINARMDGLERALQAVTETQRGPGAPAGDELTRLSAAMLEGGVDGLLEGLETLNGTEGGARGCCLRLDMGGWGVGGFGTMLEERVQSLEERLATLAGELSHDSASPGRSARPLVQTELAVLEQRLVSLETSCTPSTTSAILDSLVAEVKAWQSRSEALLRQVASHAALLQQLNGTVAEVQGQLAEGTGSSLQGEITLLKVNLNSVSKSLTGLSDSVSQYSDAFLAANTSLDERERKVEAEVQAIQEQVSSQGSRLQAGHRQVLNLRGELEQLKAGVAKVASGLSRCQDTAQKLQHTVGHFDQRVAQVEGACRRLGLLAAGLDSLPTEPLRPREGLWSHVDQLNRTLAQHTQDIARLRDDLLDCQAQLAEQVRPGQAN

SEQ ID NO: 4749 - protein, 1142 aa, Homo Sapiens
MLVLRCRLGTSFPKLDNLVPKGKMKILLVFLGLLGNSVAMPMHMPRMPGFSSKSEEMMRYNQFNFMNGPHMAHLGPFFGNGLPQQFPQYQMPMWPQPPPNTWHPRKSSAPKRHNKTDQTQETQKPNQTQSKKPPQKRPLKQPSHNQPQPEEEAQPPQAFPPFGNGLFPYQQPPWQIPQRLPPPGYGRPPISNEEGGNPYFGYFGYHGFGGRPPYYSEEMFEQDFEKPKEEDPPKAESPGTEPTANSTVTETNSTQPNPKGSQGGNDTSPTGNSTPGLNTGNNPPAQNGIGPLPAVNASGQGGPGSQIPWRPSQPNIRENHPYPNIRNFPSGRQWYFTGTVMGHRQNRPFYRNQQVQRGPRWNFFAWERKQVARPGNPVYHKAYPPTSRGNYPNYAGNPANLRRKPQGPNKHPVGTTVAPLGPKPGPVVRNEKIQNPKEKPLGPKEQIIVPTKNPTSPWRNSQQYEVNKSNYKLPHSEGYMPVPNFNSVDQHENSYYPRGDSRKVPNSDGQTQSQNLPKGIVLGSRRMPYESETNQSELKHSSYQPAVYPEEIPSPAKEHFPAGRNTWDHQEISPPFKEDPGRQEEHLPHPSHGSRGSVFYPEYNPYDPRENSPYLRGNTWDERDDSPNTMGQKESPLYPINTPDQKEIVPYNEEDPVDPTGDEVFPGQNRWGEELSFKGGPTVRHYEGEQYTSNQPKEYLPYSLDNPSKPREDFYYSEFYPWSPDENFPSYNTASTMPPPIESRGYYVNNAAGPEESTLFPSRNSWDHRIQAQGQRERRPYFNRNIWDQATHLQKAPARPPDQKGNQPYYSNTPAGLQKNPIWHEGENLNYGMQITRMNSPEREHSSFPNFIPPSYPSGQKEAHLFHLSQRGSCCAGSSTGPKDNPLALQDYTPSYGLAPGENQDTSPLYTDGSHTKQTRDIISPTSILPGQRNSSEKRESQNPFRDDVSTLRRNTPCSIKNQLGQKEIMPFPEASSLQSKNTPCLKNDLGGDGNNILEQVFEDNQLNERTVDLTPEQLVIGTPDEGSNPEGIQSQVQENESERQQQRPSNILHLPCFGSKLAKHHSSTTGTPSSDGRQSPFDGDSITPTENPNTLVELATEEQFKSINVDPLDADEHSPFEFLQRGTNVQDQVQDCLLLQA

SEQ ID NO: 4750 - protein, 297 aa, Homo Sapiens
MRALRAGLTLASGAGLGAVVEGWRRRREDARAAPGLLGRLPVLPVAAAAELPPVPGGPRGPGELAKYGLPGLAQLKSRESYVLCYDPRTRGALWVVEQLRPERLRGDGDRRECDFREDDSVHAYHRATNADYRGSGFDRGHLAAAANHRWSQKAMDDTFYLSNVAPQVPHLNQNAWNNLEKYSRSLTRSYQNVYVCTGPLFLPRTEADGKSYVKYQVIGKNHVAVPTHFFKVLILEAAGGQIELRTYVMPNAPVDEAIPLERFLVPIESIERASGLLFVPNILARAGSLKAITAGSK

SEQ ID NO: 4751 - protein, 347 aa, Homo Sapiens
MRACISLVLAVLCGLAWADLYSAPTSCQGRCYEAFDKHHQCHCNARCQEFGNCCKDFESLCSDHEVSHSSDAITKEEIQSISEKIYRADTNKAQKEDIVLNSQNCISPSETRNQVDRCPKPLFTYVNEKLFSKPTYAAFINLLNNYQRATGHGEHFSAQELAEQDAFLREIMKTAVMKELYSFLHHQNRYGSEQEFVDDLKNMWFGLYSRGNEEGDSSGFEHVFSGEVKKGKVTGFHNWIRFYLEEKEGLVDYYSHIYDGPWDSYPDVLAMQFNWDGYYKEVGSAFIGSSPEFEFALYSLCFIARPGKVCQLSLGGYPLAVRTYTWDKSTYGNGKKYIATAYIVSST

SEQ ID NO: 4752 - protein, 369 aa, Homo Sapiens
MRACISLVLAVLCGLAWAEDHKESEPLPQLEEETEEALASNLYSAPTSCQGRCYEAFDKHHQCHCNARCQEFGNCCKDFESLCSDHEVSHSSDAITKEEIQSISEKIYRADTNKAQKEDIVLNSQNCISPSETRNQVDRCPKPLFTYVNEKLFSKPTYAAFINLLNNYQRATGHGEHFSAQELAEQDAFLREIMKTAVMKELYSFLHHQNRYGSEQEFVDDLKNMWFGLYSRGNEEGDSSGFEHVFSGEVKKGKVTGFHNWIRFYLEEKEGLVDYYSHIYDGPWDSYPDVLAMQFNWDGYYKEVGSAFIGSSPEFEFALYSLCFIARPGKVCQLSLGGYPLAVRTYTWDKSTYGNGKKYIATAYIVSST

SEQ ID NO: 4753 - protein, 410 aa, Homo Sapiens
MRACISLVLAVLCGLAWAGKIESCASRCNEKFNRDAACQCDRRCLWHGNCCEDYEHLCTEDHKESEPLPQLEEETEEALASNLYSAPTSCQGRCYEAFDKHHQCHCNARCQEFGNCCKDFESLCSDHEVSHSSDAITKEEIQSISEKIYRADTNKAQKEDIVLNSQNCISPSETRNQVDRCPKPLFTYVNEKLFSKPTYAAFINLLNNYQRATGHGEHFSAQELAEQDAFLREIMKTAVMKELYSFLHHQNRYGSEQEFVDDLKNMWFGLYSRGNEEGDSSGFEHVFSGEVKKGKVTGFHNWIRFYLEEKEGLVDYYSHIYDGPWDSYPDVLAMQFNWDGYYKEVGSAFIGSSPEFEFALYSLCFIARPGKVCQLSLGGYPLAVRTYTWDKSTYGNGKKYIATAYIVSST

SEQ ID NO: 4754 - protein, 76 aa, Homo Sapiens
MGAAISQGALIAIVCNGLVGFLLLLLWVILCWACHSRSADVDSLSESSPNSSPGPCPEKAPPPQKPSHEGSYLLQP

SEQ ID NO: 4755 - protein, 363 aa, Homo Sapiens
MAIGAVSLAVAKACAMLLNKPLYLNIALLKHNQEQPTTLSMPLLMVSLVSCGKSSSGKLNLMKEVICIPHPELTTKQGVEMLMEMQKHINKIIEMPSPPKAETKKGHDGSKRGQQQITGKMSHLGCLTINCDSIEQPLLLIQEICANLGLELGTNLHLAINCAGHELMDYNKGKYEVIMGTYKNAAEMVDLYVDLINKYPSIIALIDPFRKEDSEQWDSIYHALGSRCYIIAGTASKSISKLLEQGNISIPKSNGLIIKHTNQTTMSDLVEITNLIDSKKHITVFGSTEGESSDDSLVDLAVGLGVRFIKLGGLSRGERVTKYNRLLTIEEELVQNGTLATSSSSCDARIGGQEQETMTLVKV

SEQ ID NO: 4756 - protein, 625 aa, Homo Sapiens
MEEEGGGRSCGTTRELQKLKQQAMEYYRENDVPRRLEELLNSTFYLQPADVYGHLANCFSKLAKPPTICKIVGKDVLDGLGLPTLQVDIFCTIQNFPKNVCSVVISTHFEVHENALPELAKAEEAERASAVSTAVQWVNSTITHELQGMAPSDQAEVDHLLRIFFASKVQEDKGRKELEKSLEYSTVPTPLPPVPPPPPPPPPTKKKGQKPGRKDTITEKPIAPAEPVEPVLSGSMAIGAVSLAVAKACAMLLNKPLYLNIALLKHNQEQPTTLSMPLLMVSLVSCGKSSSGKLNLMKEVICIPHPELTTKQGVEMLMEMQKHINKIIEMPSPPKAETKKGHDGSKRGQQQITGKMSHLGCLTINCDSIEQPLLLIQEICANLGLELGTNLHLAINCAGHELMDYNKGKYEVIMGTYKNAAEMVDLYVDLINKYPSIIALIDPFRKEDSEQWDSIYHALGSRCYIIAGTASKSISKLLEQGNISIPKSNGLIIKHTNQTTMSDLVEITNLIDSKKHITVFGSTEGESSDDSLVDLAVGLGVRFIKLGGLSRGERVTKYNRLLTIEEELVQNGTLGFKEEHTFFYFNEEAEKAAEALEAAAAREPLVPTFPTQGVEESAETGASSG

SEQ ID NO: 4757 - protein, 628 aa, Homo Sapiens [sequence omitted]

SEQ ID NO: 4758 - protein, 308 aa, Homo Sapiens
MEEEGGGRSCGTTRELQKLKQQAMEYYRENDVPRRLEELLNSTFYLQPADVYGHLPSPPKAETKKGHDGSKRGQQQITGKMSHLGCLTINCDSIEQPLLLIQEICANLGLELGTNLHLAINCAGHELMDYDSEQWDSIYHALGSRCYIIAGTASKSISKLLEQGNISIPKSNGLIIKHTNQTTMSDLVEITNLIDSKKHITVFGSTEGESSDDSLVDLAVGLGVRFIKLGGLSRGERVTKYNRLLTIEEELVQNGTLGFKEEHTFFYFNEEAEKAAEALEAAAAREPLVPTFPTQGVEESAETGASSG

SEQ ID NO: 4759 - protein, 138 aa, Homo Sapiens
  misc_feature (1)..(1): Xaa can be any naturally occurring amino acid
XGRSCGTTRELQKLKQQAMEYYRENDVPRRLEELLNSTFYLQPADVYGHLANCFSKLAKPPTICKIVGKDVLDGLGLPTLQVDIFCTIQNFPKNVCSVVISTHFEVHENALPELAKAEEAERASAVSTAVQWVNSTIT

SEQ ID NO: 4760 - protein, 440 aa, Homo Sapiens
MAVKLGTLLLALALGLAQPASARRKLLVFLLDGFRSDYISDEALESLPGFKEIVSRGVKVDYLTPDFPSLSYPNYYTLMTGRHCEVHQMIGNYMWDPTTNKSFDIGVNKDSLMPLWWNGSEPLWVTLTKAKRKVYMYYWPGCEVEILGVRPTYCLEYKNVPTDINFANAVSDALDSFKSGRADLAAIYHERIDVEGHHYGPASPQRKDALKAVDTVLKYMTKWIQERGLQDRLNVIIFSDHGMTDIFWMDKVIELNKYISLNDLQQVKDRGPVVSLWPAPGKHSEIYNKLSTVEHMTVYEKEAIPSRFYYKKGKFVSPLTLVADEGWFITENREMLPFWMNSTGRREGWQRGWHGYDNELMDMRGIFLAFGPDFKSNFRAAPIRSVDVYNVMCNVVGITPLPNNGSWSRVMCMLKGRASTAPPVWPSHCALALILLFLLA

SEQ ID NO: 4761 - protein, 194 aa, Homo Sapiens
MIGNYMWDPTTNKSFDIGVNKDSLMPLWWNGSEPLWVTLTKAKRKVYMYYWPGCEVEILGVRPTYCLEYKNVPTDINFANAVSDALDSFKSGRADLAAIYHERIDVEGHHYGPASPQRKDALKAVDTVLKYMTKWIQERGLQDRLNVIIFSDHGMTDIFWMDKVIELNKYISLNDLQQVKDRGPVVSLWPAPGK

SEQ ID NO: 4762 - protein, 159 aa, Homo Sapiens
LKDAHPKLHVYKKEAFPEAFHYANNPRVTPLLMYSDLGYVIHGRINVQFNNGEHGFDNKDMDMKTIFRAVGPSFRAGLEVEPFESVHVYELMCRLLGIVPEANDGHLATLLPMLHTESALPPDGRPTLLPKGRSALPPSSRPLLVMGLLGTVILLSEVA

SEQ ID NO: 4763 - protein, 458 aa, Homo Sapiens
MRGPAVLLTVALATLLAPGAGAPVQSQGSQNKLLLVSFDGFRWNYDQDVDTPNLDAMARDGVKARYMTPAFVTMTSPCHFTLVTGKYIENHGVVHNMYYNTTSKVKLPYHATLGIQRWWDNGSVPIWITAQRQGLRAGSFFYPGGNVTYQGVAVTRSRKEGIAHNYKNETEWRANIDTVMAWFTEEDLDLVTLYFGEPDSTGHRYGPESPERREMVRQVDRTVGYLRESIARNHLTDRLNLIITSDHGMTTVDKRAGDLVEFHKFPNFTFRDIEFELLDYGPNGMLLPKEGRLEKVYDALKDAHPKLHVYKKEAFPEAFHYANNPRVTPLLMYSDLGYVIHGRINVQFNNGEHGFDNKDMDMKTIFRAVGPSFRAGLEVEPFESVHVYELMCRLLGIVPEANDGHLATLLPMLHTESALPPDGRPTLLPKGRSALPPSSRPLLVMGLLGTVILLSEVA

SEQ ID NO: 4764 - protein, 91 aa, Homo Sapiens
MATSWGTVFFMLVVSCVCSAVSHRNQQTWFEGIFLSSMCPINVSASTLYGIMFDAGSTGTRIHVYTFVQKMPGHLWSLGKGGGVRCPPEKW

SEQ ID NO: 4765 - protein, 211 aa, Homo Sapiens
MATSWGTVFFMLVVSCVCSAVSHRNQQTWFEGIFLSSMCPINVSASTLYGIMFDAGSTGTRIHVYTFVQKMPGQLPILEGEVFDSVKPGLSAFVDQPKQGAETVQGLLEVAKDSIPRSHWKKTPVVLKATAGLRLLPEHKAKALLFEVKEIFRKSPFLVPKGSVSIMDGSDEGILAWVTVNFLTGQLHGHRQETVGTLDLGGASTQITFLP

SEQ ID NO: 4766 - protein, 428 aa, Homo Sapiens
MATSWGTVFFMLVVSCVCSAVSHRNQQTWFEGIFLSSMCPINVSASTLYGIMFDAGSTGTRIHVYTFVQKMPGQLPILEGEVFDSVKPGLSAFVDQPKQGAETVQGLLEVAKDSIPRSHWKKTPVVLKATAGLRLLPEHKAKALLFEVKEIFRKSPFLVPKGSVSIMDGSDEGILAWVTVNFLTGQLHGHRQETVGTLDLGGASTQITFLPQFEKTLEQTPRGYLTSFEMFNSTYKLYTHSYLGFGLKAARLATLGALETEGTDGHTFRSACLPRWLEAEWIFGGVKYQYGGNQEGEVGFEPCYAEVLRVVRGKLHQPEEVQRGSFYAFSYYYDRAVDTDMIDYEKGGILKVEDFERKAREVCDNLENFTSGSPFLCMDLSYITALLKDGFGFADSTVLQLTKKVNNIETGWALGATFHLLQSLGISH

SEQ ID NO: 4767 - protein, 407 aa, Homo Sapiens
MATSWGTVFFMLVVSCVCSAVSHRNQQTWFEGIFLSSMCPINVSASTLYGIMFDAGSTGTRIHVYTFVQKMPGQLPILEGEVFDSVKPGLSAFVDQPKQGAETVQGLLEVAKDSIPRSHWKKTPVVLKATAGLRLLPEHKAKALLFEVKEIFRKSPFLVPKGSVSIMDGSDEGILAWVTVNFLTGQLHGHRQETVGTLDLGGASTQITFLPQFEKTLEQTPRGYLTSFEMFNSTYKLYTHSYLGFGLKAARLATLGALETEGTDGHTFRSACLPRWLEAEWIFGGVKYQYGGNQEGEVGFEPCYAEVLRVVRGKLHQPEEVQRGSFYAFSYYYDRAVDTDMIDYEKGGILKVEDFERKAREVCDNLENFTSGSPFLCMDLSYITALLKDGFGFADSTVLQHIISWVN

SEQ ID NO: 4768 - protein, 80 aa, Homo Sapiens
  misc_feature (1)..(1): Xaa can be any naturally occurring amino acid
XYAFSYYYDRAVDTDMIDYEKGGILKVEDFERKAREVCDNLENFTSGSPFLCMDLSYITALLKDGFGFADSTVLQAAVLR

SEQ ID NO: 4769 - protein, 223 aa, Homo Sapiens
LGASGVSGLTALILLLVEATSVLLPTDIKFGIVFDAGSSHTSLFLYQWLANKENGTGVVSQALACQVEGPGISSYTSNAAQAGESLQGCLEEALVLIPEAQHRKTPTFLGATAGMRLLSSHPGPGPVSRGLLGCRAPGRAGRRCLWLDHCQLRLGDAGQVLLHWRMDPASGGDAGGCPGHGRGLHPDHVRAWGPHLGQEHPGRFSPLRLRLQRLHSQLPVLWT

SEQ ID NO: 4770 - protein, 458 aa, Homo Sapiens
MGLSRKEQVFLALLGASGVSGLTALILLLVEATSVLLPTDIKFGIVFDAGSSHTSLFLYQWLANKENGTGVVSQALACQVEGPGISSYTSNAAQAGESLQGCLEEALVLIPEAQHRKTPTFLGATAGMRLLSRKNSSQARDIFAAVTQVLGRSPVDFWGAELLAGQAEGAFGWITVNYGLGTLVKYSFTGEWIQPPEEMLVGALDMGGASTQITFVPGGPILDKSTQADFRLYGSDYSVYTHSYLCFGRDQMLSRLLVGLVQSRPAALLRHPCYLSGYQTTLALGPLYESPCVHATPPLSLPQNLTVEGTGNPGACVSAIRELFNFSSCQGQEDCAFDGVYQPPLRGQFYVEASYPGQDRWLRDYCASGLYILTLLHEGYGFSEETWPSLEFRKQAGGVDIGWTLGYMLNLTGMIPADAPAQWRAESYGVWVAKVVFMVLALVAVVGAALVQLFWLQD

SEQ ID NO: 4771 - protein, 495 aa, Homo Sapiens
MGLSRKEQVFLALLGASGVSGLTALILLLVEATSVLLPTDIKFGIVFDAGSSHTSLFLYQWLANKENGTGVVSQALACQVEGPGISSYTSNAAQAGESLQGCLEEALVLIPEAQHRKTPTFLGATAGMRLLSRKNSSQARDIFAAVTQVLGRSPVDFWGAELLAGQAEGAFGWITVNYGLGTLVKYSFTGEWIQPPEEMLVGALDMGGASTQITFVPGGPILDKSTQADFRLYGSDYSVYTHSYLCFGRDQMLSRLLVGLVQSRPAALLRHPCYLSGYQTTLALGPLYESPCVHATPPLSLPQNLTVEGTGNPGACVSAIRELFNFSSCQGQEDCAFDGVYQPPLRGQFYAFSNFYYTFHFLNLTSRQPLSTVNATIWEFCQRPWKLVEASYPGQDRWLRDYCASGLYILTLLHEGYGFSEETWPSLEFRKQAGGVDIGWTLGYMLNLTGMIPADAPAQWRAESYGVWVAKVVFMVLALVAVVGAALVQLFWLQD

SEQ ID NO: 4772 - protein, 495 aa, Homo Sapiens; identical to SEQ ID NO: 4771

SEQ ID NO: 4773 - protein, 135 aa, Homo Sapiens
MISAHCNLCLLDSSDSCALASQVAGITGVHHHAQLIFVFLIETEFHHVGQAGLELWVQEILPPCLPKCWDYRCEPPRMALNFLFLGIPKFSTFSALEFVNIFVEYHMTVIPECSNLFMIYLGKFTTVLLFAIIWL

SEQ ID NO: 4774 - protein, 124 aa, Homo Sapiens
MLMLFVFGVLLHEVSLSGQNEAPPNTHSIPGEPLYNYASIRLPEEHIPFFLHNNRHIATVCRKDSLCPYKKHLEKLKYCWGYEKSCKPEFRFGYPVCSYVDMGWTDTLESAEDIFWKQADFGYA

SEQ ID NO: 4775 - protein, 132 aa, Homo Sapiens
MLMLFVFGVLLHEVSLSGQNEAPPNTHSIPGEPLYNYASIRLPEEHIPFFLHNNRHIATVCRKDSLCPYKKHLEKLKYCWGYEKSCKPEFRFGYPVCSYVDMGWTDTLESAEDIFWKQADFGYARERLEEMH

SEQ ID NO: 4776 - protein, 206 aa, Homo Sapiens
MLMLFVFGVLLHEVSLSGQNEAPPNTHSIPGEPLYNYASIRLPEEHIPFFLHNNRHIATVCRKDSLCPYKKHLEKLKYCWGYEKSCKPEFRFGYPVCSYVDMGWTDTLESAEDIFWKQADFGYARERLEEMHVLCQPKETSDSSLVCSRYLQYCRATNLYLDLRNIKRNHDRFKEDFFQSGEIGGHCKLDIRTLTSEGQRKSPLQS

SEQ ID NO: 4777 - protein, 443 aa, Homo Sapiens
MLMLFVFGVLLHEVSLSGQNEAPPNTHSIPGEPLYNYASIRLPEEHIPFFLHNNRHIATVCRKDSLCPYKKHLEKLKYCWGYEKSCKPEFRFGYPVCSYVDMGWTDTLESAEDIFWKQADFGYARERLEEMHVLCQPKETSDSSLVCSRYLQYCRATNLYLDLRNIKRNHDRFKEDFFQSGEIGGHCKLDIRTLTSEGQRKSPLQSWFAELQSYTQLNFRPIEDAKCDIVIEKPTYFMKLDAGVNMYHHFCDFINLYITQHVNNSFSTDVYIVMWDTDGKIRVTILARSTEYRKILNQNELVNALKTVSTFEVQIVDYKYRELGFLDQLRITHNTDIFIGMHGAGLTHLLFLPDWAAVFELYNCEDERCYLDLARLRGVHYITWRRQNKVFPQDKGHHPTLGEHPKFTNYSFDVEEFMYLVLQAADHVLQHPKWPFKKKHDEL

SEQ ID NO: 4778 - protein, 527 aa, Homo Sapiens
MLMLFVFGVLLHEVSLSGQNEAPPNTHSIPGEPLYNYASIRLPEEHIPFFLHNNRHIATVCRKDSLCPYKKHLEKLKYCWGYEKSCKPEFRFGYPVCSYVDMGWTDTLESAEDIFWKQADFGYARERLEEMHVLCQPKETSDSSLVCSRYLQYCRATNLYLDLRNIKRNHDRFKEDFFQSGEIGGHCKLDIRTLTSEGQRKSPLQSWFAELQSYTQLNFRPIEDAKCDIVIEKPTYFMKLDAGVNMYHHFCDFINLYITQHVNNSFSTDVYIVMWDTSSYGYGDLFSDTWNAFTDYDVIHLKTYDSKRVCFKEAVFSLLPRMRYGLFYNTPLISGCQNTGLFRAFAQHVLHRLNITQEGPKDGKIRVTILARSTEYRKILNQNELVNALKTVSTFEVQIVDYKYRELGFLDQLRITHNTDIFIGMHGAGLTHLLFLPDWAAVFELYNCEDERCYLDLARLRGVHYITWRRQNKVFPQDKGHHPTLGEHPKFTNYSFDVEEFMYLVLQAADHVLQHPKWPFKKKHDEL

SEQ ID NO: 4779 - protein, 443 aa, Homo Sapiens; identical to SEQ ID NO: 4777

SEQ ID NO: 4780 - protein, 527 aa, Homo Sapiens; identical to SEQ ID NO: 4778

SEQ ID NO: 4781 - protein, 314 aa, Homo Sapiens
MAPPQVLAFGLLLAAATATFAAAQEECVCENYKLAVNCFVNNNRQCQCTSVGAQNTVICSKLAAKCLVMKAEMNGSKLGRRAKPEGALQNNDGLYDPDCDESGLFKAKQCNGTSMCWCVNTAGVRRTDKDTEITCSERVRTYWIIIELKHKAREKPYDSKSLRTALQKEITTRYQLDPKFITSILYENNVITIDLVQNSSQKTQNDVDIADVAYYFEKDVKGESLFHSKKMDLTVNGEQLDLDPGQTLIYYVDEKAPEFSMQGLKAGVIAVIVVVVIAVVAGIVVLVISRKKRMAKYEKAEIKEMGEMHRELNA

SEQ ID NO: 4782 - protein, 199 aa, Homo Sapiens
MAPPQVLAFGLLLAAATATFAAAQEGEARIGAELWSWAGLGGSGPRPSAPETGIIGRGPRGRAFQRGDRTVRPCSGSGPPRGRKRRGPSRGAASLRSFARLECVCENYKLAVNCFVNNNRQCQCTSVGAQNTVICSKLAAKCLVMKAEMNGSKLGRRAKPEGALQNNDGLYDPDCDESGLFKAKQCNGTSMCWCVNTAG

SEQ ID NO: 4783 - protein, 342 aa, Homo Sapiens
METKHLGRGGAGRAGPHLWRGPRPNCSAGAGGGEPTHSPNSRAVTHQRAPAARECVCENYKLAVNCFVNNNRQCQCTSVGAQNTVICSKLAAKCLVMKAEMNGSKLGRRAKPEGALQNNDGLYDPDCDESGLFKAKQCNGTSMCWCVNTAGVRRTDKDTEITCSERVRTYWIIIELKHKAREKPYDSKSLRTALQKEITTRYQLDPKFITSILYENNVITIDLVQNSSQKTQNDVDIADVAYYFEKDVKGESLFHSKKMDLTVNGEQLDLDPGQTLIYYVDEKAPEFSMQGLKAGVIAVIVVVVIAVVAGIVVLVISRKKRMAKYEKAEIKEMGEMHRELNA

SEQ ID NO: 4784 - protein, 342 aa, Homo Sapiens; identical to SEQ ID NO: 4783

SEQ ID NO: 4785 - protein, 122 aa, Homo Sapiens
MFQIDQATKQCSKMTLTQPWDPLDIPQNSTFEDQYSIGGPQEQITVQEWSDRKSARSYETWIGIYTVKDCYPVQETFTINYSVILSTRFFDIQLGIKDPSVFTPPSTCQMAQLEKMSEDCSW

SEQ ID NO: 4786 - protein, 90 aa, Homo Sapiens
MPGRAPLRTVPGALGAWLLGGLWAWTLCGLCSLGAVGAPRPCQAPQQWEGRQVMYQQSSGRNSRALLSYDGLNQRVRVLDERKALIPCKR

SEQ ID NO: 4787 - protein, 224 aa, Homo Sapiens
MPGRAPLRTVPGALGAWLLGGLWAWTLCGLCSLGAVGAPRPCQAPQQWEGRQVMYQQSSGRNSRALLSYDGLNQRVRVLDERKALIPCKRLFEYILLYKDGVMFQIDQATKQCSKMTLTQPWDPLDIPQNSTFEDQYSIGGPQEQITVQEWSDRKSARSYETWIGIYTVKDCYPVQETFTINYSVILSTRFFDIQLGIKDPSVFTPPSTCQMAQLEKMSEDCSW

SEQ ID NO: 4788 - protein, 163 aa, Homo Sapiens
MVRDWEGRCAHRGRPAGGGLSNTQRGGGRLFEYILLYKDGVMFQIDQATKQCSKMTLTQPWDPLDIPQNSTFEDQYSIGGPQEQITVQEWSDRKSARSYETWIGIYTVKDCYPVQETFTINYSVILSTRFFDIQLGIKDPSVFTPPSTCQMAQLEKMSEDCSW

SEQ ID NO: 4789 - protein, 73 aa, Homo Sapiens
MALGVPISVYLLFNADNIEGPIALKFSHLCLEDHNSYCINGACAFHHELEKAICRCLKLKSPYNVCSGERRPL

SEQ ID NO: 4790 - protein, 133 aa, Homo Sapiens
MALGVPISVYLLFNAMTALTEEAAVTVTPPITAQQADNIEGPIALKFSHLCLEDHNSYCINGACAFHHELEKAICRCFTGYTGERCEHLTLTSYAVDSYEKYIAIGIGVGLLLSGFLVIFYCYIRKRYEKDKI

SEQ ID NO: 4791 - protein, 103 aa, Homo Sapiens
MALGVPISVYLLFNAMTALTEEAAVTVTPPITAQQADNIEGPIALKFSHLCLEDHNSYCINGACAFHHELEKAICRCFTGYTGERCLKLKSPYNVCSGERRPL

SEQ ID NO: 4792 - protein, 94 aa, Homo Sapiens
MALGVPISVYLLFNAMTALTEEAAVTVTPPITAQQADNIEGPIALKFSHLCLEDHNSYCINGACAFHHELEKAICRCLKLKSPYNVCSGERRPL

SEQ ID NO: 4793 - protein, 94 aa, Homo Sapiens
MALGVPISVYLLFNAMTALTEEAAVTVTPPITAQQGNWTVNKTEADNIEGPIALKFSHLCLEDHNSYCINGACAFHHELEKAICRCFTGYTGER

SEQ ID NO: 4794 - protein, 154 aa, Homo Sapiens
MALGVPISVYLLFNAMTALTEEAAVTVTPPITAQQGNWTVNKTEADNIEGPIALKFSHLCLEDHNSYCINGACAFHHELEKAICRCFTGYTGERCEHLTLTSYAVDSYEKYIAIGIGVGLLLSGFLVIFYCYIRKRCLKLKSPYNVCSGERRPL

SEQ ID NO: 4795 - protein, 112 aa, Homo Sapiens
MALGVPISVYLLFNAMTALTEEAAVTVTPPITAQQGNWTVNKTEADNIEGPIALKFSHLCLEDHNSYCINGACAFHHELEKAICRCFTGYTGERCLKLKSPYNVCSGERRPL

SEQ ID NO: 4796 - protein, 103 aa, Homo Sapiens
MALGVPISVYLLFNAMTALTEEAAVTVTPPITAQQGNWTVNKTEADNIEGPIALKFSHLCLEDHNSYCINGACAFHHELEKAICRCLKLKSPYNVCSGERRPL

SEQ ID NO: 4797 - protein, 130 aa, Homo Sapiens
  misc_feature (1)..(1): Xaa can be any naturally occurring amino acid
XTALTEEAAVTVTPPITAQQADNIEGPIALKFSHLCLEDHNSYCINGACAFHHELEKAICRCFTGYTGERCEHLTLTSYAVDSYEKYIAIGIGVGLLLSGFLVIFYCYIRKRCLKLKSPYNVCSGERRPL

SEQ ID NO: 4798 - protein, 218 aa, Homo Sapiens
AQVTVSTGPGAPWEEDEIRRDRVEPQSVSLSWREPIPAGAPGANDTEYEIRYYEKGQSEQTYSMVKTGAPTVTVTNLKPATRYVFQIRAASPGPSWEAQSFNPSIEVQTLGEAASGSRDQSPAIVVTVVTISALLVLGSVMSVLAIWRRPCSYGKGGGDAHDEEELYFHFKVPTRRTFLDPQSCGDLLQAVHLFAKELDAKSVTLERSLGGGLETSPH

SEQ ID NO: 4799 - protein, 392 aa, Homo Sapiens
EQTYSMVKTGAPTVTVTNLKPATRYVFQIRAASPGPSWEAQSFNPSIEVQTLGEAASGSRDQSPAIVVTVVTISALLVLGSVMSVLAIWRRPCSYGKGGGDAHDEEELYFHFKVPTRRTFLDPQSCGDLLQAVHLFAKELDAKSVTLERSLGGGRFGELCCGCLQLPGRQELLVAVHMLRDSASDSQRLGFLAEALTLGQFDHSHIVRLEGVVTRGSTLMIVTEYMSHGALDGFLRRHEGQLVAGQLMGLLPGLASAMKYLSEMGYVHRGLAARHVLVSSDLVCKISGFGRGPRDRSEAVYTTMSGRSPALWAAPETLQFGHFSSASDVWSFGIIMWEVMAFGERPYWDMSGQDVIKAVEDGFRLPPPRNCPNLLHRLMLDCWQKDPGLPPH

SEQ ID NO: 4800 - protein, 295 aa, Homo Sapiens
METCAGPHPLRLFLCRMQLCLALLLGPWRPGTAEEVILLDSKASQAELGWTALPSNGWEEISGVDEHDRPIRTYQVCNVLEPNQDNWLQTGWISRGRGQRIFVELQFTLRDCSSIPGAAGTCKETFNVYYLETEADLGRGRPRLGGSRPRKIDTIAADESFTQGDLGERKMKLNTEVREIGPLSRRGFHLAFQDVGACVALVSVRVYYKQCRATVRGLATFPATAAESAFSTLVEVAGTCVAHSEGEPGSPPRMHCGADGEWLVPVGRCSCSAGFQERGDFCEGIQLAGGRGVGV

SEQ ID NO: 4801 - protein, 1008 aa, Homo Sapiens
METCAGPHPLRLFLCRMQLCLALLLGPWRPGTAEEVILLDSKASQAELGWTALPSNGWEEISGVDEHDRPIRTYQVCNVLEPNQDNWLQTGWISRGRGQRIFVELQFTLRDCSSIPGAAGTCKETFNVYYLETEADLGRGRPRLGGSRPRKIDTIAADESFTQGDLGERKMKLNTEVREIGPLSRRGFHLAFQDVGACVALVSVRVYYKQCRATVRGLATFPATAAESAFSTLVEVAGTCVAHSEGEPGSPPRMHCGADGEWLVPVGRCSCSAGFQERGDFCEACPPGFYKVSPRRPLCSPCPEHSRALENASTFCVCQDSYARSPTDPPSASCTRPPSAPRDLQYSLSRSPLVLRLRWLPPADSGGRSDVTYSLLCLRCGREGPAGACEPCGPRVAFLPRQAGLRERAATLLHLRPGARYTVRVAALNGVSGPAAAAGTTYAQVTVSTGPGAPWEEDEIRRDRVEPQSVSLSWREPIPAGAPGANDTEYEIRYYEKGQSEQTYSMVKTGAPTVTVTNLKPATRYVFQIRAASPGPSWEAQSFNPSIEVQTLGEAASGSRDQSPAIVVTVVTISALLVLGSVMSVLAIWRRPCSYGKGGGDAHDEEELYFHFKVPTRRTFLDPQSCGDLLQAVHLFAKELDAKSVTLERSLGGGRFGELCCGCLQLPGRQELLVAVHMLRDSASDSQRLGFLAEALTLGQFDHSHIVRLEGVVTRGSTLMIVTEYMSHGALDGFLRRHEGQLVAGQLMGLLPGLASAMKYLSEMGYVHRGLAARHVLVSSDLVCKISGFGRGPRDRSEAVYTTMSGRSPALWAAPETLQFGHFSSASDVWSFGIIMWEVMAFGERPYWDMSGQDVIKAVEDGFRLPPPRNCPNLLHRLMLDCWQKDPGERPRFSQIHSILSKMVQDPEPPKCALTTCPRPPTPLADRAFSTFPSFGSVGAWLEALDLCRYKDSFAAAGYGSLEAVAEMTAQDLVSLGISLAEHREALLSGISALQARVLQLQGQGVQV

SEQ ID NO: 4802 - protein, 1014 aa, Homo Sapiens
METCAGPHPLRLFLCRMQLCLALLLGPWRPGTAEEVILLDSKASQAELGWTALPSNGWEEISGVDEHDRPIRTYQVCNVLEPNQDNWLQTGWISRGRGQRIFVELQFTLRDCSSIPGAAGTCKETFNVYYLETEADLGRGRPRLGGSRPRKIDTIAADESFTQGDLGERKMKLNTEVREIGPLSRRGFHLAFQDVGACVALVSVRVYYKQCRATVRGLATFPATAAESAFSTLVEVAGTCVAHSEGEPGSPPRMHCGADGEWLVPVGRCSCSAGFQERGDFCEACPPGFYKVSPRRPLCSPCPEHSRALENASTFCVCQDSYARSPTDPPSASCTRPPSAPRDLQYSLSRSPLVLRLRWLPPADSGGRSDVTYSLLCLRCGREGPAGACEPCGPRVAFLPRQAGLRERAATLLHLRPGARYTVRVAALNGVSGPAAAAGTTYAQVTVSTGPGAPWEEDEIRRDRVEPQSVSLSWREPIPAGAPGANDTEYEIRYYEKGQSEQTYSMVKTGAPTVTVTNLKPATRYVFQIRAASPGPSWEAQSFNPSIEVQTLGEAASGSRDQSPAIVVTVVTISALLVLGSVMSVLAIWRRPCSYGKGGGDAHDEEELYFHFKVPTRRTFLDPQSCGDLLQAVHLFAKELDAKSVTLERSLGGGRFGELCCGCLQLPGRQELLVAVHMLRDSASDSQRLGFLAEALTLGQFDHSHIVRLEGVVTRGSTLMIVTEYMSHGALDGFLRRHEGQLVAGQLMGLLPGLASAMKYLSEMGYVHRGLAARHVLVSSDLVCKISGFGRGPRDRSEAVYTTMSGRSPALWAAPETLQFGHFSSASDVWSFGIIMWEVMAFGERPYWDMSGQDVIKAVEDGFRLPPPRNCPNLLHRLMLDCWQKDPGERPRFSQIHSILSKMVQDPEPPKCALTTCPRPPTPLADRAFSTFPSFGSVGAWLEALDLCRYKDSFAAAGYGSLEAVAEMTAQDLVSLGISLAEHREALLSGISALQARVLQLQGQGVQVIIKTCL

SEQ ID NO: 4803 - protein, 155 aa, Homo Sapiens
MVKTGAPTVTVTNLKPATRYVFQIRAASPGPSWEAQSFNPSIEVQTLGEAASGSRDQSPAIVVTVVTISALLVLGSVMSVLAIWRRPCSYGKGGGDAHDEEELYFHFKVPTRRTFLDPQSCGDLLQAVHLFAKELDAKSVTLERSLGGGLETSPH

SEQ ID NO: 4804 - protein, 92 aa, Homo Sapiens
  misc_feature (1)..(1): Xaa can be any naturally occurring amino acid
XHLRPGARYTVRVAALNGVSGPAAAAGTTYAQVTVSTGPGAPWEEDEIRRDRVEPQSVSLSWREPIPAGAPGANDTEYEIRYYEKDTCADFC

SEQ ID NO: 4805 - protein, 217 aa, Homo Sapiens
  misc_feature (1)..(1): Xaa can be any naturally occurring amino acid
XQIRAASPGPSWEAQSFNPSIEVQTLGEAASGSRDQSPAIVVTVVTISALLVLGSVMSVLAIWRRPCSYGKGGGDAHDEEELYFHFKVPTRRTFLDPQSCGDLLQAVHLFAKELDAKSVTLERSLGGGLCSCLEALPPHQAHPPPRKSLACLIIGKRMAEGSVTLSWSSRAVWGAVLWLLAAPRSPGAARSRAYAEGQRLRLTEARLPGRGPHAGPV

SEQ ID NO: 4806 - protein, 983 aa, Homo Sapiens
MDCQLSILLLLSCSVLDSFGELIPQPSNEVNLLDSKTIQGELGWISYPSHGWEEISGVDEHYTPIRTYQVCNVMDHSQNNWLRTNWVPRNSAQKIYVELKFTLRDCNSIPLVLGTCKETFNLYYMESDDDHGVKFREHQFTKIDTIAADESFTQMDLGDRILKLNTEIREVGPVNKKGFYLAFQDVGACVALVSVRVYFKKCPFTVKNLAMFPDTVPMDSQSLVEVRGSCVNNSKEEDPPRMYCSTEGEWLVPIGKCSCNAGYEERGFMCQACRPGFYKALDGNMKCAKCPPHSSTQEDGSMNCRCENNYFRADKDPPSMACTRPPSSPRNVISNINETSVILDWSWPLDTGGRKDVTFNIICKKCGWNIKQCEPCSPNVRFLPRQFGLTNTTVTVTDLLAHTNYTFEIDAVNGVSELSSPPRQFAAVSITTNQAAPSPVLTIKKDRTSRNSISLSWQEPEHPNGIILDYEVKYYEKQEQETSYTILRARGTNVTISSLKPDTIYVFQIRARTAAGYGTNSRKFEFETSPDSFSISGESSQVVMIAISAAVAIILLTVVIYVLIGRFCGYKSKHGADEKRLHFGNGHLKLPGLRTYVDPHTYEDPTQAVHEFAKELDATNISIDKVVGAGEFGEVCSGRLKLPSKKEISVAIKTLKVGYTEKQRRDFLGEASIMGQFDHPNIIRLEGVVTKSKPVMIVTEYMENGSLDSFLRKHDAQFTVIQLVGMLRGIASGMKYLSDMGYVHRDLAARNILINSNLVCKVSDFGLSRVLEDDPEAAYTTRGGKIPIRWTSPEAIAYRKFTSASDVWSYGIVLWEVMSYGERPYWEMSNQDVIKAVDEGYRLPPPMDCPAALYQLMLDCWQKDRNNRPKFEQIVSILDKLIRNPGSLKIITSAAARPSNLLLDQSNVDITTFRTTGDWLNGVWTAHCKEIFTGVEYSSCDTIAKISTDDMKKVGVTVVGPQKKIISSIKALETQSKNGPVPV

SEQ ID NO: 4807 - protein, 918 aa, Homo Sapiens
MDCQLSILLLLSCSVLDSFGELIPQPSNEVNLLDSKTIQGELGWISYPSHGWEEISGVDEHYTPIRTYQVCNVMDHSQNNWLRTNWVPRNSAQKIYVELKFTLRDCNSIPLVLGTCKETFNLYYMESDDDHGVKFREHQFTKIDTIAADESFTQMDLGDRILKLNTEIREVGPVNKKGFYLAFQDVGACVALVSVRVYFKKCPFTVKNLAMFPDTVPMDSQSLVEVRGSCVNNSKEEDPPRMYCSTEGEWLVPIGKCSCNAGYEERGFMCQACRPGFYKALDGNMKCAKCPPHSSTQEDGSMNCRCENNYFRADKDPPSMACTRPPSSPRNVISNINETSVILDWSWPLDTGGRKDVTFNIICKKCGWNIKQCEPCSPNVRFLPRQFGLTNTTVTVTDLLAHTNYTFEIDAVNGVSELSSPPRQFAAVSITTNQAAPSPVLTIKKDRTSRNSISLSWQEPEHPNGIILDYEVKYYEKQEQETSYTILRARGTNVTISSLKPDTIYVFQIRARTAAGYGTNSRKFEFETSPDSFSISGESSQVVMIAISAAVAIILLTVVIYVLIGRFCGYKSKHGADEKRLHFGNGHLKLPGLRTYVDPHTYEDPTQAVHEFAKELDATNISIDKVVGAGEFGEVCSGRLKLPSKKEISVAIKTLKVGYTEKQRRDFLGEASIMGQFDHPNIIRLEGVVTKSKPVMIVTEYMENGSLDSFLRKHDAQFTVIQLVGMLRGIASGMKYLSDMGYVHRDLAARNILINSNLVCKVSDFGLSRVLEDDPEAAYTTRGGKIPIRWTSPEAIAYRKFTSASDVWSYGIVLWEVMSYGERPYWEMSNQDVIKAVDEGYRLPPPMDCPAALYQLMLDCWQKDRNNRPKFEQIVSILDKLIRNPGSLKIITSAAARPSNLLLDQSNVDITTFRTTVT

SEQ ID NO: 4808 - protein, 539 aa, Homo Sapiens
MDCQLSILLLLSCSVLDSFGELIPQPSNEVNLLDSKTIQGELGWISYPSHGWEEISGVDEHYTPIRTYQVCNVMDHSQNNWLRTNWVPRNSAQKIYVELKFTLRDCNSIPLVLGTCKETFNLYYMESDDDHGVKFREHQFTKIDTIAADESFTQMDLGDRILKLNTEIREVGPVNKKGFYLAFQDVGACVALVSVRVYFKKCPFTVKNLAMFPDTVPMDSQSLVEVRGSCVNNSKEEDPPRMYCSTEGEWLVPIGKCSCNAGYEERGFMCQACRPGFYKALDGNMKCAKCPPHSSTQEDGSMNCRCENNYFRADKDPPSMACTRPPSSPRNVISNINETSVILDWSWPLDTGGRKDVTFNIICKKCGWNIKQCEPCSPNVRFLPRQFGLTNTTVTVTDLLAHTNYTFEIDAVNGVSELSSPPRQFAAVSITTNQAAPSPVLTIKKDRTSRNSISLSWQEPEHPNGIILDYEVKYYEKQEQETSYTILRARGTNVTISSLKPDTIYVFQIRARTAAGYGTNSRKFEFETSPDCMYYFNAV

SEQ ID NO: 4809 - protein, 37 aa, Homo Sapiens
AYRKFTSASDVWSYGIVMWEVMSYGERPYWDMSNQDT

SEQ ID NO: 4810 - protein, 177 aa, Homo Sapiens
MAGIFYFALFSCLFGICDAVTGSRVYPANEGPPSAPLNLISNVNETSVNLEWSSPQNTGGRQDISYNVVCKKCGAGDPSKCRPCGSGVHYTPQQNGLKTTKVSITDLLAHTNYTFEIWAVNGVSKYNPNPDQSVSVTVTTNQAAPSSIALVQAKEVTRYSVALAWLEPDRPNGVILE

SEQ ID NO: 4811 - protein, 38 aa, Homo Sapiens
MAGIFYFALFSCLFGICDAVTGSRVYPANEVGGSEYHG

SEQ ID NO: 4812 - protein, 91 aa, Homo Sapiens
MAGIFYFALFSCLFGICDAVTGSRVYPANEVTLLDSRSVQGELGWIASPLEGGWEEVSIMDEKNTPIRTYQVCNVMEPSQNNWLRTDWITR

SEQ ID NO: 4813 - protein, 149 aa, Homo Sapiens
MAGIFYFALFSCLFGICDAVTGSRVYPANEVTLLDSRSVQGELGWIASPLEGGWEEVSIMDEKNTPIRTYQVCNVMEPSQNNWLRTDWITREGAQRVYIEIKFTLRDCNSLPGVMGTCKETFNLYYYESDNDKERFIRENQFVKIDTIA

SEQ ID NO: 4814 - protein, 986 aa, Homo Sapiens
MAGIFYFALFSCLFGICDAVTGSRVYPANEVTLLDSRSVQGELGWIASPLEGGWEEVSIMDEKNTPIRTYQVCNVMEPSQNNWLRTDWITREGAQRVYIEIKFTLRDCNSLPGVMGTCKETFNLYYYESDNDKERFIRENQFVKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEERSGECQACKIGYYKALSTDATCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTKVSITDLLAHTNYTFEIWAVNGVSKYNPNPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTVPSRIIGDGANSTVLLVSVSGSVVLVVILIAAFVISRRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVGDWLQAIKMDRYKDNFTAAGYTTLEAVVHVNQEDLARIGITAITHQNKILSSVQAMRTQMQQMHGRMVPV

SEQ ID NO: 4815 - protein, 986 aa, Homo Sapiens; identical to SEQ ID NO: 4814

SEQ ID NO: 4816 - protein, 949 aa, Homo Sapiens
MAGIFYFALFSCLFGICDAVTGSRVYPANEVTLLDSRSVQGELGWIASPLEGGWEEVSIMDEKNTPIRTYQVCNVMEPSQNNWLRTDWITREGAQRVYIEIKFTLRDCNSLPGVMGTCKETFNLYYYESDNDKERFIRENQFVKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEERSGECQACKIGYYKALSTDATCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTKVSITDLLAHTNYTFEIWAVNGVSKYNPNPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTVPSRIIGDGANSTVLLVSVSGSVVLVVILIAAFVISRRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVGDWLQAIKMDRYKDNFTAAGYTTLEAVVHVNQE

SEQ ID NO: 4817 - protein, 126 aa, Homo Sapiens
MDEKNTPIRTYQVCNVMEPSQNNWLRTDWITREGAQRVYIEIKFTLRDCNSLPGVMGTCKETFNLYYYESDNDKERFIRENQFVKIDTIAADESFTQVDIGDRIMKLNTEIRDVGPLSKKGFYLAF

SEQ ID NO: 4818 - protein, 189 aa, Homo Sapiens
  misc_feature (1)..(1): Xaa can be any naturally occurring amino acid
XFHGSLSSTHFTCKIGYYKALSTDATCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTKVSITDLLAHTNYTFEIWAVNGVSKYNPNPDQSVSVTVTTNQAAPSSIALVQAKEV

SEQ ID NO: 4819 - protein, 279 aa, Homo Sapiens
MVFQTRYPSWIILCYIWLLRFAHTGEAQAAKEVLLLDSKAQQTELEWISSPPNGWEEISGLDENYTPIRTYQVCQVMEPNQNNWLRTNWISKGNAQRIFVELKFTLRDCNSLPGVLGTCKETFNLYYYETDYDTGRNIRENLYVKIDTIAADESFTQGDLGERKMKLNTEVREIGPLSKKGFYLAFQDVGACIALVSVKVYYKKCWSIIENLAIFPDTVTGSEFSSLVEVRGTCVSSAEEEAENAPRMHCSAEGEWLVPIGKCICKAGYQQKGDTCERK

SEQ ID NO: 4820 - protein, 998 aa, Homo Sapiens
MVFQTRYPSWIILCYIWLLRFAHTGEAQAAKEVLLLDSKAQQTELEWISSPPNGWEEISGLDENYTPIRTYQVCQVMEPNQNNWLRTNWISKGNAQRIFVELKFTLRDCNSLPGVLGTCKETFNLYYYETDYDTGRNIRENLYVKIDTIAADESFTQGDLGERKMKLNTEVREIGPLSKKGFYLAFQDVGACIALVSVKVYYKKCWSIIENLAIFPDTVTGSEFSSLVEVRGTCVSSAEEEAENAPRMHCSAEGEWLVPIGKCICKAGYQQKGDTCEPCGRGFYKSSSQDLQCSRCPTHSFSDKEGSSRCECEDGYYRAPSDPPYVACTRPPSAPQNLIFNINQTTVSLEWSPPADNGGRNDVTYRILCKRCSWEQGECVPCGSNIGYMPQQTGLEDNYVTVMDLLAHANYTFEVEAVNGVSDLSRSQRLFAAVSITTGQAAPSQVSGVMKERVLQRSVELSWQEPEHPNGVITEYEIKYYEKDQRERTYSTVKTKSTSASINNLKPGTVYVFQIRAFTAAGYGNYSPRLDVATLEEATGKMFEATAVSSEQNPVIIIAVVAVAGTIILVFMVFGFIIGRRHCGYSKADQEGDEELYFHFKFPGTKTYIDPETYEDPNRAVHQFAKELDASCIKIERVIGAGEFGEVCSGRLKLPGKRDVAVAIKTLKVGYTEKQRRDFLCEASIMGQFDHPNVVHLEGVVTRGKPVMIVIEFMENGALDAFLRKHDGQFTVIQLVGMLRGIAAGMRYLADMGYVHRDLAARNILVNSNLVCKVSDFGLSRVIEDDPEAVYTTTGGKIPVRWTAPEAIQYRKFTSASDVWSYGIVMWEVMSYGERPYWDMSNQDVIKAIEEGYRLPAPMDCPAGLHQLMLDCWQKERAERPKFEQIVGILDKMIRNPNSLKTPLGTCSRPISPLLDQNTPDFTTFCSVGEWLQAIKMERYKDNFTAAGYNSLESVARMTIEDVMSLGITLVGHQKKIMSSIQTMRAQMLHLHGTGIQV

SEQ ID NO: 4821 - protein, 1005 aa, Homo Sapiens
MAPARGRLPPALWVVTAAAAAATCVSAARGEVNLLDTSTIHGDWGWLTYPAHGWDSINEVDESFQPIHTYQVCNVMSPNQNNWLRTSWVPRDGARRVYAEIKFTLRDCNSMPGVLGTCKETFNLYYLESDRDLGASTQESQFLKIDTIAADESFTGADLGVRRLKLNTEVRSVGPLSKRGFYLAFQDIGACLAILSLRIYYKKCPAMVRNLAAFSEAVTGADSSSLVEVRGQCVRHSEERDTPKMYCSAEGEWLVPIGKCVCSAGYEERRDACVACELGFYKSAPGDQLCARCPPHSHSAAPAAQACHCDLSYYRAALDPPSSACTRPPSAPVNLISSVNGTSVTLEWAPPLDPGGRSDITYNAVCRRCPWALSRCEACGSGTRFVPQQTSLVQASLLVANLLAHMNYSFWIEAVNGVSDLSPEPRRAAVVNITTNQAAPSQVVVIRQERAGQTSVSLLWQEPEQPNGIILEYEIKYYEKDKEMQSYSTLKAVTTRATVSGLKPGTRYVFQVRARTSAGCGRFSQAMEVETGKPRPRYDTRTIVWICLTLITGLVVLLLLLICKKRHCGYSKAFQDSDEEKMHYQNGQAPPPVFLPLHHPPGKLPEPQFYAEPHTYEEPGRAGRSFTREIEASRIHIEKIIGSGDSGEVCYGRLRVPGQRDVPVAIKALKAGYTERQRRDFLSEASIMGQFDHPNIIRLEGVVTRGRLAMIVTEYMENGSLDTFLRTHDGQFTIMQLVGMLRGVGAGMRYLSDLGYVHRDLAARNVLVDSNLVCKVSDFGLSRVLEDDPDAAYTTTGGKIPIRWTAPEAIAFRTFSSASDVWSFGVVMWEVLAYGERPYWNMTNRDVISSVEEGYRLPAPMGCPHALHQLMLDCWHKDRAQRPRFSQIVSVLDALIRSPESLRATATVSRCPPPAFVRSCFDLRGGSGGGGGLTVGDWLDSIRMGRYRDHFAAGGYSSLGMVLRMNAQDVRALGITLMGHQKKILGSIQTMRAQLTSTQGPRRHL

SEQ ID NO: 4822 - protein, 495 aa, Homo Sapiens
MAPARGRLPPALWVVTAAAAAATCVSAARGEVNLLDTSTIHGDWGWLTYPAHGWDSINEVDESFQPIHTYQVCNVMSPNQNNWLRTSWVPRDGARRVYAEIKFTLRDCNSMPGVLGTCKETFNLYYLESDRDLGASTQESQFLKIDTIAADESFTGADLGVRRLKLNTEVRSVGPLSKRGFYLAFQDIGACLAILSLRIYYKKCPAMVRNLAAFSEAVTGADSSSLVEVRGQCVRHSEERDTPKMYCSAEGEWLVPIGKCVCSAGYEERRDACVACELGFYKSAPGDQLCARCPPHSHSAAPAAQACHCDLSYYRAALDPPSSACTRPPSAPVNLISSVNGTSVTLEWAPPLDPGGRSDITYNAVCRRCPWALSRCEACGSGTRFVPQQTSLVQASLLVANLLAHMNYSFWIEAVNGVSDLSPEPRRAAVVNITTNQAGRRRNSVPQRPGPPASPASDPSRDQSSAGDVLWAFRQVPLWPCAPHQDPELEALHCL

SEQ ID NO: 4823 - protein, 986 aa, Homo Sapiens
MALRRLGAALLLLPLLAAVEETLMDSTTATAELGWMVHPPSGWEEVSGYDENMNTIRTYQVCNVFESSQNNWLRTKFIRRRGAHRIHVEMKFSVRDCSSIPSVPGSCKETFNLYYYEADFDSATKTFPNWMENPWVKVDTIAADESFSQVDLGGRVMKINTEVRSFGPVSRSGFYLAFQDYGGCMSLIAVRVFYRKCPRIIQNGAIFQETLSGAESTSLVAARGSCIANAEEVDVPIKLYCNGDGEWLVPIGRCMCKAGFEAVENGTVCRGCPSGTFKANQGDEACTHCPINSRTTSEGATNCVCRNGYYRADLDPLDMPCTTIPSAPQAVISSVNETSLMLEWTPPRDSGGREDLVYNIICKSCGSGRGACTRCGDNVQYAPRQLGLTEPRIYISDLLAHTQYTFEIQAVNGVTDQSPFSPQFASVNITTNQAAPSAVSIMHQVSRTVDSITLSWSQPDQPNGVILDYELQYYEKELSEYNATAIKSPTNTVTVQGLKAGAIYVFQVRARTVAGYGRYSGKMYFQTMTEAEYQTSIQEKLPLIIGSSAAGLVFLIAVVVIAIVCNRRGFERADSEYTDKLQHYTSGHMTPGMKIYIDPFTYEDPNEAVREFAKEIDISCVKIEQVIGAGEFGEVCSGHLKLPGKREIFVAIKTLKSGYTEKQRRDFLSEASIMGQFDHPNVIHLEGVVTKSTPVMIITEFMENGSLDSFLRQNDGQFTVIQLVGMLRGIAAGMKYLADMNYVHRDLAARNILVNSNLVCKVSDFGLSRFLEDDTSDPTYTSALGGKIPIRWTAPEAIQYRKFTSASDVWSYGIVMWEVMSYGERPYWDMTNQDVINAIEQDYRLPPPMDCPSALHQLMLDCWQKDRNHRPKFGQIVNTLDKMIRNPNSLKAMAPLSSGINLPLLDRTIPDYTSFNTVDEWLEAIKMGQYKESFANAGFTSFDVVSQMMMEDILRVGVTLAGHQKKILNSIQVMRAQMNQIQSVEV

SEQ ID NO: 4824 - protein, 1055 aa, Homo Sapiens
MALRRLGAALLLLPLLAAVEETLMDSTTATAELGWMVHPPSGWEEVSGYDENMNTIRTYQVCNVFESSQNNWLRTKFIRRRGAHRIHVEMKFSVRDCSSIPSVPGSCKETFNLYYYEADFDSATKTFPNWMENPWVKVDTIAADESFSQVDLGGRVMKINTEVRSFGPVSRSGFYLAFQDYGGCMSLIAVRVFYRKCPRIIQNGAIFQETLSGAESTSLVAARGSCIANAEEVDVPIKLYCNGDGEWLVPIGRCMCKAGFEAVENGTVCRGCPSGTFKANQGDEACTHCPINSRTTSEGATNCVCRNGYYRADLDPLDMPCTTIPSAPQAVISSVNETSLMLEWTPPRDSGGREDLVYNIICKSCGSGRGACTRCGDNVQYAPRQLGLTEPRIYISDLLAHTQYTFEIQAVNGVTDQSPFSPQFASVNITTNQAAPSAVSIMHQVSRTVDSITLSWSQPDQPNGVILDYELQYYEKELSEYNATAIKSPTNTVTVQGLKAGAIYVFQVRARTVAGYGRYSGKMYFQTMTEAEYQTSIQEKLPLIIGSSAAGLVFLIAVVVIAIVCNRRGFERADSEYTDKLQHYTSGHMTPGMKIYIDPFTYEDPNEAVREFAKEIDISCVKIEQVIGAGEFGEVCSGHLKLPGKREIFVAIKTLKSGYTEKQRRDFLSEASIMGQFDHPNVIHLEGVVTKSTPVMIITEFMENGSLDSFLRQNDGQFTVIQLVGMLRGIAAGMKYLADMNYVHRDLAARNILVNSNLVCKVSDFGLSRFLEDDTSDPTYTSALGGKIPIRWTAPEAIQYRKFTSASDVWSYGIVMWEVMSYGERPYWDMTNQDVINAIEQDYRLPPPMDCPSALHQLMLDCWQKDRNHRPKFGQIVNTLDKMIRNPNSLKAMAPLSSGINLPLLDRTIPDYTSFNTVDEWLEAIKMGQYKESFANAGFTSFDVVSQMMMEDILRVGVTLAGHQKKILNSIQVMRAQMNQIQSVEGQPLARRPRATGRTKRCQPRDVTKKTCNSNDGKKKGMGKKKTDPGRGREIQGIFFKEDSHKESNDCSCGG

SEQ ID NO: 4825 - protein, 987 aa, Homo Sapiens
MALRRLGAALLLLPLLAAVEETLMDSTTATAELGWMVHPPSGWEEVSGYDENMNTIRTYQVCNVFESSQNNWLRTKFIRRRGAHRIHVEMKFSVRDCSSIPSVPGSCKETFNLYYYEADFDSATKTFPNWMENPWVKVDTIAADESFSQVDLGGRVMKINTEVRSFGPVSRSGFYLAFQDYGGCMSLIAVRVFYRKCPRIIQNGAIFQETLSGAESTSLVAARGSCIANAEEVDVPIKLYCNGDGEWLVPIGRCMCKAGFEAVENGTVCRGCPSGTFKANQGDEACTHCPINSRTTSEGATNCVCRNGYYRADLDPLDMPCTTIPSAPQAVISSVNETSLMLEWTPPRDSGGREDLVYNIICKSCGSGRGACTRCGDNVQYAPRQLGLTEPRIYISDLLAHTQYTFEIQAVNGVTDQSPFSPQFASVNITTNQAAPSAVSIMHQVSRTVDSITLSWSQPDQPNGVILDYELQYYEKELSEYNATAIKSPTNTVTVQGLKAGAIYVFQVRARTVAGYGRYSGKMYFQTMTEAEYQTSIQEKLPLIIGSSAAGLVFLIAVVVIAIVCNRRRGFERADSEYTDKLQHYTSGHMTPGMKIYIDPFTYEDPNEAVREFAKEIDISCVKIEQVIGAGEFGEVCSGHLKLPGKREIFVAIKTLKSGYTEKQRRDFLSEASIMGQFDHPNVIHLEGVVTKSTPVMIITEFMENGSLDSFLRQNDGQFTVIQLVGMLRGIAAGMKYLADMNYVHRDLAARNILVNSNLVCKVSDFGLSRFLEDDTSDPTYTSALGGKIPIRWTAPEAIQYRKFTSASDVWSYGIVMWEVMSYGERPYWDMTNQDVINAIEQDYRLPPPMDCPSALHQLMLDCWQKDRNHRPKFGQIVNTLDKMIRNPNSLKAMAPLSSGINLPLLDRTIPDYTSFNTVDEWLEAIKMGQYKESFANAGFTSFDVVSQMMMEDILRVGVTLAGHQKKILNSIQVMRAQMNQIQSVEV

SEQ ID NO: 4826 - protein, 482 aa, Homo Sapiens
MALRRLGAALLLLPLLAAVEETLMDSTTATAELGWMVHPPSGWEEVSGYDENMNTIRTYQVCNVFESSQNNWLRTKFIRRRGAHRIHVEMKFSVRDCSSIPSVPGSCKETFNLYYYEADFDSATKTFPNWMENPWVKVDTIAADESFSQVDLGGRVMKINTEVRSFGPVSRSGFYLAFQDYGGCMSLIAVRVFYRKCPRIIQNGAIFQETLSGAESTSLVAARGSCIANAEEVDVPIKLYCNGDGEWLVPIGRCMCKAGFEAVENGTVCRGCPSGTFKANQGDEACTHCPINSRTTSEGATNCVCRNGYYRADLDPLDMPCTTIPSAPQAVISSVNETSLMLEWTPPRDSGGREDLVYNIICKSCGSGRGACTRCGDNVQYAPRQLGLTEPRIYISDLLAHTQYTFEIQAVNGVTDQSPFSPQFASVNITTNQAAPSAVSIMHQVSRTVDSITLSWSQPDQPNGVILDYELQYYEKMKTQRS

SEQ ID NO: 4827 - protein, 946 aa, Homo Sapiens
MWVPVLALPVCTYAETLMDSTTATAELGWMVHPPSGWEEVSGYDENMNTIRTYQVCNVFESSQNNWLRTKFIRRRGAHRIHVEMKFSVRDCSSIPSVPGSCKETFNLYYYEADFDSATKTFPNWMENPWVKVDTIAADESFSQVDLGGRVMKINTEVRSFGPVSRSGFYLAFQDYGGCMSLIAVRVFYRKCPRIIQNGAIFQETLSGAESTSLVAARGSCIANAEEVDVPIKLYCNGDGEWLVPIGRCMCKAGFEAVENGTVCRGCPSGTFKANQGDEACTHCPINSRTTSEGATNCVCRNGYYRADLDPLDMPCTTIPSAPQAVISSVNETSLMLEWTPPRDSGGREDLVYNIICKSCGSGRGACTRCGDNVQYAPRQLGLTEPRIYISDLLAHTQYTFEIQAVNGVTDQSPFSPQFASVNITTNQAAPSAVSIMHQVSRTVDSITLSWSQPDQPNGVILDYELQYYEKQELSEYNATAIKSPTNTVTVQGLKAGAIYVFQVRARTVAGYGRYSGKMYFQTMTEAEYQTSIQEKLPLIIGSSAAGLVFLIAVVVIAIVCNRRGFERADSEYTDKLQHYTSGHMTPGMKIYIDPFTYEDPNEAVREFAKEIDISCVKIEQVIGAGEFGEVCSGHLKLPGKREIFVAIKTLKSGYTEKQRRDFLSEASIMGQFDHPNVIHLEGVVTKSTPVMIITEFMENGSLDSFLRQNDGQFTVIQLVGMLRGIAAGMKYLADMNYVHRDLAARNILVNSNLVCKVSDFGLSRFLEDDTSDPTYTSALGGKIPIRWTAPEAIQYRKFTSASDVWSYGIVMWEVMSYGERPYWDMTNQDVINAIEQDYRLPPPMDCPSALHQLMLDCWQKDRNHRPKFGQIVNTLDKMIRNPNSLKAMAPLSSGINLPLLDRTIPDYTSFNTVDEWLEAIKMGQYKESFANAGFTSFDVVSQMMME

SEQ ID NO: 4828 - protein, 935 aa, Homo Sapiens
MELRVLLCWASLAAALEETLLNTKLETADLKWVTFPQVDGQWEELSGLDEEQHSVRTYEVCDVQRAPGQAHWLRTGWVPRRGAVHVYATLRFTMLECLSLPRAGRSCKETFTVFYYESDADTATALTPAWMENPYIKVDTVAAEHLTRKRPGAEATGKVNVKTLRLGPLSKAGFYLAFQDQGACMALLSLHLFYKKCAQLTVNLTRFPETVPRELVVPVAGSCVVDAVPAPGPSPSLYCREDGQWAEQPVTGCSCAPGFEAAEGNTKCRACAQGTFKPLSGEGSCQPCPANSHSNTIGSAVCQCRVGYFRARTDPRGAPCTTPPSAPRSVVSRLNGSSLHLEWSAPLESGGREDLTYALRCRECRPGGSCAPCGGDLTFDPGPRDLVEPWVVVRGLRPDFTYTFEVTALNGVSSLATGPVPFEPVNVTTDREVPPAVSDIRVTRSSPSSLSLAWAVPRAPSGAVLDYEVKYHEKGAEGPSSVRFLKTSENRAELRGLKRGASYLVQVRARSEAGYGPFGQEHHSQTQLDESEGWREQLALIAGTAVVGVVLVLVVIVVAVLCLRKQSNGREAEYSDKHGQYLIGHGTKVYIDPFTYEDPNEAVREFAKEIDVSYVKIEEVIGAGEFGEVCRGRLKAPGKKESCVAIKTLKGGYTERQRREFLSEASIMGQFEHPNIIRLEGVVTNSMPVMILTEFMENGALDSFLRLNDGQFTVIQLVGMLRGIASGMRYLAEMSYVHRDLAARNILVNSNLVCKVSDFGLSRFLEENSSDPTYTSSLGGKIPIRWTAPEAIAFRKFTSASDAWSYGIVMWEVMSFGERPYWDMSNQDVINAIEQDYRLPPPPDCPTSLHQLMLDCWQKDRNARPRFPQVVSALDKMIRNPASLKIVARENGGDLLRIGVTLAGHQKKILASVQHMKSQAKPGTPGGTGGPAPQY

SEQ ID NO: 4829 - protein, 987 aa, Homo Sapiens
MELRVLLCWASLAAALEETLLNTKLETADLKWVTFPQVDGQWEELSGLDEEQHSVRTYEVCDVQRAPGQAHWLRTGWVPRRGAVHVYATLRFTMLECLSLPRAGRSCKETFTVFYYESDADTATALTPAWMENPYIKVDTVAAEHLTRKRPGAEATGKVNVKTLRLGPLSKAGFYLAFQDQGACMALLSLHLFYKKCAQLTVNLTRFPETVPRELVVPVAGSCVVDAVPAPGPSPSLYCREDGQWAEQPVTGCSCAPGFEAAEGNTKCRACAQGTFKPLSGEGSCQPCPANSHSNTIGSAVCQCRVGYFRARTDPRGAPCTTPPSAPRSVVSRLNGSSLHLEWSAPLESGGREDLTYALRCRECRPGGSCAPCGGDLTFDPGPRDLVEPWVVVRGLRPDFTYTFEVTALNGVSSLATGPVPFEPVNVTTDREVPPAVSDIRVTRSSPSSLSLAWAVPRAPSGAVLDYEVKYHEKGAEGPSSVRFLKTSENRAELRGLKRGASYLVQVRARSEAGYGPFGQEHHSQTQLDESEGWREQLALIAGTAVVGVVLVLVVIVVAVLCLRKQSNGREAEYSDKHGQYLIGHGTKVYIDPFTYEDPNEAVREFAKEIDVSYVKIEEVIGAGEFGEVCRGRLKAPGKKESCVAIKTLKGGYTERQRREFLSEASIMGQFEHPNIIRLEGVVTNSMPVMILTEFMENGALDSFLRLNDGQFTVIQLVGMLRGIASGMRYLAEMSYVHRDLAARNILVNSNLVCKVSDFGLSRFLEENSSDPTYTSSLGGKIPIRWTAPEAIAFRKFTSASDAWSYGIVMWEVMSFGERPYWDMSNQDVINAIEQDYRLPPPPDCPTSLHQLMLDCWQKDRNARPRFPQVVSALDKMIRNPASLKIVARENGGASHPLLDQRQPHYSAFGSVGEWLRAIKMGRYEESFAAAGFGSFELVSQISAEDLLRIGVTLAGHQKKILASVQHMKSQAKPGTPGGTGGPAPQY

SEQ ID NO: 4830 - protein, 306 aa, Homo Sapiens
MELRVLLCWASLAAALEETLLNTKLETADLKWVTFPQVDGQWEELSGLDEEQHSVRTYEVCDVQRAPGQAHWLRTGWVPRRGAVHVYATLRFTMLECLSLPRAGRSCKETFTVFYYESDADTATALTPAWMENPYIKVDTVAAEHLTRKRPGAEATGKVNVKTLRLGPLSKAGFYLAFQDQGACMALLSLHLFYKKCAQLTVNLTRFPETVPRELVVPVAGSCVVDAVPAPGPSPSLYCREDGQWAEQPVTGCSCAPGFEAAEGNTKCRGRRGSQQRAVPEDVRKPGRAAGAEAGSQLPGAGTGAL

SEQ ID NO: 4831 - protein, 126 aa, Homo Sapiens
MPELVVTALLAPSRLSLKLLRAFMWSLVFSVALVAAAVYGCIALTHVLCRPRRGCCGRRRSASPACLSDPSLGEHGFLNLKSSGLRLHYVSAGRGNGPLMLFLHGFPENWFSWRYQLREFQSRFHV

SEQ ID NO: 4832 - protein, 360 aa, Homo Sapiens
MPELVVTALLAPSRLSLKLLRAFMWSLVFSVALVAAAVYGCIALTHVLCRPRRGCCGRRRSASPACLSDPSLGEHGFLNLKSSGLRLHYVSAGRGNGPLMLFLHGFPENWFSWRYQLREFQSRFHVVAVDLRGYGPSDAPRDVDCYTIDLLLVDIKDVILGLGYSKCILVAHDWGALLAWHFSIYYPSLVERMVVVSGAPMSVYQDYSLHHISQFFRSHYMFLFQLPWLPEKLLSMSDFQILKTTLTHRKTGIPCLTPSELEAFLYNFSQPGGLTGPLNYYRNLFRNFPLEPQELTTPTLLLWGEKDTYLELGLVEAIGSRFVPGRLEAHILPGIGHWIPQSNPQEMHQYMWAFLQDLLD

SEQ ID NO: 4833 - protein, 360 aa, Homo Sapiens; identical to SEQ ID NO: 4832

SEQ ID NO: 4834 - protein, 360 aa, Homo Sapiens; identical to SEQ ID NO: 4832

SEQ ID NO: 4835 - protein, 193 aa, Homo Sapiens
MGVHECPAWLWLLLSLLSLPLGLPVLGAPPRLICDSRVLERYLLEAKEAENITTGCAEHCSLNENITVPDTKVNFYAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 4836 - protein, 133 aa, Homo Sapiens
MGSSGLLSLLVLFVLLANVQGPGLTDWLFPRRCPKIREECEFQERDVCTKDRQCQDNKKCCVFSCGKKCLDLKQDVCEMPKETGPCLAYFLHWWYDKKDNTCSMFVYGGCQGNNNNFQSKANCLNTCKNKRFP

SEQ ID NO: 4837 - protein, 77 aa, Homo Sapiens
MGSSGLLSLLVLFVLLANVQGPGLTDWLFPRRCPKIREECEFQERDVCTKDRQCQDNKKCCVFSCGKKCLDLKQGKQ

SEQ ID NO: 4838 - protein, 117 aa, Homo Sapiens
MLSKAHGCKTALSLGRCPKIREECEFQERDVCTKDRQCQDNKKCCVFSCGKKCLDLKQDVCEMPKETGPCLAYFLHWWYDKKDNTCSMFVYGGCQGNNNNFQSKANCLNTCKNKRFP

SEQ ID NO: 4839 - protein, 179 aa, Homo Sapiens
MGSSGLLSLLVLFVLLANVQGPGLTDWLFPRRCPKIREECEFQERDVCTKDRQCQDNKKCCVFSCGKKCLDLKQDVCEMPKETGPCLAYFLHWWYDKKDNTCSMFVYGGCQGNNNNFQSKANCLNTCKNKQPCPKIKVECEVEEIDQCTKPRDCPENMKCCPFSRGKKCLDFRKASLST

SEQ ID NO: 4840 - protein, 762 aa, Homo Sapiens
MAAAAQLSLTQLSSGNPVYEKYYRQVDTGNTGRVLASDAAAFLKKSGLPDLILGKIWDLADTDGKGILNKQEFFVALRLVACAQNGLEVSLSSLNLAVPPPRFHDTSSPLLISGTSAAELPWAVKPEDKAKYDAIFDSLSPVNGFLSGDKVKPVLLNSKLPVDILGRVWELSDIDHDGMLDRDEFAVAMFLVYCALEKEPVPMSLPPALVPPSKRKTWVVSPAEKAKYDEIFLKTDKDMDGFVSGLEVREIFLKTGLPSTLLAHIWSLCDTKDCGKLSKDQFALAFHLISQKLIKGIDPPHVLTPEMIPPSDRASLQKNIIGSSPVADFSAIKELDTLNNEIVDLQREKNNVEQDLKEKEDTIKQRTSEVQDLQDEVQRENTNLQKLQAQKQQVQELLDELDEQKAQLEEQLKEVRKKCAEEAQLARSSPELLPSGVTDENEVTTAVTEKVCSELDNNRHSKEEDPFNVDSSSLTGPVADTNLDFFQSDPFVGSDPFKDDPFGKIDPFGGDPFKGSDPFASDCFFRQSTDPFATSSTDPFSAANNSSITSVETLKHNDPFAPGGTVVAASDSATDPFASVFGNESFGGGFADFSTLSKVNNEDPFRSATSSSVSNVVITKNVFEETSVKSEDEPPALPPKIGTPTRPCPLPPGKRSINKLDSPDPFKLNDPFQPFPGNDSPKEKDPEIFCDPFTSATTTTNKEADPSNFANFSAYPSEEDMIEWAKRESEREEEQRLARLNQQEQEDLELAIALSKSEISEA

SEQ ID NO: 4841 - protein, 896 aa, Homo Sapiens
MAAAAQLSLTQLSSGNPVYEKYYRQVDTGNTGRVLASDAAAFLKKSGLPDLILGKIWDLADTDGKGILNKQEFFVALRLVACAQNGLEVSLSSLNLAVPPPRFHDTSSPLLISGTSAAELPWAVKPEDKAKYDAIFDSLSPVNGFLSGDKVKPVLLNSKLPVDILGRVWELSDIDHDGMLDRDEFAVAMFLVYCALEKEPVPMSLPPALVPPSKRKTWVVSPAEKAKYDEIFLKTDKDMDGFVSGLEVREIFLKTGLPSTLLAHIWSLCDTKDCGKLSKDQFALAFHLISQKLIKGIDPPHVLTPEMIPPSDRASLQKNIIGSSPVADFSAIKELDTLNNEIVDLQREKNNVEQDLKEKEDTIKQRTSEVQDLQDEVQRENTNLQKLQAQKQQVQELLDELDEQKAQLEEQLKEVRKKCAEEAQLISSLKAELTSQESQISTYEEELAKAREELSRLQQETAELEESVESGKAQLEPLQQHLQDSQQEISSMQMKLMEMKDLENHNSQLNWCSSPHSILVNGATDYCSLSTSSSETANLNEHVEGQSNLESEPIHQESPARSSPELLPSGVTDENEVTTAVTEKVCSELDNNRHSKEEDPFNVDSSSLTGPVADTNLDFFQSDPFVGSDPFKDDPFGKIDPFGGDPFKGSDPFASDCFFRQSTDPFATSSTDPFSAANNSSITSVETLKHNDPFAPGGTVVAASDSATDPFASVFGNESFGGGFADFSTLSKVNNEDPFRSATSSSVSNVVITKNVFEETSVKSEDEPPALPPKIGTPTRPCPLPPGKRSINKLDSPDPFKLNDPFQPFPGNDSPKEKDPEIFCDPFTSATTTTNKEADPSNFANFSAYPSEEDMIEWAKRESEREEEQRLARLNQQEQEDLELAIALSKSEISEA

SEQ ID NO: 4842 - protein, 90 aa, Homo Sapiens
  misc_feature (1)..(1): Xaa can be any naturally occurring amino acid
XAAAQLSLTQLSSGNPVYEKYYRQVDTGNTGRVLASDAAAFLKKSGLPDLILGKIWDLADTDGKGILNKQHDTSSPLLISGTSAAELPWA

SEQ ID NO: 4843 - protein, 659 aa, Homo Sapiens
MDSQGRVWAQEMLLRVSPDHVTLLDPASKEELESYPLGAIVRCDAVMPPGRSRSLLLLVCQEPERAQPDVHFFQGLRLGAELIREDIQGALHNYRSGRGERRAAALRATQEELQRDRSPAAETPPLQRRPSVRAVISTVERGAGRGRPQAKPIPEAEEAQRPEPVGTSSNADSASPDLGPRGPDLAVLQAEREVDILNHVFDDVESFVSRLQKSAEAARVLEHRERGRRSRRRAAGEGLLTLRAKPPSEAEYTDVLQKIKYAFSLLARLRGNIADPSSPELLHFLFGPLQMIVNTSGGPEFASSVRRPHLTSDAVALLRDNVTPRENELWTSLGDSWTRPGLELSPEEGPPYRPEFFSGWEPPVTDPQSRAWEDPVEKQLQHERRRRQQSAPQVAVNGHRDLEPESEPQLESETAGKWVLCNYDFQARNSSELSVKQRDVLEVLDDSRKWWKVRDPAGQEGYVPYNILTPYPGPRLHHSQSPARSLNSTPPPPPAPAPAPPPALARPRWDRPRWDSCDSLNGLDPSEKEKFSQMLIVNEELQARLAQGRSGPSRAVPGPRAPEPQLSPGSDASEVRAWLQAKGFSSGTVDALGVLTGAQLFSLQKEELRAVSPEEGARVYSQVTVQRSLLEDKEKVSELEAVMEKQKKKVEGEVEMEVI

SEQ ID NO: 4844 - protein, 548 aa, Homo Sapiens
MGRKAIVLAIANTSLAFPLCQHLVTFCLGEDDGVHTVEDASRKLAVMDSQGRVWAQEMLLRVSPDHVTLLDPASKEELESYPLGAIVRCDAVMPPGRSRSLLLLVCQEPERAQPDVHFFQGLRLGAELIREDIQGALHNYRSGRGERRAAALRATQEELQRDRSPAAETPPLQRRPSVRAVISTVERGAGRGRPQAKPIPEAEEAQRPEPVGTSSNADSASPDLGPRGPDLAVLQAEREVDILNHVFDDVESFVSRLQKSAEAARVLEHRERGRRSRRRAAGEGLLTLRAKPPSEAEYTDVLQKIKYAFSLLARLRGNIADPSSPELLHFLFGPLQMIVNTSGGPEFASSVRRPHLTSDAVALLRDNVTPRENELWTSLGDSWTRPGLELSPEEGPPYRPEFFSGWEPPVTDPQSRAWEDPVEKQLQHERRRRQVTQATQQGRGWEVRGRGRSAWPRLTRLSYFLQQSAPQVAVNGHRDLEPESEPQLESETAGKWVLCNYDFQARNSSELSVKQRDVLEDKEKVSELEAVMEKQKKKVEGEVEMEVI

SEQ ID NO: 4845 - protein, 428 aa, Homo Sapiens
MHLVTFCLGEDDGVHTVEDASRKLAVMDSQGRVWAQEMLLRVSPDHVTLLDPASKEELESYPLGAIVRCDAVMPPGRSRSLLLLVCQEPERAQPDVHFFQGLRLGAELIREDIQGALHNYRSGRGERRAAALRATQEELQRDRSPAAETPPLQRRPSVRAVISTVERGAGRGRPQAKPIPEAEEAQRPEPVGTSSNADSASPDLGPRGPDLAVLQAEREVDILNHVFDDVESFVSRLQKSAEAARVLEHRERGRRSRRRAAGEGLLTLRAKPPSEAEYTDVLQKIKYAFSLLARLRGNIADPSSPELLHFLFGPLQMIVNTSGGPEFASSVRRPHLTSDAVALLRDNVTPRENELWTSLGDSWTRPGLELSPEEGPPYRPEFFSGWEPPVTDPQSRAWEDPVEKQLQHERRRRQQSAPQVAVNGWVRW

SEQ ID NO: 4846 - protein, 596 aa, Homo Sapiens
MNRTWPRRIWGSSQDEAELIREDIQGALHNYRSGRGERRAAALRATQEELQRDRSPAAETPPLQRRPSVRAVISTVERGAGRGRPQAKPIPEAEEAQRPEPVGTSSNADSASPDLGPRGPDLAVLQAEREVDILNHVFDDVESFVSRLQKSAEAARVLEHRERGRRSRRRAAGEGLLTLRAKPPSEAEYTDVLQKIKYAFSLLARLRGNIADPSSPELLHFLFGPLQMIVNTSGGPEFASSVRRPHLTSDAVALLRDNVTPRENELWTSLGDSWTRPGLELSPEEGPPYRPEFFSGWEPPVTDPQSRAWEDPVEKQLQHERRRRQQSAPQVAVNGHRDLEPESEPQLESETAGKWVLCNYDFQARNSSELSVKQRDVLEVLDDSRKWWKVRDPAGQEGYVPYNILTPYPGPRLHHSQSPARSLNSTPPPPPAPAPAPPPALARPRWDRPRWDSCDSLNGLDPSEKEKFSQMLIVNEELQARLAQGRSGPSRAVPGPRAPEPQLSPGSDASEVRAWLQAKGFSSGTVDALGVLTGAQLFSLQKEELRAVSPEEGARVYSQVTVQRSLLEDKEKVSELEAVMEKQKKKVEGEVEMEVI

SEQ ID NO: 4847 - protein, 409 aa, Homo Sapiens
MNRTWPRRIWGSSQDEVGFASSVRRPHLTSDAVALLRDNVTPRENELWTSLGDSWTRPGLELSPEEGPPYRPEFFSGWEPPVTDPQSRAWEDPVEKQLQHERRRRQVTQATQQGRGWEVRGRGRSAWPRLTRLSYFLQQSAPQVAVNGHRDLEPESEPQLESETAGKWVLCNYDFQARNSSELSVKQRDVLEVLDDSRKWWKVRDPAGQEGYVPYNILTPYPGPRLHHSQSPARSLNSTPPPPPAPAPAPPPALARPRWDRPRWDSCDSLNGLDPSEKEKFSQMLIVNEELQARLAQGRSGPSRAVPGPRAPEPQLSPGSDASEVRAWLQAKGFSSGTVDALGVLTGAQLFSLQKEELRAVSPEEGARVYSQVTVQRSLLEDKEKVSELEAVMEKQKKKVEGEVEMEVI

SEQ ID NO: 4848 - protein, 723 aa, Homo Sapiens
MSTATGPEAAPKPSAKSIYEQRKRYSTVVMADVSQYPVNHLVTFCLGEDDGVHTVEDASRKLAVMDSQGRVWAQEMLLRVSPDHVTLLDPASKEELESYPLGAIVRCDAVMPPGRSRSLLLLVCQEPERAQPDVHFFQGLRLGAELIREDIQGALHNYRSGRGERRAAALRATQEELQRDRSPAAETPPLQRRPSVRAVISTVERGAGRGRPQAKPIPEAEEAQRPEPVGTSSNADSASPDLGPRGPDLAVLQAEREVDILNHVFDDVESFVSRLQKSAEAARVLEHRERGRRSRRRAAGEGLLTLRAKPPSEAEYTDVLQKIKYAFSLLARLRGNIADPSSPELLHFLFGPLQMIVNTSGGPEFASSVRRPHLTSDAVALLRDNVTPRENELWTSLGDSWTRPGLELSPEEGPPYRPEFFSGWEPPVTDPQSRAWEDPVEKQLQHERRRRQQSAPQVAVNGHRDLEPESEPQLESETAGKWVLCNYDFQARNSSELSVKQRDVLEVLDDSRKWWKVRDPAGQEGYVPYNILTPYPGPRLHHSQSPARSLNSTPPPPPAPAPAPPPALARPRWDRPRWDSCDSLNGLDPSEKEKFSQMLIVNEELQARLAQGRSGPSRAVPGPRAPEPQLSPGSDASEVRAWLQAKGFSSGTVDALGVLTGAQLFSLQKEELRAVSPEEGARVYSQVTVQRSLLEDKEKVSELEAVMEKQKKKVEGEVEMEVI

SEQ ID NO: 4849 - protein, 715 aa, Homo Sapiens
MHLLPALAGVLATLVLAQPCEGTDPASPGAVETSVLRDCIAEAKLLVDAAYNWTQKSIKQRLRSGSASPMDLLSYFKQPVAATRTVVRAADYMHVALGLLEEKLQPQRSGPFNVTDVLTEPQLRLLSQASGCALRDQAERCSDKYRTITGRCNNKRRPLLGASNQALARWLPAEYEDGLSLPFGWTPSRRRNGFLLPLVRAVSNQIVRFPNERLTSDRGRALMFMQWGQFIDHDLDFSPESPARVAFTAGVDCERTCAQLPPCFPIKIPPNDPRIKNQRDCIPFFRSAPSCPQNKNRVRNQINALTSFVDASMVYGSEVSLSLRLRNRTNYLGLLAINQRFQDNGRALLPFDNLHDDPCLLTNRSARIPCFLAGDTRSTETPKLAAMHTLFMREHNRLATELRRLNPRWNGDKLYNEARKIMGAMVQIITYRDFLPLVLGKARARRTLGHYRGYCSNVDPRVANVFTLAFRFGHTMLQPFMFRLDSQYRASAPNSHVPLSSAFFASWRIVYEGGIDPILRGLMATPAKLNRQDAMLVDELRDRLFRQVRRIGLDLAALNMQRSRDHGLPGYNAWRRFCGLSQPRNLAQLSRVLKNQDLARKFLNLYGTPDNIDIWIGAIAEPLLPGARVGPLLACLFENQFRRARDGDRFWWQKRGVFTKRQRKALSRISLSRIICDNTGITTVSRDIFRANIYPRGFVNCSRIPRLNLSAWRGT

SEQ ID NO: 4850 - protein, 234 aa, Homo Sapiens
MKTLAGLVLGLVIFDAAVTAPTLESINYDSETYDATLEDLDNLYNYENIPVDKVEIEIATVMPSGNRELLTPPPQPEKAQEEEEEEESTPRLIDGSSPQEPEFTGVLGPHTNEDFPTCLLCTCISTTVYCDDHELDAIPPLPKNTAYFYSRFNRIKKINKNDFASLSDLKRIDLTSNLISEIDEDAFRKLPQLRELVLRDNKIRQLPELPTTLTFIDISNNRLGRKGIKQEAFK

SEQ ID NO: 4851 - protein, 322 aa, Homo Sapiens
MKTLAGLVLGLVIFDAAVTAPTLESINYDSETYDATLEDLDNLYNYENIPVDKVEIEIATVMPSGNRELLTPPPQPEKAQEEEEEEESTPRLIDGSSPQEPEFTGVLGPHTNEDFPTCLLCTCISTTVYCDDHELDAIPPLPKNTAYFYSRFNRIKKINKNDFASLSDLKRIDLTSNLISEIDEDAFRKLPQLRELVLRDNKIRQLPELPTTLTFIDISNNRLGRKGIKQEAFKDMYDLHHLYLTDNNLDHIPLPLPENLRALHLQNNNILEMHEDTFCNVKNLTYIRKALEDIRLDGNPINLSKTPQAYMCLPRLPVGSLV

SEQ ID NO: 4852 - protein, 294 aa, Homo Sapiens
MNFILFIFIPGVFSLKSSTLKPTIEALPNVLPLNEDVNKQEEKNEDHTPNYAPANEKNGNYYKDIKQYVFTTQNPNGTESEISVRATTDLNFALKNDKTVNATTYEKSTIEEETTTSEPSHKNIQRSTPNVPAFWTMLAKAINGTAVVMDDKDQLFHPIPESDVNATQGENQPDLEDLKIKIMLGISLMTLLLFVVLLAFCSATLYKLRHLSYKSCESQYSVNPELATMSYFHPSEGVSDTSFSKSAESSTFLGTTSSDMRRSGTRTSESKIMTDIISIGSDNEMHENDESVTR

SEQ ID NO: 4853 - protein, 127 aa, Homo Sapiens
MNFILFIFIPGVFSLKSSTLKPTIEALPNVLPLNEDVNKQEEKNEDHTPNYAPANEKNGNYYKDIKQYVFTTQNPNGTESEISVRATTDLNFALKNDKTVNATTYEKSTIEEETTTSEPSHKNIQSI

SEQ ID NO: 4854 - protein, 265 aa, Homo Sapiens
MNFILFIFIPGVFSLKSSTLKPTIEALPNVLPLNEDVNKQEEKNEDHTPNYAPANEKNGNYYKDIKQYVFTTQNPNGTESEISVRATTDLNFALKNGSTPNVPAFWTMLAKAINGTAVVMDDKDQLFHPIPESDVNATQGENQPDLEDLKIKIMLGISLMTLLLFVVLLAFCSATLYKLRHLSYKSCESQYSVNPELATMSYFHPSEGVSDTSFSKSAESSTFLGTTSSDMRRSGTRTSESKIMTDIISIGSDNEMHENDESVTR

SEQ ID NO: 4855 - protein, 9 aa, Homo Sapiens
MAFPCFDEP

SEQ ID NO: 4856 - protein, 129 aa, Homo Sapiens
MVFLPLKWSLATMSFLLSSLLALLTVSTPSWCQSTEASPKRSDGTPFPWNKIRLPEYVIPVHYDLLIHANLTTLTFWGTTKVEITASQPTSTIILHSHHLQISRATLRKGAGERLSEEPLQVLEHPRQE

SEQ ID NO: 4857 - protein, 948 aa, Homo Sapiens
MVFLPLKWSLATMSFLLSSLLALLTVSTPSWCQSTEASPKRSDGTPFPWNKIRLPEYVIPVHYDLLIHANLTTLTFWGTTKVEITASQPTSTIILHSHHLQISRATLRKGAGERLSEEPLQVLEHPRQEQIALLAPEPLLVGLPYTVVIHYAGNLSETFHGFYKSTYRTKEGELRILASTQFEPTAARMAFPCFDEPAFKASFSIKIRREPRHLAISNMPLVKSVTVAEGLIEDHFDVTVKMSTYLVAFIISDFESVSKITKSGVKVSVYAVPDKINQADYALDAAVTLLEFYEDYFSIPYPLPKQDLAAIPDFQSGAMENWGLTTYRESALLFDAEKSSASSKLGITMTVAHELAHQWFGNLVTMEWWNDLWLNEGFAKFMEFVSVSVTHPELKVGDYFFGKCFDAMEVDALNSSHPVSTPVENPAQIREMFDDVSYDKGACILNMLREYLSADAFKSGIVQYLQKHSYKNTKNEDLWDSMASICPTDGVKGMDGFCSRSQHSSSSSHWHQEGVDVKTMMNTWTLQKGFPLITITVRGRNVHMKQEHYMKGSDGAPDTGYLWHVPLTFITSKSDMVHRFLLKTKTDVLILPEEVEWIKFNVGMNGYYIVHYEDDGWDSLTGLLKGTHTAVSSNDRASLINNAFQLVSIGKLSIEKALDLSLYLKHETEIMPVFQGLNELIPMYKLMEKRDMNEVETQFKAFLIRLLRDLIDKQTWTDEGSVSERMLRSQLLLLACVHNYQPCVQRAEGYFRKWKESNGNLSLPVDVTLAVFAVGAQSTEGWDFLYSKYQFSLSSTEKSQIEFALCRTQNKEKLQWLLDESFKGDKIKTQEFPQILTLIGRNPVGYPLAWQFLRKNWNKLVQKFELGSSSIAHMVMGTTNQFSTRTRLEEVKGFFSSLKENGSQLRCVQQTIETIEENIGWMDKNFDKIRVWLQSEKLEHDPEADATG

SEQ ID NO: 4858 - protein, 941 aa, Homo Sapiens
MVFLPLKWSLATMSFLLSSLLALLTVSTPSWCQSTEASPKRSDGTPFPWNKIRLPEYVIPVHYDLLIHANLTTLTFWGTTKVEITASQPTSTIILHSHHLQISRATLRKGAGERLSEEPLQVLEHPRQEQIALLAPEPLLVGLPYTVVIHYAGNLSETFHGFYKSTYRTKEGELRILASTQFEPTAARMAFPCFDEPAFKASFSIKIRREPRHLAISNMPLVKSVTVAEGLIEDHFDVTVKMSTYLVAFIISDFESVSKITKSGVKVSVYAVPDKINQADYALDAAVTLLEFYEDYFSIPYPLPKQDLAAIPDFQSGAMENWGLTTYRESALLFDAEKSSASSKLGITMTVAHELAHQWFGNLVTMEWWNDLWLNEGFAKFMEFVSVSVTHPELKVGDYFFGKCFDAMEVDALNSSHPVSTPVENPAQIREMFDDVSYDKGACILNMLREYLSADAFKSGIVQYLQKHSYKNTKNEDLWDSMASICPTDGVKGMDGFCSRSQHSSSSSHWHQEGVDVKTMMNTWTLQKGFPLITITVRGRNVHMKQEHYMKGSDGAPDTGYLWHVPLTFITSKSDMVHRFLLKTKTDVLILPEEVEWIKFNVGMNGYYIVHYEDDGWDSLTGLLKGTHTAVSSNDRASLINNAFQLVSIGKLSIEKALDLSLYLKHETEIMPVFQGLNELIPMYKLMEKRDMNEVETQFKAFLIRLLRDLIDKQTWTDEGSVSERMLRSQLLLLACVHNYQPCVQRAEGYFRKWKESNGNLSLPVDVTLAVFAVGAQSTEGWDFLYSKYQFSLSSTEKSQIEFALCRTQNKEKLQWLLDESFKGDKIKTQEFPQILTLIGRNPVGYPLAWQFLRKNWNKLVQKFELGSSSIAHMVMGTTNQFSTRTRLEEVKGFFSSLKENGSQLRCVQQTIETIEENIGWMDKNFDKIRVWLQSEKLERM

SEQ ID NO: 4859 - protein, 144 aa, Homo Sapiens
  misc_feature (1)..(1): Xaa can be any naturally occurring amino acid
XKGDKIKTQEFPQILTLIGRNPVGYPLAWQFLRKNWNKLVQKFELGSSSIAHMVMGTTNQFSTRTRLEEVKGFFSSLKENGSQLRCVQQTIETIEENIGWMDKNFDKIRVWLQSEKLERVALQRKPKCWVPCHRRIKYLILLIL

SEQ ID NO: 4860 - protein, 960 aa, Homo Sapiens
MFHSSAMVNSHRKPMFNIHRGFYCLTAILPQICICSQFSVPSSYHFTEDPGAFPVATNGERFPWQELRLPSVVIPLHYDLFVHPNLTSLDFVASEKIEVLVSNATQFIILHSKDLEITNATLQSEEDSRYMKPGKELKVLSYPAHEQIALLVPEKLTPHLKYYVAMDFQAKLGDGFEGFYKSTYRTLGGETRILAVTDFEPTQARMAFPCFDEPLFKANFSIKIRRESRHIALSNMPKVKTIELEGGLLEDHFETTVKMSTYLVAYIVCDFHSLSGFTSSGVKVSIYASPDKRNQTHYALQASLKLLDFYEKYFDIYYPLSKLDLIAIPDFAPGAMENWGLITYRETSLLFDPKTSSASDKLWVTRVIAHELAHQWFGNLVTMEWWNDIWLKEGFAKYMELIAVNATYPELQFDDYFLNVCFEVITKDSLNSSRPISKPAETPTQIQEMFDEVSYNKGACILNMLKDFLGEEKFQKGIIQYLKKFSYRNAKNDDLWSSLSNSCLESDFTSGGVCHSDPKMTSNMLAFLGENAEVKEMMTTWTLQKGIPLLVVKQDGCSLRLQQERFLQGVFQEDPEWRALQERYLWHIPLTYSTSSSNVIHRHILKSKTDTLDLPEKTSWVKFNVDSNGYYIVHYEGHGWDQLITQLNQNHTLLRPKDRVGLIHDVFQLVGAGRLTLDKALDMTYYLQHETSSPALLEGLSYLESFYHMMDRRNISDISENLKRYLLQYFKPVIDRQSWSDKGSVWDRMLRSALLKLACDLNHAPCIQKAAELFSQWMESSGKLNIPTDVLKIVYSVGAQTTAGWNYLLEQYELSMSSAEQNKILYALSTSKHQEKLLKLIELGMEGKVIKTQNLAALLHAIARRPKGQQLAWDFVRENWTHLLKKFDLGSYDIRMIISGTTAHFSSKDKLQEVKLFFESLEAQGSHLDIFQTVLETITKNIKWLEKNLPTLRTWLMVNT

SEQ ID NO: 4861 - protein, 350 aa, Homo Sapiens
MFHSSAMVNSHRKPMFNIHRGFYCLTAILPQICICSQFSVPSSYHFTEDPGAFPVATNGERFPWQELRLPSVVIPLHYDLFVHPNLTSLDFVASEKIEVLVSNATQFIILHSKDLEITNATLQSEEDSRYMKPGKELKVLSYPAHEQIALLVPEKLTPHLKYYVAMDFQAKLGDGFEGFYKSTYRTLGGETRILAVTDFEPTQARMAFPCFDEPLFKANFSIKIRRESRHIALSNMPKVKTIELEGGLLEDHFETTVKMSTYLVAYIVCDFHSLSGFTSSGVKVSIYASPDKRNQTHYALQASLKLLDFYEKYFDIYYPLSKLGMFKFHIIVFIFAHKTCFDLFPLSLSM

SEQ ID NO: 4862 - protein, 694 aa, Homo Sapiens
MFHSSAMVNSHRKPMFNIHRGFYCLTAILPQICICSQFSVPSSYHFTEDPGAFPVATNGERFPWQELRLPSVVIPLHYDLFVHPNLTSLDFVASEKIEVLVSNATQFIILHSKDLEITNATLQSEEDSRYMKPGKELKVLSYPAHEQIALLVPEKLTPHLKYYVAMDFQAKLGDGFEGFYKSTYRTLGGETRILAVTDFEPTQARMAFPCFDEPLFKANFSIKIRRESRHIALSNMPKVKTIELEGGLLEDHFETTVKMSTYLVAYIVCDFHSLSGFTSSGVKVSIYASPDKRNQTHYALQASLKLLDFYEKYFDIYYPLSKLDLIAIPDFAPGAMENWGLITYRETSLLFDPKTSSASDKLWVTRVIAHELAHQWFGNLVTMEWWNDIWLKEGFAKYMELIAVNATYPELQFDDYFLNVCFEVITKDSLNSSRPISKPAETPTQIQEMFDEVSYNKGACILNMLKDFLGEEKFQKGIIQYLKKFSYRNAKNDDLWSSLSNSCLESDFTSGGVCHSDPKMTSNMLAFLGENAEVKEMMTTWTLQKGIPLLVVKQDGCSLRLQQERFLQGVFQEDPEWRALQERYLWHIPLTYSTSSSNVIHRHILKSKTDTLDLPEKTSWVKFNVDSNGYYIVHYEGHGWDQLITQLNQNHTLLRPKDRVGLIHDVFQLVGAGRLTLDKALDMTYYLQHETSSP

SEQ ID NO: 4863 - protein, 532 aa, Homo Sapiens
MFHSSAMVNSHRKPMFNIHRGFYCLTAILPQICICSQFSVPSSYHFTEDPGAFPVATNGERFPWQELRLPSVVIPLHYDLFVHPNLTSLDFVASEKIEVLVSNATQFIILHSKDLEITNATLQSEEDSRYMKPGKELKVLSYPAHEQIALLVPEKLTPHLKYYVAMDFQAKLGDGFEGFYKSTYRTLGGETRILAVTDFEPTQARMAFPCFDEPLFKANFSIKIRRESRHIALSNMPKVKTIELEGGLLEDHFETTVKMSTYLVAYIVCDFHSLSGFTSSGVKVSIYASPDKRNQTHYALQASLKLLDFYEKYFDIYYPLSKLDLIAIPDFAPGAMENWGLITYRETSLLFDPKTSSASDKLWVTRVIAHELAHQWFGNLVTMEWWNDIWLKEGFAKYMELIAVNATYPELQFDDYFLNVCFEVITKDSLNSSRPISKPAETPTQIQEMFDEVSYNKGACILNMLKDFLGEEKFQKGIIQYLKKFSYRNAKNDDLWSSLSNSCLESDFTSGGVCHSDPKMTSNMVRIKRVTE

SEQ ID NO: 4864 - protein, 915 aa, Homo Sapiens
MFHSSAMVNSHRKPMFNIHRGFYCLTAILPQICICSQFSVPSSYHFTEDPGAFPVATNGERFPWQELRLPSVVIPLHYDLFVHPNLTSLDFVASEKIEVLVSNATQFIILHSKDLEITNATLQSEEDSRYMKPGKELKVLSYPAHEQIALLVPEKLTPHLKYYVAMDFQAKLGDGFEGFYKSTYRTLGGETRILAVTDFEPTQARMAFPCFDEPLFKANFSIKIRRESRHIALSNMPKVSIYASPDKRNQTHYALQASLKLLDFYEKYFDIYYPLSKLDLIAIPDFAPGAMENWGLITYRETSLLFDPKTSSASDKLWVTRVIAHELAHQWFGNLVTMEWWNDIWLKEGFAKYMELIAVNATYPELQFDDYFLNVCFEVITKDSLNSSRPISKPAETPTQIQEMFDEVSYNKGACILNMLKDFLGEEKFQKGIIQYLKKFSYRNAKNDDLWSSLSNSCLESDFTSGGVCHSDPKMTSNMLAFLGENAEVKEMMTTWTLQKGIPLLVVKQDGCSLRLQQERFLQGVFQEDPEWRALQERYLWHIPLTYSTSSSNVIHRHILKSKTDTLDLPEKTSWVKFNVDSNGYYIVHYEGHGWDQLITQLNQNHTLLRPKDRVGLIHDVFQLVGAGRLTLDKALDMTYYLQHETSSPALLEGLSYLESFYHMMDRRNISDISENLKRYLLQYFKPVIDRQSWSDKGSVWDRMLRSALLKLACDLNHAPCIQKAAELFSQWMESSGKLNIPTDVLKIVYSVGAQTTAGWNYLLEQYELSMSSAEQNKILYALSTSKHQEKLLKLIELGMEGKVIKTQNLAALLHAIARRPKGQQLAWDFVRENWTHLLKKFDLGSYDIRMIISGTTAHFSSKDKLQEVKLFFESLEAQGSHLDIFQTVLETITKNIKWLEKNLPTLRTWLMVNT

SEQ ID NO: 4865 - protein, 29 aa, Homo Sapiens
MLHRVDGLVSQGQDPSGRILAVTDFEPTQ

SEQ ID NO: 4866 - protein, 79 aa, Homo Sapiens
  misc_feature (1)..(1): Xaa can be any naturally occurring amino acid
XGKVIKTQNLAALLHAIARRPKGQQLAWDFVRENWTHLLKKFDLGSYDIRMIISGTTAHFSSKDKLQEVCDFLFLTISK

SEQ ID NO: 4867 - protein, 163 aa, Homo Sapiens
  misc_feature (1)..(1): Xaa can be any naturally occurring amino acid
XQTHYALQASLKLLDFYEKYFDIYYPLSKLDLIAIPDFAPGAMENWGLITYRETSLLFDPKTSSASDKLWVTRVIAHELAHQWFGNLVTMEWWNDIWLKEGFAKYMELIAVNATYPELQFGACILNMLKDFLGEEKFQKGIIQYLKKFSYRNAKNDDLWSSLS

SEQ ID NO: 4868 - protein, 649 aa, Homo Sapiens
CLSCRNYSRGGVCVTHCNFLNGEPREFAHEAECFSCHPECQPMEGTATCNGSGSDTCAQCAHFRDGPHCVSSCPHGVLGAKGPIYKYPDVQNECRPCHENCTQGCKGPELQDCLGQTLVLIGKTHLTMALTVIAGLVVIFMMLGGTFLYWRGRRIQNKRAMRRYLERGESIEPLDPSEKTPIKWMALESIHFGKYTHQSDVWSYGVTVWELMTFGAEPYAGLRLAEVPDLLEKGERLAQPQICTIDVYMVMVKCWMIDENIRPTFKELANEFTRMARDPPRYLVIKRESGPGIAPGPEPHGLTNKKLEEVELEPELDLDLDLEAEEDNLATTTLGSALSLPVGTLNRPRGSQSLLSPSSGYMPMNQGNLGESCQESAVSGSSERCPRPVSLHPMPRGCLASESSEGHVTGSEAELQEKVSMCRSRSRSRSPRPRGDSAYHSQRHSLLTPVTPLSPPGLEEEDVNGYVMPDTHLKGTPSSREGTLSSVGLSSVLGTEEEDEDEEYEYMNRRRRHSPPHPPRPSSLEELGYEYMDVGSDLSASLGSTQSCPLHPVPIMPTAGTTPDEDYEYMNRQRDGGGPGGDYAAMGACPASEQGYEEMRAFQGPGHQAPHVHYARLKTLRSLEATDSAFDNPDYWHSRLFPKANAQRT

SEQ ID NO: 4869 - protein, 81 aa, Homo Sapiens
LDIKHNRPRRDCVAEGKVCDPLCSSGGCWGPGPGQCLSCRNYSRGGVCVTHCNFLNGYSKGSQSRMGGGGALQWNCSGGIQ

SEQ ID NO: 4870 - protein, 19 aa, Homo Sapiens
MGNLEIVLTGHNADLSFLQ

SEQ ID NO: 4871 - protein, 115 aa, Homo Sapiens
MGNLEIVLTGHNADLSFLQWIREVTGYVLVAMNEFSTLPLPNLRVVRGTQVYDGKFAIFVMLNYNTNSSHALRQLRLTQLTEILSGGVYIEKNDKLCHMDTIDWRDIVRDRDAEI

SEQ ID NO: 4872 - protein, 116 aa, Homo Sapiens
MGNLEIVLTGHNADLSFLQWIREVTGYVLVAMNEFSTLPLPNLRVVRGTQVYDGKFAIFVMLNYNTNSSHALRQLRLTQLTEILSGGVYIEKNDKLCHMDTIDWRDIVRDRDAEIV

SEQ ID NO: 4873 - protein, 1283 aa, Homo Sapiens
MGNLEIVLTGHNADLSFLQWIREVTGYVLVAMNEFSTLPLPNLRVVRGTQVYDGKFAIFVMLNYNTNSSHALRQLRLTQLTEILSGGVYIEKNDKLCHMDTIDWRDIVRDRDAEIVVKDNGRSCPPCHEVCKGRCWGPGSEDCQTLTKTICAPQCNGHCFGPNPNQCCHDECAGGCSGPQDTDCFACRHFNDSGACVPRCPQPLVYNKLTFQLEPNPHTKYQYGGVCVASCPHNFVVDQTSCVRACPPDKMEVDKNGLKMCEPCGGLCPKACEGTGSGSRFQTVDSSNIDGFVNCTKILGNLDFLITGLNGDPWHKIPALDPEKLNVFRTVREITGYLNIQSWPPHMHNFSVFSNLTTIGGRSLYNRGFSLLIMKNLNVTSLGFRSLKEISAGRIYISANRQLCYHHSLNWTKVLRGPTEERLDIKHNRPRRDCVAEGKVCDPLCSSGGCWGPGPGQCLSCRNYSRGGVCVTHCNFLNGEPREFAHEAECFSCHPECQPMEGTATCNGSGSDTCAQCAHFRDGPHCVSSCPHGVLGAKGPIYKYPDVQNECRPCHENCTQGCKGPELQDCLGQTLVLIGKTHLTMALTVIAGLVVIFMMLGGTFLYWRGRRIQNKRAMRRYLERGESIEPLDPSEKANKVLARIFKETELRKLKVLGSGVFGTVHKGVWIPEGESIKIPVCIKVIEDKSGRQSFQAVTDHMLAIGSLDHAHIVRLLGLCPGSSLQLVTQYLPLGSLLDHVRQHRGALGPQLLLNWGVQIAKGMYYLEEHGMVHRNLAARNVLLKSPSQVQVADFGVADLLPPDDKQLLYSEAKTPIKWMALESIHFGKYTHQSDVWSYGVTVWELMTFGAEPYAGLRLAEVPDLLEKGERLAQPQICTIDVYMVMVKCWMIDENIRPTFKELANEFTRMARDPPRYLVIKRESGPGIAPGPEPHGLTNKKLEEVELEPELDLDLDLEAEEDNLATTTLGSALSLPVGTLNRPRGSQSLLSPSSGYMPMNQGNLGESCQESAVSGSSERCPRPVSLHPMPRGCLASESSEGHVTGSEAELQEKVSMCRSRSRSRSPRPRGDSAYHSQRHSLLTPVTPLSPPGLEEEDVNGYVMPDTHLKGTPSSREGTLSSVGLSSVLGTEEEDEDEEYEYMNRRRRHSPPHPPRPSSLEELGYEYMDVGSDLSASLGSTQSCPLHPVPIMPTAGTTPDEDYEYMNRQRDGGGPGGDYAAMGACPASEQGYEEMRAFQGPGHQAPHVHYARLKTLRSLEATDSAFDNPDYWHSRLFPKANAQRT

SEQ ID NO: 4874 - protein, 583 aa, Homo Sapiens
MLAIGSLDHAHIVRLLGLCPGSSLQLVTQYLPLGSLLDHVRQHRGALGPQLLLNWGVQIAKGMYYLEEHGMVHRNLAARNVLLKSPSQVQVADFGVADLLPPDDKQLLYSEAKTPIKWMALESIHFGKYTHQSDVWSYGVTVWELMTFGAEPYAGLRLAEVPDLLEKGERLAQPQICTIDVYMVMVKCWMIDENIRPTFKELANEFTRMARDPPRYLVIKRESGPGIAPGPEPHGLTNKKLEEVELEPELDLDLDLEAEEDNLATTTLGSALSLPVGTLNRPRGSQSLLSPSSGYMPMNQGNLGESCQESAVSGSSERCPRPVSLHPMPRGCLASESSEGHVTGSEAELQEKVSMCRSRSRSRSPRPRGDSAYHSQRHSLLTPVTPLSPPGLEEEDVNGYVMPDTHLKGTPSSREGTLSSVGLSSVLGTEEEDEDEEYEYMNRRRRHSPPHPPRPSSLEELGYEYMDVGSDLSASLGSTQSCPLHPVPIMPTAGTTPDEDYEYMNRQRDGGGPGGDYAAMGACPASEQGYEEMRAFQGPGHQAPHVHYARLKTLRSLEATDSAFDNPDYWHSRLFPKANAQRT

SEQ ID NO: 4875 - protein, 462 aa, Homo Sapiens
MPMSTILPVTSPCLPATGVTVWELMTFGAEPYAGLRLAEVPDLLEKGERLAQPQICTIDVYMVMVKCWMIDENIRPTFKELANEFTRMARDPPRYLVIKRESGPGIAPGPEPHGLTNKKLEEVELEPELDLDLDLEAEEDNLATTTLGSALSLPVGTLNRPRGSQSLLSPSSGYMPMNQGNLGESCQESAVSGSSERCPRPVSLHPMPRGCLASESSEGHVTGSEAELQEKVSMCRSRSRSRSPRPRGDSAYHSQRHSLLTPVTPLSPPGLEEEDVNGYVMPDTHLKGTPSSREGTLSSVGLSSVLGTEEEDEDEEYEYMNRRRRHSPPHPPRPSSLEELGYEYMDVGSDLSASLGSTQSCPLHPVPIMPTAGTTPDEDYEYMNRQRDGGGPGGDYAAMGACPASEQGYEEMRAFQGPGHQAPHVHYARLKTLRSLEATDSAFDNPDYWHSRLFPKANAQRT

SEQ ID NO: 4876 - protein, 126 aa, Homo Sapiens
MRANDALQVLGLLFSLARGSEVGNSQAVCPGTLNGLSVTGDAENQYQTLYKLYERCEVVMGNLEIVLTGHNADLSFLQWIREVTGYVLVAMNEFSTLPLPNLRVVRGTQVYDGKFAIFVMLNYNTN

SEQ ID NO: 4877 - protein, 1342 aa, Homo Sapiens
MRANDALQVLGLLFSLARGSEVGNSQAVCPGTLNGLSVTGDAENQYQTLYKLYERCEVVMGNLEIVLTGHNADLSFLQWIREVTGYVLVAMNEFSTLPLPNLRVVRGTQVYDGKFAIFVMLNYNTNSSHALRQLRLTQLTEILSGGVYIEKNDKLCHMDTIDWRDIVRDRDAEIVVKDNGRSCPPCHEVCKGRCWGPGSEDCQTLTKTICAPQCNGHCFGPNPNQCCHDECAGGCSGPQDTDCFACRHFNDSGACVPRCPQPLVYNKLTFQLEPNPHTKYQYGGVCVASCPHNFVVDQTSCVRACPPDKMEVDKNGLKMCEPCGGLCPKACEGTGSGSRFQTVDSSNIDGFVNCTKILGNLDFLITGLNGDPWHKIPALDPEKLNVFRTVREITGYLNIQSWPPHMHNFSVFSNLTTIGGRSLYNRGFSLLIMKNLNVTSLGFRSLKEISAGRIYISANRQLCYHHSLNWTKVLRGPTEERLDIKHNRPRRDCVAEGKVCDPLCSSGGCWGPGPGQCLSCRNYSRGGVCVTHCNFLNGEPREFAHEAECFSCHPECQPMEGTATCNGSGSDTCAQCAHFRDGPHCVSSCPHGVLGAKGPIYKYPDVQNECRPCHENCTQGCKGPELQDCLGQTLVLIGKTHLTMALTVIAGLVVIFMMLGGTFLYWRGRRIQNKRAMRRYLERGESIEPLDPSEKANKVLARIFKETELRKLKVLGSGVFGTVHKGVWIPEGESIKIPVCIKVIEDKSGRQSFQAVTDHMLAIGSLDHAHIVRLLGLCPGSSLQLVTQYLPLGSLLDHVRQHRGALGPQLLLNWGVQIAKGMYYLEEHGMVHRNLAARNVLLKSPSQVQVADFGVADLLPPDDKQLLYSEAKTPIKWMALESIHFGKYTHQSDVWSYGVTVWELMTFGAEPYAGLRLAEVPDLLEKGERLAQPQICTIDVYMVMVKCWMIDENIRPTFKELANEFTRMARDPPRYLVIKRESGPGIAPGPEPHGLTNKKLEEVELEPELDLDLDLEAEEDNLATTTLGSALSLPVGTLNRPRGSQSLLSPSSGYMPMNQGNLGESCQESAVSGSSERCPRPVSLHPMPRGCLASESSEGHVTGSEAELQEKVSMCRSRSRSRSPRPRGDSAYHSQRHSLLTPVTPLSPPGLEEEDVNGYVMPDTHLKGTPSSREGTLSSVGLSSVLGTEEEDEDEEYEYMNRRRRHSPPHPPRPSSLEELGYEYMDVGSDLSASLGSTQSCPLHPVPIMPTAGTTPDEDYEYMNRQRDGGGPGGDYAAMGACPASEQGYEEMRAFQGPGHQAPHVHYARLKTLRSLEATDSAFDNPDYWHSRLFPKANAQRT

SEQ ID NO: 4878 - protein, 921 aa, Homo Sapiens
MRANDALQVLGLLFSLARGSEVGNSQAVCPGTLNGLSVTGDAENQYQTLYKLYERCEVVMGNLEIVLTGHNADLSFLQWIREVTGYVLVAMNEFSTLPLPNLRVVRGTQVYDGKFAIFVMLNYNTNSSHALRQLRLTQLTEILSGGVYIEKNDKLCHMDTIDWRDIVRDRDAEIVVKDNGRSCPPCHEVCKGRCWGPGSEDCQTLTKTICAPQCNGHCFGPNPNQCCHDECAGGCSGPQDTDCFACRHFNDSGACVPRCPQPLVYNKLTFQLEPNPHTKYQYGGVCVASCPHNFVVDQTSCVRACPPDKMEVDKNGLKMCEPCGGLCPKACEGTGSGSRFQTVDSSNIDGFVNCTKILGNLDFLITGLNGDPWHKIPALDPEKLNVFRTVREITGYLNIQSWPPHMHNFSVFSNLTTIGGRSLYNRGFSLLIMKNLNVTSLGFRSLKEISAGRIYISANRQLCYHHSLNWTKVLRGPTEERLDIKHNRPRRDCVAEGKVCDPLCSSGGCWGPGPGQCLSCRNYSRGGVCVTHCNFLNGEPREFAHEAECFSCHPECQPMEGTATCNGSGSDTCAQCAHFRDGPHCVSSCPHGVLGAKGPIYKYPDVQNECRPCHENCTQGCKGPELQDCLGQTLVLIGKTHLTMALTVIAGLVVIFMMLGGTFLYWRGRRIQNKRAMRRYLERGESIEPLDPSEKANKVLARIFKETELRKLKVLGSGVFGTVHKGVWIPEGESIKIPVCIKVIEDKSGRQSFQAVTDHMLAIGSLDHAHIVRLLGLCPGSSLQLVTQYLPLGSLLDHVRQHRGALGPQLLLNWGVQIAKGMYYLEEHGMVHRNLAARNVLLKSPSQVQVADFGVADLLPPDDKQLLYSEAKTPIKWMALESIHFGKYTHQSDVWSYGQCIWMPSLPSLAPVSNLPFETPS

SEQ ID NO: 4879 - protein, 331 aa, Homo Sapiens
MRANDALQVLGLLFSLARGSEVGNSQAVCPGTLNGLSVTGDAENQYQTLYKLYERCEVVMGNLEIVLTGHNADLSFLQWIREVTGYVLVAMNEFSTLPLPNLRVVRGTQVYDGKFAIFVMLNYNTNSSHALRQLRLTQLTEILSGGVYIEKNDKLCHMDTIDWRDIVRDRDAEIVVKDNGRSCPPCHEVCKGRCWGPGSEDCQTLTKTICAPQCNGHCFGPNPNQCCHDECAGGCSGPQDTDCFACRHFNDSGACVPRCPQPLVYNKLTFQLEPNPHTKYQYGGVCVASCPHNFVVDQTSCVRACPPDKMEVDKNGLKMCEPCGGLCPKAF

SEQ ID NO: 4880 - protein, 183 aa, Homo Sapiens
MRANDALQVLGLLFSLARGSEVGNSQAVCPGTLNGLSVTGDAENQYQTLYKLYERCEVVMGNLEIVLTGHNADLSFLQWIREVTGYVLVAMNEFSTLPLPNLRVVRGTQVYDGKFAIFVMLNYNTNSSHALRQLRLTQLTGQFPMVPSGLTPQPAQDWYLLDDDPRLLTLSASSKVPVTLAAV

SEQ ID NO: 4881 - protein, 43 aa, Homo Sapiens
MRANDALQVPRAQSTSTQMFRMNVGPAMRTAPRGVKDQSFKTV

SEQ ID NO: 4882 - protein, 354 aa, Homo Sapiens
MAPARRPAGARLLLVYAGLLAAAAAGLGSPEPGAPSRSRARREPPPGNELPRGPGESRAGPAARPPEPTAERAHSVDPRDAWMLFVRQSDKGVNGKKRSRGKAKKLKFGLPGPPGPPGPQGPPGPIIPPEALLKEFQLLLKGAVRQRERAEPEPCTCGPAGPVAASLAPVSATAGEDDDDVVGDVLALLAAPLAPGPRAPRVEAAFLCRLRRDALVERRALHELGVYYLPDAEGAFRRGPGLNLTSGQYRAPVAGFYALAATLHVALGEPPRRGPPRPRDHLRLLICIQSRCQRNASLEAIMGLESSSELFTISVNGVLYLQMGQWTSVFLDNASGCSLTVRSGSHFSAVLLGV

SEQ ID NO: 4883 - protein, 63 aa, Homo Sapiens
  misc_feature (1)..(1): Xaa can be any naturally occurring amino acid
XFGYSSLEAIMGLESSSELFTISVNGVLYLQMGQWTSVFLDNASGCSLTVRSGSHFSAVLLGV

SEQ ID NO: 4884 - protein, 74 aa, Homo Sapiens
  misc_feature (1)..(1): Xaa can be any naturally occurring amino acid
XIQSRCQRNASLEAIMGLESSSELFTISVNGVLYLQATKNLVPQDLLGAKLVWQGRSGLGEKGAMASHLHLLTN

SEQ ID NO: 4885 - protein, 275 aa, Homo Sapiens
MNMTQARVLVAAVVGLVAVLLYASIHKIEEGHLAVYYRGGALLTSPSGPGYHIMLPFITTFRSVQTTLQTDEVKNVPCGTSGGVMIYIDRIEVVNMLAPYAVFDIVRNYTADYDKTLIFNKIHHELNQFCSAHTLQEVYIELFDQIDENLKQALQKDLNLMAPGLTIQAVRVTKPKIPEAIRRNFELMEAEKTKLLIAAQKQKVVEKEAETERKKAVIEAEKIAQVAKIRFQQKVMEKETEKRISEIEDAAFLAREKAKADAEYYAAHKYATSNK

SEQ ID NO: 4886 - protein, 348 aa, Homo Sapiens
MNMTQARVLVAAVVGLVAVLLYASIHKIEEGHLAVYYRGGALLTSPSGPGYHIMLPFITTFRSVQTTLQTDEVKNVPCGTSGGVMIYIDRIEVVNMLAPYAVFDIVRNYTADYDKTLIFNKIHHELNQFCSAHTLQEVYIELFDQIDENLKQALQKDLNLMAPGLTIQAVRVTKPKIPEAIRRNFELMEAEKTKLLIAAQKQKVVEKEAETERKKAVIEAEKIAQVAKIRFQQKVMEKETEKRISEIEDAAFLAREKAKADAEYYAAHKYATSNKHKLTPEYLELKKYQAIASNSKIYFGSNIPNMFVDSSCALKYSDIRTGRESSLPSKEALEPSGENVIQNKESTG

SEQ ID NO: 4887 - protein, 348 aa, Homo Sapiens; identical to SEQ ID NO: 4886

SEQ ID NO: 4888 - protein, 339 aa, Homo Sapiens
MAQLGAVVAVASSFFCASLFSAVHKIEEGHIGVYYRGGALLTSTSGPGFHLMLPFITSYKSVQTTLQTDEVKNVPCGTSGGVMIYFDRIEVVNFLVPNAVYDIVKNYTADYDKALIFNKIHHELNQFCSVHTLQEVYIELFDQIDENLKLALQQDLTSMAPGLVIQAVRVTKPNIPEAIRRNYELMESEKTKLLIAAQKQKVVEKEAETERKKALIEAEKVAQVAEITYGQKVMEKETEKKISEIEDAAFLAREKAKADAECYTAMKIAEANKLKLTPEYLQLMKYKAIASNSKIYFGKDIPNMFMDSAGSVSKQFEGLADKLSFGLEDEPLETATKEN

SEQ ID NO: 4889 - protein, 339 aa, Homo Sapiens; identical to SEQ ID NO: 4888

SEQ ID NO: 4890 - protein, 338 aa, Homo Sapiens
MAQLGAVVAVASSFFCASLFSAVHKIEEGHIGVYYRGGALLTSTSGPGFHLMLPFITSYKSVQTTLQTDEVKNVPCGTSGGVMIYFDRIEVVNFLVPNAVYDIVKNYTADYDKALIFNKIHHELNQFCSVHTLQEVYIELFDQIDENLKLALQQDLTSMAPGLVIQAVRVTKPNIPEAIRRNYELMESEKTKLLIAAQKQKVVEKEAETERKKALIEAEKVAQVAEITYGQKVMEKETEKKISEIEDAAFLAREKAKADAECYTAMKIAEANKLKLTPEYLQLMKYKAIASNSKIYFGKDIPNMFMDSAGSVSKQFEGLADKLSFGLEDEPLETATKE

SEQ ID NO: 4891 - protein, 206 aa, Homo Sapiens
MAQLGAVVAVASSFFCASLFSAVHKIEEGHIGVYYRGGALLTSTSGPGFHLMLPFITSYKSVQTTLQTDEVKNVPCGTSGGVMIYFDRIEVVNFLVPNAVYDIVKNYTADYDKALIFNKIHHELNQFCSVHTLQEVYIELFGKKVSPEHAVLKQGSWNPASLHCLKPGCLQGVMVTYGQEMLKNLVLRSWSQRSSWRMLIAMQQDP

SEQ ID NO: 4892 - protein, 206 aa, Homo Sapiens; identical to SEQ ID NO: 4891

SEQ ID NO: 4893 - protein, 206 aa, Homo Sapiens; identical to SEQ ID NO: 4891

SEQ ID NO: 4894 - protein, 152 aa, Homo Sapiens
MAQLGAVVAVASSFFCASLFSAVHKIEEGHIGVYYRGGALLTSTSGPGFHLMLPFITSYKSVQTTLQTDEVKNVPCGTSGGVMIYFDRIEVVNFLVPNAVYDIVKNYTADYDKALIFNKIHHELNQFCSVHTLQEVYIELFGLENDFSQESS

SEQ ID NO: 4895 - protein, 152 aa, Homo Sapiens; identical to SEQ ID NO: 4894

SEQ ID NO: 4896 - protein, 197 aa, Homo Sapiens
MAQLGAVVAVASSFFCASLFSAVHKIEEGHIGVYYSGGVMIYFDRIEVVNFLVPNAVYDIVKNYTADYDKALIFNKIHHELNQFCSVHTLQEVYIELFDQIDENLKLALQQDLTSMAPGLVIQAVRVTKPNIPEAIRRNYELMESEKTKLLIAAQKQKVVEKEAETERKKALIEAEKVAQVAEITYGQKVMEKETEK

SEQ ID NO: 4897 - protein, 977 aa, Homo Sapiens
MPARRLLLLLTLLLPGLGIFGSTSTVTLPETLLFVSTLDGSLHAVSKRTGSIKWTLKEDPVLQVPTHVEEPAFLPDPNDGSLYTLGSKNNEGLTKLPFTIPELVQASPCRSSDGILYMGKKQDIWYVIDLLTGEKQQTLSSAFADSLCPSTSLLYLGRTEYTITMYDTKTRELRWNATYFDYAASLPEDDVDYKMSHFVSNGDGLVVTVDSESGDVLWIQNYASPVVAFYVWQREGLRKVMHINVAVETLRYLTFMSGEVGRITKWKYPFPKETEAKSKLTPTLYVGKYSTSLYASPSMVHEGVAVVPRGSTLPLLEGPQTDGVTIGDKGECVITPSTDVKFDPGLKSKNKLNYLRNYWLLIGHHETPLSASTKMLERFPNNLPKHRENVIPADSEKKSFEEVINLVDQTSENAPTTVSRDVEEKPAHAPARPEAPVDSMLKDMATIILSTFLLIGWVAFIITYPLSMHQQQQLQHQQFQKELEKIQLLQQQQQQLPFHPPGDTAQDGELLDTSGPYSESSGTSSPSTSPRASNHSLCSGSSASKAGSSPSLEQDDGDEETSVVIVGKISFCPKDVLGHGAEGTIVYRGMFDNRDVAVKRILPECFSFADREVQLLRESDEHPNVIRYFCTEKDRQFQYIAIELCAATLQEYVEQKDFAHLGLEPITLLQQTTSGLAHLHSLNIVHRDLKPHNILISMPNAHGKIKAMISDFGLCKKLAVGRHSFSRRSGVPGTEGWIAPEMLSEDCKENPTYTVDIFSAGCVFYYVISEGSHPFGKSLQRQANILLGACSLDCLHPEKHEDVIARELIEKMIAMDPQKRPSAKHVLKHPFFWSLEKQLQFFQDVSDRIEKESLDGPIVKQLERGGRAVVKMDWRENITVPLQTDLRKFRTYKGGSVRDLLRAMRNKKHHYRELPAEVRETLGSLPDDFVCYFTSRFPHLLAHTYRAMELCSHERLFQPYYFHEPPEPQPPVTPDAL

SEQ ID NO: 4898 - protein, 70 aa, Homo Sapiens
MPARRLLLLLTLLLPGLGVSDRGAWGGGQLATAGSGPGQRRGAGAGVRAGSATAAARCPVSPAVGGSGRA

SEQ ID NO: 4899 - protein, 23 aa, Homo Sapiens
ELLQLLPPDSPTRWLPGTWLEPC

SEQ ID NO: 4900 - protein, 80 aa, Homo Sapiens
MASAVRGSRPWPRLGLQLQFAALLLGTLSPQGCGWATRMLGLLLGAQPHPVCSRRDWSRFILSGQRTSCWCPPWMEVSTH

SEQ ID NO: 4901 - protein, 129 aa, Homo Sapiens
MASAVRGSRPWPRLGLQLQFAALLLGTLSPQVHTLRPENLLLVSTLDGSLHALSKQTGDLKWTLRDDPVIEGPMYVTEMAFLSDPADGSLYILGTQKQQGLMAGVQWYDHKAHCSLELLASSNPRTSVS

SEQ ID NO: 4902 - protein, 926 aa, Homo Sapiens
MASAVRGSRPWPRLGLQLQFAALLLGTLSPQVHTLRPENLLLVSTLDGSLHALSKQTGDLKWTLRDDPVIEGPMYVTEMAFLSDPADGSLYILGTQKQQGLMKLPFTIPELVHASPCRSSDGVFYTGRKQDAWFVVDPESGETQMTLTTEGPSTPRLYIGRTQYTVTMHDPRAPALRWNTTYRRYSAPPMDGSPGKYMSHLASCGMGLLLTVDPGSGTVLWTQDLGVPVMGVYTWHQDGLRQLPHLTLARDTLHFLALRWGHIRLPASGPRDTATLFSTLDTQLLMTLYVGKDETGFYVSKALVHTGVALVPRGLTLAPADGPTTDEVTLQVSGEREGSPSTAVRYPSGSVALPSQWLLIGHHELPPVLHTTMLRVHPTLGSGTAETRPPENTQAPAFFLELLSLSREKLWDSELHPEEKTPDSYLGLGPQDLLAASLTAVLLGGWILFVMRQQQPQVVEKQQETPLAPADFAHISQDAQSLHSGASRRSQKRLQSPSKQAQPLDDPEAEQLTVVGKISFNPKDVLGRGAGGTFVFRGQFEGRAVAVKRLLRECFGLVRREVQLLQESDRHPNVLRYFCTERGPQFHYIALELCRASLQEYVENPDLDRGGLEPEVVLQQLMSGLAHLHSLHIVHRDLKPGNILITGPDSQGLGRVVLSDFGLCKKLPAGRCSFSLHSGIPGTEGWMAPELLQLLPPDSPTSAVDIFSAGCVFYYVLSGGSHPFGDSLYRQANILTGAPCLAHLEEEVHDKVVARDLVGAMLSPLPQPRPSAPQVLAHPFFWSRAKQLQFFQDVSDWLEKESEQEPLVRALEAGGCAVVRDNWHEHISMPLQTDLRKFRSYKGTSVRDLLRAVRNKKHHYRELPVEVRQALGQVPDGFVQYFTNRFPRLLLHTHRAMRSCASESLFLPYYPPDSEARRPCPGATGR

SEQ ID NO: 4903 - protein, 874 aa, Homo Sapiens
MASAVRGSRPWPRLGLQLQFAALLLGTLSPQVHTLRPENLLLVSTLDGSLHALSKQTGDLKWTLRDDPVIEGPMYVTEMAFLSDPADGSLYILGTQKQQGLMKLPFTIPELVHASPCRSSDGVFYTGRKQDAWFVVDPESGETQMTLTTEGPSTPRLYIGRTQYTVTMHDPRAPALRWNTTYRRYSAPPMDGSPGKYMSHLASCGMGLLLTVDPGSGTVLWTQDLGVPVMGVYTWHQDGLRQLPHLTLARDTLHFLALRWGHIRLPASGPRDTATLFSTLDTQLLMTLYVGKDETGFYVSKALVHTGVALVPRGLTLAPADGPTTDEVTLQVSGEREGSPSTAVRYPSGSVALPSQWLLIGHHELPPVLHTTMLRVHPTLGSGTAETRPPENTQAPAFFLEQQPQVVEKQQETPLAPADFAHISQDAQSLHSGASRRSQKRLQSPSKQAQPLDDPEAEQLTVVGKISFNPKDVLGRGAGGTFVFRGQFEGRAVAVKRLLRECFGLVRREVQLLQESDRHPNVLRYFCTERGPQFHYIALELCRASLQEYVENPDLDRGGLEPEVVLQQLMSGLAHLHSLHIVHRDLKPGNILITGPDSQGLGRVVLSDFGLCKKLPAGRCSFSLHSGIPGTEGWMAPELLQLLPPDSPTSAVDIFSAGCVFYYVLSGGSHPFGDSLYRQANILTGAPCLAHLEEEVHDKVVARDLVGAMLSPLPQPRPSAPQVLAHPFFWSRAKQLQFFQDVSDWLEKESEQEPLVRALEAGGCAVVRDNWHEHISMPLQTDLRKFRSYKGTSVRDLLRAVRNKKHHYRELPVEVRQALGQVPDGFVQYFTNRFPRLLLHTHRAMRSCASESLFLPYYPPDSEARRPCPGATGR

SEQ ID NO: 4904 - protein, 169 aa, Homo Sapiens
MGRGWGFLFGLLGAVWLLSSGHGEEQPPETAAQRCFCQVNLKRPCPFWNDISQCGRRDCAVKPCQSDEVPDGIKSASYKYSEEANNLIEECEQAERLGAVDESLSEETQKAVLQWTKHDDSSDNFCEADDIQSPEAEYVDLLLNPERYTGYKGPDAWKIWNVIYEENCF

SEQ ID NO: 4905 - protein, 125 aa, Homo Sapiens
MGRGWGFLFGLLGAVWLLSSGHGEEQPPETAAQRCFCQVSGYLDDCTCDVETIDRFNNYRLFPRLQKLLESDYFRYYKVNLKRPCPFWNDISQCGRRDCAVKPCQSDEVPDGIKSASYKVCTYTY

SEQ ID NO: 4906 - protein, 257 aa, Homo Sapiens
MGRGWGFLFGLLGAVWLLSSGHGEEQPPETAAQRCFCQVSGYLDDCTCDVETIDRFNNYRLFPRLQKLLESDYFRYYKVNLKRPCPFWNDISQCGRRDCAVKPCQSDEVPDGIKSASYKYSEEANNLIEECEQAERLGAVDESLSEETQKAVLQWTKHDDSSDNFCEADDIQSPEAEYVDLLLNPERYTGYKGPDAWKIWNVIYEENCFKPQTIKRPLNPLASGQGKLLICVSLLFLRSLCRKKSILQTYIWPTCKH

SEQ ID NO: 4907 - protein, 257 aa, Homo Sapiens; identical to SEQ ID NO: 4906

SEQ ID NO: 4908 - protein, 257 aa, Homo Sapiens; identical to SEQ ID NO: 4906

SEQ ID NO: 4909 - protein, 468 aa, Homo Sapiens
MGRGWGFLFGLLGAVWLLSSGHGEEQPPETAAQRCFCQVSGYLDDCTCDVETIDRFNNYRLFPRLQKLLESDYFRYYKVNLKRPCPFWNDISQCGRRDCAVKPCQSDEVPDGIKSASYKYSEEANNLIEECEQAERLGAVDESLSEETQKAVLQWTKHDDSSDNFCEADDIQSPEAEYVDLLLNPERYTGYKGPDAWKIWNVIYEENCFKPQTIKRPLNPLASGQGTSEENTFYSWLEGLCVEKRAFYRLISGLHASINVHLSARYLLQETWLEKKWGHNITEFQQRFDGILTEGEGPRRLKNLYFLYLIELRALSKVLPFFERPDFQLFTGNKIQDEENKMLLLEILHEIKSFPLHFDENSFFAGDKKEAHKLKEDFRLHFRNISRIMDCVGCFKCRLWGKLQTQGLGTALKILFSEKLIANMPESGPSYEFHLTRQEIVSLFNAFGRISTSVKELENFRNLLQNIH

SEQ ID NO: 4910 - protein, 75 aa, Homo Sapiens
MLLLEILHEIKSFPLHFDENSFFAGDKKEAHKLKEDFRLHFRNISRIMDCVGCFKCRLWGKLQTQGLGTALKILF

SEQ ID NO: 4911 - protein, 71 aa, Homo Sapiens
MANNTKELEDCEQANKLGAINSTLSNQSKEAFIDWARYDDSRDHFCELDDERSPAAQYVDLLLNPERYTGY

SEQ ID NO: 4912 - protein, 467 aa, Homo Sapiens
MSQGVRRAGAGQGVAAAVQLLVTLSFLRSVVEAQVTGVLDDCLCDIDSIDNFNTYKIFPKIKKLQERDYFRYYKVNLKRPCPFWAEDGHCSIKDCHVEPCPESKIPVGIKAGHSNKYLKMANNTKELEDCEQANKLGAINSTLSNQSKEAFIDWARYDDSRDHFCELDDERSPAAQYVDLLLNPERYTGYKGTSAWRVWNSIYEENCFKPRSVYRPLNPLAPSRGEDDGESFYTWLEGLCLEKRVFYKLISGLHASINLHLCANYLLEETWGKPSWGPNIKEFKHRFDPVETKGEGPRRLKNLYFLYLIELRALSKVAPYFERSIVDLYTGNAEEDADTKTLLLNIFQDTKSFPMHFDEKSMFAGDKKGAKSLKEEFRLHFKNISRIMDCVGCDKCRLWGKLQTQGLGTALKILFSEKEIQKLPENSPSKGFQLTRQEIVALLNAFGRLSTSIRDLQNFKVLLQHSR

SEQ ID NO: 4913 - protein, 173 aa, Homo Sapiens
WGPNIKEFKHRFDPVETKGEGPRRLKNLYFLYLIELRALSKVAPYFERSIVDLYTGNAEEDADTKTLLLNIFQDTKSFPMHFDEKSMFAGDKKGAKSLKEEFRLHFKNISRIMDCVGCDKCRLWGKLQTQGLGTALKILFSEKEIQKLPENSPSKGFQLTRQEIVALLNAFGR

SEQ ID NO: 4914 - protein, 273 aa, Homo Sapiens
MEAAPSRFMFLLFLLTCELAAEVAAEVEKSSDGPGAAQEPTWLTDVPAAMEFIAATEVAVIGFFQDLEIPAVPILHSMVQKFPGVSFGISTDSEVLTHYNITGNTICLFRLVDNEQLNLEDEDIESIDATKLSRFIEINSLHMVTEYNPVTVIGLFNSVIQIHLLLIMNKASPEYEENMHRYQKAAKLFQGKILFILVDSGMKENGKVISFFKLKESQLPALAIYQTLDDEWDTLPTAEVSVEHVQNFCDGFLSGKLLKENRESEGKTPKVEL

SEQ ID NO: 4915 - protein, 172 aa, Homo Sapiens
MKETCQLEIQVDNEQLNLEDEDIESIDATKLSRFIEINSLHMVTEYNPVTVIGLFNSVIQIHLLLIMNKASPEYEENMHRYQKAAKLFQGKILFILVDSGMKENGKVISFFKLKESQLPALAIYQTLDDEWDTLPTAEVSVEHVQNFCDGFLSGKLLKENRESEGKTPKVEL

SEQ ID NO: 4916 - protein, 53 aa, Homo Sapiens
MAAAVPRAAFLSPLLPLLLGFLLLSAPHGGSGLHTKGALPLDTVTFYKIMVTS

SEQ ID NO: 4917 - protein, 261 aa, Homo Sapiens
MAAAVPRAAFLSPLLPLLLGFLLLSAPHGGSGLHTKGALPLDTVTFYKVIPKSKFVLVKFDTQYPYGEKQDEFKRLAENSASSDDLLVAEVGISDYGDKLNMELSEKYKLDKESYPVFYLFRDGDFENPVPYTGAVKVGAIQRWLKGQGVYLGMPGCLPVYDALAGEFIRASGVEARQALLKQGQDNLSSVKETQKKWAEQYLKIMGKILDQGEDFPASEMTRIARLIEKNKMSDGKKEELQKSLNILTAFQKKGAEKEEL

SEQ ID NO: 4918 - protein, 160 aa, Homo Sapiens
MELSEKYKLDKESYPVFYLFRDGDFENPVPYTGAVKVGAIQRWLKGQGVYLGMPGCLPVYDALAGEFIRASGVEARQALLKQGQDNLSSVKETQKKWAEQYLKIMGKILDQGEDFPASEMTRIARLIEKNKMSDGKKEELQKSLNILTAFQKKGAEKEEL

SEQ ID NO: 4919 - protein, 95 aa, Homo Sapiens
  misc_feature (1)..(1): Xaa can be any naturally occurring amino acid
XPAPHFSPRCFPFSWASCSSPLRMAAAACTPRAPFPWIRSLSTRGPLGRGISPKSPWNTHLLSSIRPQVIPKSKFVLVKFDTQYPYGEKQDEFKR

SEQ ID NO: 4920 - protein, 406 aa, Homo Sapiens
MHPAVFLSLPDLRCSLLLLVTWVFTPVTTEITSLDTENIDEILNNADVALVNFYADWCRFSQMLHPIFEEASDVIKEEFPNENQVVFARVDCDQHSDIAQRYRISKYPTLKLFRNGMMMKREYRGQRSVKALADYIRQQKSDPIQEIRDLAEITTLDRSKRNIIGYFEQKDSDNYRVFERVANILHDDCAFLSAFGDVSKPERYSGDNIIYKPPGHSAPDMVYLGAMTNFDVTYNWIQDKCVPLVREITFENGEELTEEGLPFLILFHMKEDTESLEIFQNEVARQLISEKGTINFLHADCDKFRHPLLHIQKTPADCPVIAIDSFRHMYVFGDFKDVLIPGKLKQFVFDLHSGKLHREFHHGPDPTDTAPGEQAQDVASSPPESSFQKLAPSEYRYTLLRDRDEL

SEQ ID NO: 4921 - protein, 604 aa, Homo Sapiens
MLGMNMLLITLFLLLPLSMLKGEPWEGCLHCTHTTWSGNIMTKTLLYHTYYECAGTCLGTCTHNQTTYSVCDPGRGQPYVCYDPKSSPGTWFEIHVGSKEGDLLNQTKVFPSGKDVVSLYFDVCQIVSMGSLFPVIFSSMEYYSSCHKNRYAHPACSTDSPVTTCWDCTTWSTNQQSLGPIMLTKIPLEPDCKTSTCNSVNLTILEPDQPIWTTGLKAPLGARVSGEEIGPGAYVYLYIIKKTRTRSTQQFRVFESFYEHVNQKLPEPPPLASNLFAQLAENIASSLHVASCYVCGGMNMGDQWPWEARELMPQDNFTLTASSLEPAPSSQSIWFLKTSIIGKFCIARWGKAFTDPVGELTCLGQQYYNETLGKTLWRGKSNNSESPHPSPFSRFPSLNHSWYQLEAPNTWQAPSGLYWICGPQAYRQLPAKWSGACVLGTIRPSFFLMPLKQGEALGYPIYDETKRKSKRGITIGDWKDNEWPPERIIQYYGPATWAEDGMWGYRTPVYMLNRIIRLQAVLEIITNETAGALNLLAQQATKMRNVIYQNRLALDYLLAQEEGVCGKFNLTNCCLELDDEGKVIKEITAKIQKLAHIPVQTWKG

SEQ ID NO: 4922 - protein, 89 aa, Homo Sapiens
MKSVLLLTTLLVPAHLVAAWSNNYAVDCPQHCDSSECKSSPRCKRTVLDDCGCCRVCAAGRGETCYRTVSGMDGMKCGPGLRCQPSNGE

SEQ ID NO: 4923 - protein, 184 aa, Homo Sapiens
MKSVLLLTTLLVPAHLVAAWSNNYAVDCPQHCDSSECKSSPRCKRTVLDDCGCCRVCAAGRGETCYRTVSGMDGMKCGPGLRCQPSNGEDPFGEEFGICKDCPYGTFGMDCRETCNCQSGICDRGTGKCLKFPFFQYSVTKSSNRFVSLTEHDMASGDGNIVREEVVKENAAGSPVMRKWLNPR

SEQ ID NO: 4924 - protein, 134 aa, Homo Sapiens
MKSVLLLTTLLVPAHLVAAWSNNYAVDCPQHCDSSECKSSPRCKRTVLDDCGCCRVCAAGRGETCYRTVSGMDGMKCGPGLRCQPSNGEDPFGEEFGICKEHDMASGDGNIVREEVVKENAAGSPVMRKWLNPR

SEQ ID NO: 4925 - protein, 522 aa, Homo Sapiens
EFKKCCPGSPDIDKLDVATMTEYLNFEKSSSVSRYGASQVEDMGNIILAMISEPYNHRFSDPERVNYKFESGTCSKMELIDDNTVVRARGLPWQSSDQDIARFFKGLNIAKGGAALCLNAQGRRNGEALVRFVSEEHRDLALQRHKHHMGTRYIEVYKATGEDFLKIAGGTSNEVAQFLSKENQVIVRMRGLPFTATAEEVVAFFGQHCPITGGKEGILFVTYPDGRPTGDAFVLFACEEYAQNALRKHKDLLGKRYIELFRSTAAEVQQVLNRFSSAPLIPLPTPPIIPVLPQQFVPPTNVRDCIRLRGLPYAATIEDILDFLGEFATDIRTHGVHMVLNHQGRPSGDAFIQMKSADRAFMAAQKCHKKNMKDRYVEVFQCSAEEMNFVLMGGTLNRNGLSPPPCKLPCLSPPSYTFPAPAAVIPTEAAIYQPSVILNPRALQPSTAYYPAGTQLFMNYTAYYPSPPGSPNSLGYFPTAANLSGVPPQPGTVVRMQGLAYNTGVKEILNFFQGYQCLKDVW

SEQ ID NO: 4926 - protein, 677 aa, Homo Sapiens
MTASPDYLVVLFGITAGATGAKLGSDEKELILLFWKVVDLANKKVGQLHEVLVRPDQLELTEDCKEETKIDVESLSSASQLDQALRQFNQSVSNELNIGVGTSFCLCTDGQLHVRQILHPEASKKNVLLPECFYSFFDLRKEFKKCCPGSPDIDKLDVATMTEYLNFEKSSSVSRYGASQVEDMGNIILAMISEPYNHRFSDPERVNYKFESGTCSKMELIDDNTVVRARGLPWQSSDQDIARFFKGLNIAKGGAALCLNAQGRRNGEALVRFVSEEHRDLALQRHKHHMGTRYIEVYKATGEDFLKIAGGTSNEVAQFLSKENQVIVRMRGLPFTATAEEVVAFFGQHCPITGGKEGILFVTYPDGRPTGDAFVLFACEEYAQNALRKHKDLLGKRYIELFRSTAAEVQQVLNRFSSAPLIPLPTPPIIPVLPQQFVPPTNVRDCIRLRGLPYAATIEDILDFLGEFATDIRTHGVHMVLNHQGRPSGDAFIQMKSADRAFMAAQKCHKKNMKDRYVEVFQCSAEEMNFVLMGGTLNRNGLSPPPCLSPPSYTFPAPAAVIPTEAAIYQPSVILNPRALQPSTAYYPAGTQLFMNYTAYYPSPPGSPNSLGYFPTAANLSGVPPQPGTVVRMQGLAYNTGVKEILNFFQGYQYATEDGLIHTNDQARTLPKEWVCI

SEQ ID NO: 4927 - protein, 681 aa, Homo Sapiens
MTASPDYLVVLFGITAGATGAKLGSDEKELILLFWKVVDLANKKVGQLHEVLVRPDQLELTEDCKEETKIDVESLSSASQLDQALRQFNQSVSNELNIGVGTSFCLCTDGQLHVRQILHPEASKKNVLLPECFYSFFDLRKEFKKCCPGSPDIDKLDVATMTEYLNFEKSSSVSRYGASQVEDMGNIILAMISEPYNHRFSDPERVNYKFESGTCSKMELIDDNTVVRARGLPWQSSDQDIARFFKGLNIAKGGAALCLNAQGRRNGEALVRFVSEEHRDLALQRHKHHMGTRYIEVYKATGEDFLKIAGGTSNEVAQFLSKENQVIVRMRGLPFTATAEEVVAFFGQHCPITGGKEGILFVTYPDGRPTGDAFVLFACEEYAQNALRKHKDLLGKRYIELFRSTAAEVQQVLNRFSSAPLIPLPTPPIIPVLPQQFVPPTNVRDCIRLRGLPYAATIEDILDFLGEFATDIRTHGVHMVLNHQGRPSGDAFIQMKSADRAFMAAQKCHKKNMKDRYVEVFQCSAEEMNFVLMGGTLNRNGLSPPPCKLPCLSPPSYTFPAPAAVIPTEAAIYQPSVILNPRALQPSTAYYPAGTQLFMNYTAYYPSPPGSPNSLGYFPTAANLSGVPPQPGTVVRMQGLAYNTGVKEILNFFQGYQYATEDGLIHTNDQARTLPKEWVCI

SEQ ID NO: 4928 - protein, 659 aa, Homo Sapiens
MTASPDYLVVLFGITAGATGAKLGSDEKELILLFWKVVDLANKKVGQLHEVLVRPDQLELTEDCKEETKIDVESLSSASQLDQALRQFNQSVSNELNIGVGTSFCLCTDGQLHVRQILHPEASKKNVLLPECFYSFFDLRKEFKKCCPGSPDIDKLDVATMTEYLNFEKSSSVSRYGASQVEDMGNIILAMISEPYNHRFSDPERVNYKFESGTCSKMELIDDNTVVRARGLPWQSSDQDIARFFKGLNIAKGGAALCLNAQGRRNGEALVRFVSEEHRDLALQRHKHHMGTRYIEVYKATGEDFLKIAGGTSNEVAQFLSKENQVIVRMRGLPFTATAEEVVAFFGQHCPITGGKEGILFVTYPDGRPTGDAFVLFACEEYAQNALRKHKDLLGKRYIELFRSTAAEVQQVLNRFSSAPLIPLPTPPIIPVLPQQFVPPTNVRDCIRLRGLPYAATIEDILDFLGEFATDIRTHGVHMVLNHQGRPSGDAFIQMKSADRAFMAAQKCHKKNMKDRYVEVFQCSAEEMNFVLMGGTLNRNGLSPPPCLSPPSYTFPAPAAVIPTEAAIYQPSVILNPRALQPSTAYYPAGTQLFMNYTAYYPSPPGSPNSLGYFPTAANLSGVPPQPGTVVRMQGLAYNTGVKEILNFFQGYQCLKDVW

SEQ ID NO: 4929 - protein, 604 aa, Homo Sapiens
MTASPDYLVVLFGITAGATGAKLGSDEKELILLFWKVVDLANKKVGQLHEVLVRPDQLELTEDCKEETKIDVESLSSASQLDQALRQFNQSVSNELNIGVGTSFCLCTDGQLHVRQILHPEASKKNVLLPECFYSFFDLRKEFKKCCPGSPDIDKLDVATMTEYLNFEKSSSVSRYGASQVEDMGNIILAMISEPYNHRFSDPERVNYKFESGTCSKMELIDDNTVVRARGLPWQSSDQDIARFFKGLNIAKGGAALCLNAQGRRNGEALVRFVSEEHRDLALQRHKHHMGTRYIEVYKATGEDFLKIAGGTSNEVAQFLSKENQVIVRMRGLPFTATAEEVVAFFGQHCPITGGKEGILFVTYPDGRPTGDAFVLFACEEYAQNALRKHKDLLGKRYIELFRSTAAEVQQVLNRFSSAPLIPLPTPPIIPVLPQQFVPPTNVRDCIRLRGLPYAATIEDILDFLGEFATDIRTHGVHMVLNHQGRPSGDAFIQMKSADRAFMAAQKCHKKNMKDRYVEVFQCSAEEMNFVLMGGTLNRNGLSPPPCLSPPSYTFPAPAAVIPTEAAIYQPSVILNPRALQPSTAYYPAGTQLFMNYTAYYPSV

SEQ ID NO: 4930 - protein, 681 aa, Homo Sapiens; identical to SEQ ID NO: 4927

SEQ ID NO: 4931 - protein, 608 aa, Homo Sapiens
MTASPDYLVVLFGITAGATGAKLGSDEKELILLFWKVVDLANKKVGQLHEVLVRPDQLELTEDCKEETKIDVESLSSASQLDQALRQFNQSVSNELNIGVGTSFCLCTDGQLHVRQILHPEASKKNVLLPECFYSFFDLRKEFKKCCPGSPDIDKLDVATMTEYLNFEKSSSVSRYGASQVEDMGNIILAMISEPYNHRFSDPERVNYKFESGTCSKMELIDDNTVVRARGLPWQSSDQDIARFFKGLNIAKGGAALCLNAQGRRNGEALVRFVSEEHRDLALQRHKHHMGTRYIEVYKATGEDFLKIAGGTSNEVAQFLSKENQVIVRMRGLPFTATAEEVVAFFGQHCPITGGKEGILFVTYPDGRPTGDAFVLFACEEYAQNALRKHKDLLGKRYIELFRSTAAEVQQVLNRFSSAPLIPLPTPPIIPVLPQQFVPPTNVRDCIRLRGLPYAATIEDILDFLGEFATDIRTHGVHMVLNHQGRPSGDAFIQMKSADRAFMAAQKCHKKNMKDRYVEVFQCSAEEMNFVLMGGTLNRNGLSPPPCKLPCLSPPSYTFPAPAAVIPTEAAIYQPSVILNPRALQPSTAYYPAGTQLFMNYTAYYPSV

SEQ ID NO: 4932 - protein, 502 aa, Homo Sapiens
  misc_feature (1)..(1): Xaa can be any naturally occurring amino acid
XFFDLRKEFKKCCPGSPDIDKLDVATMTEYLNFEKSSSVSRYGASQVEDMGNIILAMISEPYNHRFSDPERVNYKFESGTCSKMELIDDNTVVRARGLPWQSSDQDIARFFKGLNIAKGGAALCLNAQGRRNGEALVRFVSEEHRDLALQRHKHHMGTRYIEVYKATGEDFLKIAGGTSNEVAQFLSKENQVIVRMRGLPFTATAEEVVAFFGQHCPITGGKEGILFVTYPDGRPTGDAFVLFACEEYAQNALRKHKDLLGKRYIELFRSTAAEVQQVLNRFSSAPLIPLPTPPIIPVLPQQFVPPTNVRDCIRLRGLPYAATIEDILDFLGEFATDIRTHGVHMVLNHQGRPSGDAFIQMKSADRAFMAAQKCHKKNMKDRYVEVFQCSAEEMNFVLMGGTLNRNGLSPPPCKLPCLSPPSYTFPAPAAVIPTEAAIYQPSVILNPRALQPSTAYYPAGTQLFMNYTAYYPSMQPRMDLYTQMTRPGLYPKNGFVFKGPSS

SEQ ID NO: 4933 - protein, 40 aa, Homo Sapiens
  misc_feature (1)..(1): Xaa can be any naturally occurring amino acid
XLLPECFYSFFDLRKEFKKCCPGSPDIDKLDVATMTECIL

SEQ ID NO: 4934 - protein, 56 aa, Homo Sapiens
MAIKSIASRLRGSRRFLSGFVAGAVVGAAGAGLAALQFFRSQGAEGALTGKQPDDC

SEQ ID NO: 4935 - protein, 56 aa, Homo Sapiens; identical to SEQ ID NO: 4934

SEQ ID NO: 4936 - protein, 56 aa, Homo Sapiens; identical to SEQ ID NO: 4934

SEQ ID NO: 4937 - protein, 56 aa, Homo Sapiens; identical to SEQ ID NO: 4934

SEQ ID NO: 4938 - protein, 56 aa, Homo Sapiens; identical to SEQ ID NO: 4934

SEQ ID NO: 4939 - protein, 318 aa, Homo Sapiens
MAIKSIASRLRGSRRFLSGFVAGAVVGAAGAGLAALQFFRSQGAEGALTGKQPDGDADRKHCKFKPDPNIPPTFSAFNEDYVGSGWSRGHMAPAGNNKFSSKAMAETFYLSNIVPQDFDNNSGYWNRIEMYCRELTERFEDVWVVSGPLTLPQTRGDGKKIVSYQVIGEDNVAVPSHLYKVILARRSSVSTEPLALGAFVVPNEAIGFQPQLTEFQVSLQDLEKLSGLVFFPHLDRTSDIRNICSVDTCKLLDFQEFTLYLSTRKIEGARSVLRLEKIMENLKNAEIEPDDYFMSRYEKKLEELKAKEQSGTQIRKPS

SEQ ID NO: 4940 - protein, 368 aa, Homo Sapiens
MAIKSIASRLRGSRRFLSGFVAGAVVGAAGAGLAALQFFRSQGAEGALTGKQPDGSAEKAVLEQFGFPLTGTEARCYTNHALSYDQAKRVPRWVLEHISKSKIMGDADRKHCKFKPDPNIPPTFSAFNEDYVGSGWSRGHMAPAGNNKFSSKAMAETFYLSNIVPQDFDNNSGYWNRIEMYCRELTERFEDVWVVSGPLTLPQTRGDGKKIVSYQVIGEDNVAVPSHLYKVILARRSSVSTEPLALGAFVVPNEAIGFQPQLTEFQVSLQDLEKLSGLVFFPHLDRTSDIRNICSVDTCKLLDFQEFTLYLSTRKIEGARSVLRLEKIMENLKNAEIEPDDYFMSRYEKKLEELKAKEQSGTQIRKPS

SEQ ID NO: 4941 - protein, 143 aa, Homo Sapiens
MAIKSIASRLRGSRRFLSGFVAGAVVGAAGAGLAALQFFRSQGAEGALTGKQPDGSAEKAVLEQFGFPLTGTEARCYTNHALSYDQAKRVPRWVLEHISKSKIMGRFFKFTLLASLFLLSLNLHLWLVLNFWVQVTLLPQPPE

SEQ ID NO: 4942 - protein, 107 aa, Homo Sapiens
MAIKSIASRLRGSRRFLSGFVAGAVVGAAGAGLAALQFFRSQGAEGALTGKQPDGSAEKAVLEQFGFPLTGTEARCYTNHALSYDQAKRVPRWVLEHISKSKIMGWS

SEQ ID NO: 4943 - protein, 81 aa, Homo Sapiens
MAIKSIASRLRGSRRFLSGFVAGAVVGAAGAGLAALQFFRSQGAEGALTGKQPDGSAEKAVLEQFGFPLTGTEVDSSSLHS

SEQ ID NO: 4944 - protein, 146 aa, Homo Sapiens
MAIKSIASRLRGSRRFLSGFVAGAVVGAAGAGLAALQFFRSQGAEGALTGKQPDGSAEKAVLEQFGFPLTGTEVMQTESIVNLSLIPISLQPSVPSMKIMLEVGGHEDTWLQQEITNFQVKPWLKPFTFLTLCLRILIIILDIGTE

SEQ ID NO: 4945 - protein, 107 aa, Homo Sapiens
RSQGAEGALTGKQPDGSAEKAVLEQFGFPLTGTEVMQTESIVNLSLIPISLQPSVPSMKIMLEVGGHEDTWLQQEITNFQVKPWLKPFTFLTLCLRILIIILDIGTE

SEQ ID NO: 4946 - protein, 187 aa, Homo Sapiens
  misc_feature (1)..(1): Xaa can be any naturally occurring amino acid
XFRSQGAEGALTGKQPDGSAEKAVLEQFGFPLTGTEARCYTNHALSYDQAKRVPRWVLEHISKSKIMGDADRKHCKFKPDPNIPPTFSAFNEDYVGSGWSRGHMAPAGNNKFSSKAMAETFYLSNIVPQDFDNNSGYWNRIEMYCRELTERFEDVWVVSGPLTLPQTRGDGKKIVSYQSWEYPSLQF

SEQ ID NO: 4947 - protein, 15 aa, Homo Sapiens
  misc_feature (1)..(1): Xaa can be any naturally occurring amino acid
XGAEGALTGKQPDDC

SEQ ID NO: 4948 - protein, 676 aa, Homo Sapiens
MQSWRRRKSLWLALSASWLLLVLLGGFSLLRLALPPRPRPGASQGWPRWLDAELLQSFSQPGELPEDAVSPPQAPHGGSCNWESCFDTSKCRGDGLKVFVYPAVGTISETHRRILASIEGSRFYTFSPAGACLLLLLSLDAQTGECSSMPLQWNRGRNHLVLRLHPAPCPRTFQLGQAMVAEASPTVDSFRPGFDVALPFLPEAHPLRGGAPGQLRQHSPQPGVALLALEEERGGWRTADTGSSACPWDGRCEQDPGPGQTQRQETLPNATFCLISGHRPEAASRFLQALQAGCIPVLLSPRWELPFSEVIDWTKAAIVADERLPLQVLAALQEMSPARVLALRQQTQFLWDAYFSSVEKVIHTTLEVIQDRIFGTSAHPSLLWNSPPGALLALSTFSTSPQDFPFYYLQQGSRPEGRFSALIWVGPPGQPPLKLIQAVAGSQHCAQILVLWSNERPLPSRWPETAVPLTVIDGHRKVSDRFYPYSTIRTDAILSLDARSSLSTSEVDFAFLVWQSFPERMVGFLTSSHFWDEAHGGWGYTAERTNEFSMVLTTAAFYHRYYHTLFTHSLPKALRTLADEAPTCVDVLMNFIVAAVTKLPPIKVPYGKQRQEAAPLAPGGPGPRPKPPAPAPDCINQIAAAFGHMPLLSSRLRLDPVLFKDPVSVQRKKYRSLEKP

SEQ ID NO: 4949 - protein, 117 aa, Homo Sapiens
MGIRVLRLSLVVILVLLLVAGALTALLPSVKEDKMLMLRREIKSQGKSTMDSFTLIMQTYNRTDLLLKLLNHYQAVPNLHKVIVVWNNIGEKAPDELWNSLGPHPIPVIFKQQTANR

SEQ ID NO: 4950 - protein, 147 aa, Homo Sapiens
MRCCHICKLPGRVMGIRVLRLSLVVILVLLLVAGALTALLPSVKEDKMLMLRREIKSQGKSTMDSFTLIMQTYNRTDLLLKLLNHYQAVPNLHKVIVVWNNIGEKAPDELWNSLGPHPIPVIFKQQTANRMRNRLQVFPELETNAIS

SEQ ID NO: 4951 - protein, 330 aa, Homo Sapiens
MRCCHICKLPGRVMGIRVLRLSLVVILVLLLVAGALTALLPSVKEDKMLMLRREIKSQGKSTMDSFTLIMQTYNRTDLLLKLLNHYQAVPNLHKVIVVWNNIGEKAPDELWNSLGPHPIPVIFKQQTANRMRNRLQVFPELETNAVLMVDDDTLISTPDLVFAFSVWQQFPDQIVGFVPRKHVSTSSGIYSYGSFEMQAPGSGNGDQYSMVLIGASFFNSKYLELFQRQPAAVHALIDDTQNCDDIAMNFIIAKHIGKTSGIFVKPVNMDNLEKETNSGYSGMWHRAEHALQRSYCINKLVNIYDSMPLRYSNIMISQFGFPYANYKRKI

SEQ ID NO: 4952 - protein, 330 aa, Homo Sapiens; identical to SEQ ID NO: 4951

SEQ ID NO: 4953 - protein, 266 aa, Homo Sapiens
MRTWNSGGTKCCHICKLPGRVMGIRVLRLSLVVILVLLLVAGALTALLPSVKEDKMLMLRREIKSQGKSTMDSFTLIMQTYNRTDLLLKLLNHYQAVPNLHKVIVVWNNIGEKAPDELWNSLGPHPIPVIFKQQTANRMRNRLQVFPELETNAVLMVDDDTLISTPDLVFAFSVWQQFPDQIVGFVPRKHVSTSSGIYSYGSFEMQAPGSGNGDQYSMVLIGASFFNSKYLELFQRQPAAVHALIDDTQNCDDIAMNFIIAKHIGK

SEQ ID NO: 4954 - protein, 130 aa, Homo Sapiens
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELCMLIFAL

SEQ ID NO: 4955 - protein, 334 aa, Homo Sapiens
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRGTGTRSRRRAVRRCTRWRWSSSTTGSQRRPMTSTSPCSGSRPPSPSA

SEQ ID NO: 4956 - protein, 332 aa, Homo Sapiens
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKGTGTRSRRRAVRRCTRWRWSSSTTGSQRRPMTSTSPCSGSRPPSPSA

SEQ ID NO: 4957 - protein, 488 aa, Homo Sapiens
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 4958 - protein, 162 aa, Homo Sapiens
MIFLYQVVHFILFTSVSGECVTQLLKDTCFEGGDITTVFTPSAKYCQVVCTYHPRCLLFTFTAESPSEDPTRWFTCVLKDSVTETLPRVNRTAAISGYSFKQCSHQISACNKDIYVDLDMKGINYNSSVAKSAQECQERCTDDVHCHFFTYATRQFPSLEHR

SEQ ID NO: 4959 - protein, 625 aa, Homo Sapiens
MIFLYQVVHFILFTSVSGECVTQLLKDTCFEGGDITTVFTPSAKYCQVVCTYHPRCLLFTFTAESPSEDPTRWFTCVLKDSVTETLPRVNRTAAISGYSFKQCSHQISACNKDIYVDLDMKGINYNSSVAKSAQECQERCTDDVHCHFFTYATRQFPSLEHRNICLLKHTQTGTPTRITKLDKVVSGFSLKSCALSNLACIRDIFPNTVFADSNIDSVMAPDAFVCGRICTHHPGCLFFTFFSQEWPKESQRNLCLLKTSESGLPSTRIKKSKALSGFSLQSCRHSIPVFCHSSFYHDTDFLGEELDIVAAKSHEACQKLCTNAVRCQFFTYTPAQASCNEGKGKCYLKLSSNGSPTKILHGRGGISGYTLRLCKMDNECTTKIKPRIVGGTASVRGEWPWQVTLHTTSPTQRHLCGGSIIGNQWILTAAHCFYGVESPKILRVYSGILNQSEIKEDTSFFGVQEIIIHDQYKMAESGYDIALLKLETTVNYTDSQRPICLPSKGDRNVIYTDCWVTGWGYRKLRDKIQNTLQKAKIPLVTNEECQKRYRGHKITHKMICAGYREGGKDACKGDSGGPLSCKHNEVWHLVGITSWGEGCAQRERPGVYTNVVEYVDWILEKTQAV

SEQ ID NO: 4960 - protein, 571 aa, Homo Sapiens
MIFLYQVVHFILFTSVSGECVTQLLKDTCFEGGDITTVFTPSAKYCQVVCTYHPRCLLFTFTAESPSEDPTRWFTCVLKDSVTETLPRVNRTAAISGYSFKQCSHQISNICLLKHTQTGTPTRITKLDKVVSGFSLKSCALSNLACIRDIFPNTVFADSNIDSVMAPDAFVCGRICTHHPGCLFFTFFSQEWPKESQRNLCLLKTSESGLPSTRIKKSKALSGFSLQSCRHSIPVFCHSSFYHDTDFLGEELDIVAAKSHEACQKLCTNAVRCQFFTYTPAQASCNEGKGKCYLKLSSNGSPTKILHGRGGISGYTLRLCKMDNECTTKIKPRIVGGTASVRGEWPWQVTLHTTSPTQRHLCGGSIIGNQWILTAAHCFYGVESPKILRVYSGILNQSEIKEDTSFFGVQEIIIHDQYKMAESGYDIALLKLETTVNYTDSQRPICLPSKGDRNVIYTDCWVTGWGYRKLRDKIQNTLQKAKIPLVTNEECQKRYRGHKITHKMICAGYREGGKDACKGDSGGPLSCKHNEVWHLVGITSWGEGCAQRERPGVYTNVVEYVDWILEKTQAV

SEQ ID NO: 4961 - protein, 210 aa, Homo Sapiens
  misc_feature (1)..(1): Xaa can be any naturally occurring amino acid
XSGFSLKSCALSNLACIRDIFPNTVFADSNIDSVMAPDAFVCGRICTHHPGCLFFTFFSQEWPKESQRNLCLLKTSESGLPSTRIKKSKALSGFSLQSCRHSIPVFCHSSFYHDTDFLGEELDIVAAKSHEACQKLCTNAVRCQFFTYTPAQASCNEGKGKCYLKLSSNGSPTKILHGRGGISGYTLRLCKMDNELRGAPMKISGWLKTS

SEQ ID NO: 4962 - protein, 159 aa, Homo Sapiens
  misc_feature (1)..(1): Xaa can be any naturally occurring amino acid
XVESPKILRVYSGILNQSEIKEDTSFFGVQEIIIHDQYKMAESGYDIALLKLETTVNYTDKIQNTLQKAKIPLVTNEECQKRYRGHKITHKMICAGYREGGKDACKGDSGGPLSCKHNEVWHLVGITSWGEGCAQRERPGVYTNVVEYVDWILEKTQAV

SEQ ID NO: 4963 - protein, 615 aa, Homo Sapiens
MRALLLLGFLLVSLESTLSIPPWEAPKEHKYKAEEHTVVLTVTGEPCHFPFQYHRQLYHKCTHKGRPGPQPWCATTPNFDQDQRWGYCLEPKKVKDHCSKHSPCQKGGTCVNMPSGPHCLCPQHLTGNHCQKEKCFEPQLLRFFHKNEIWYRTEQAAVARCQCKGPDAHCQRLASQACRTNPCLHGGRCLEVEGHRLCHCPVGYTGAFCDVDTKASCYDGRGLSYRGLARTTLSGAPCQPWASEATYRNVTAEQARNWGLGGHAFCRNPDNDIRPWCFVLNRDRLSWEYCDLAQCQTPTQAAPPTPVSPRLHVPLMPAQPAPPKPQPTTRTPPQSQTPGALPAKREQPPSLTRNGPLSCGQRLRKSLSSMTRVVGGLVALRGAHPYIAALYWGHSFCAGSLIAPCWVLTAAHCLQDRPAPEDLTVVLGQERRNHSCEPCQTLAVRSYRLHEAFSPVSYQHDLALLRLQEDADGSCALLSPYVQPVCLPSGAARPSETTLCQVAGWGHQFEGAEEYASFLQEAQVPFLSLERCSAPDVHGSSILPGMLCAGFLEGGTDACQGDSGGPLVCEDQAAERRLTLQGIISWGSGCGDRNKPGVYTDVAYYLAWIREHTVS

SEQ ID NO: 4964 - protein, 661 aa, Homo Sapiens
MRLKNLTFIIILIISGELYAEEKPCGFPHVENGRIAQYYYTFKSFYFPMSIDKKLSFFCLAGYTTESGRQEEQTTCTTEGWSPEPRCFKKCTKPDLSNGYISDVKLLYKIQENMRYGCASGYKTTGGKDEEVVQCLSDGWSSQPTCRKEHETCLAPELYNGNYSTTQKTFKVKDKVQYECATGYYTAGGKKTEEVECLTYGWSLTPKCTKLKCSSLRLIENGYFHPVKQTYEEGDVVQFFCHENYYLSGSDLIQCYNFGWYPESPVCEGRRNRCPPPPLPINSKIQTHSTTYRHGEIVHIECELNFEIHGSAEIRCEDGKWTEPPKCIEGQEKVACEEPPFIENGAANLHSKIYYNGDKVTYACKSGYLLHGSNEITCNRGKWTLPPECVENNENCKHPPVVMNGAVADGILASYATGSSVEYRCNEYYLLRGSKISRCEQGKWSSPPVCLEPCTVNVDYMNRNNIEMKWKYEGKVLHGDLIDFVCKQGYDLSPLTPLSELSVQCNRGEVKYPLCTRKESKGMCTSPPLIKHGVIISSTVDTYENGSSVEYRCFDHHFLEGSREAYCLDGMWTTPPLCLEPCTLSFTEMEKNNLLLKWDFDNRPHILHGEYIEFICRGDTYPAELYITGSILRMQCDRGQLKYPRCIPRQSTLSYQEPLRT

SEQ ID NO: 4965 - protein, 622 aa, Homo Sapiens
MAHVRGLQLPGCLALAALCSLVHSQHVFLAPQQARSLLQRVRRANTFLEEVRKGNLERECVEETCSYEEAFEALESSTATDVFWAKYTACETARTPRDKLAACLEGNCAEGLGTNYRGHVNITRSGIECQLWRSRYPHKPEINSTTHPGADLQENFCRNPDSSTTGPWCYTTDPTVRRQECSIPVCGQDQVTVAMTPRSEGSSVNLSPPLEQCVPDRGQQYQGRLAVTTHGLPCLAWASAQAKALSKHQDFNSAVQLVENFCRNPDGDEEGVWCYVAGKPGDFGYCDLNYCEEAVEEETGDGLDEDSDRAIEGRTATSEYQTFFNPRTFGSGEADCGLRPLFEKKSLEDKTERELLESYIDGRIVEGSDAEIGMSPWQVMLFRKSPQELLCGASLISDRWVLTAAHCLLYPPWDKNFTENDLLVRIGKHSRTRYERNIEKISMLEKIYIHPRYNWRENLDRDIALMKLKKPVAFSDYIHPVCLPDRETAASLLQAGYKGRVTGWGNLKETWTANVGKGQPSVLQVVNLPIVERPVCKDSTRIRITDNMFCAGYKPDEGKRGDACEGDSGGPFVMKSPFNNRWYQMGIVSWGEGCDRDGKYGFYTHVFRLKKWIQKVIDQFGE

SEQ ID NO: 4966 - protein, 583 aa, Homo Sapiens
MAHVRGLQLPGCLALAALCSLVHSQHVFLAPQQARSLLQRVRRANTFLEEVRKGNLERECVEETCSYEEAFEALESSTATDVFWAKYTACETARTPRDKLAACLEGNCAEGLGTNYRGHVNITRSGIECQLWRSRYPHKPEINSTTHPGADLQENFCRNPDSSTTGPWCYTTDPTVRRQECSIPVCGQDQVTVAMTPRSEGSSVNLSPPLEQCVPDRGQQYQGRLAVTTHGLPCLAWASAQAKALSKHQDFNSAVQLVENFCRNPDGDEEGVWCYVAGKPGDFGYCDLNYCEEAVEEETGDGLDEDSDRAIEGRTATSEYQTFFNPRTFGSGEADCGLRPLFEKKSLEDKTERELLESYIDGRIVEGSDAEIGMSPWQVMLFRKSPQELLCGASLISDRWVLTAAHCLLYPPWDKNFTENDLLVRIGKHSRTRYERNIEKISMLEKIYIHPSLLQAGYKGRVTGWGNLKETWTANVGKGQPSVLQVVNLPIVERPVCKDSTRIRITDNMFCAGYKPDEGKRGDACEGDSGGPFVMKSPFNNRWYQMGIVSWGEGCDRDGKYGFYTHVFRLKKWIQKVIDQFGE

SEQ ID NO: 4967 - protein, 324 aa, Homo Sapiens
MGWGLLAGQSTQSWPLMFLAPQQARSLLQRVRRANTFLEEVRKGNLERECVEETCSYEEAFEALESSTATDVFWAKYTACETARTPRDKLAACLEGNCAEGLGTNYRGHVNITRSGIECQLWRSRYPHKPEINSTTHPGADLQENFCRNPDSSTTGPWCYTTDPTVRRQECSIPVCGQDQVTVAMTPRSEGSSVNLSPPLEQCVPDRGQQYQGRLAVTTHGLPCLAWASAQAKALSKHQDFNSAVQLVENFCRNPDGDEEGVWCYVAGKPGDFGYCDLNYCEEAVEEETGDGLDEDSDRAIEGRTATSEYQTFFNPRTFGSGEA

SEQ ID NO: 4968 - protein, 425 aa, Homo Sapiens
MGPRRLLLVAACFSLCGPLLSARTRARRPESKATNATLDPRSFLLRNPNDKYEPFWEDEEKNESGLTEYRLVSINKSSPLQKQLPAFISEDASGYLTSSWLTLFVPSVYTGVFVVSLPLNIMAIVVFILKMKVKKPAVVYMLHLATADVLFVSVLPFKISYYFSGSDWQFGSELCRFVTAAFYCNMYASILLMTVISIDRFLAVVYPMQSLSWRTLGRASFTCLAIWALAIAGVVPLLLKEQTIQVPGLNITTCHDVLNETLLEGYYAYYFSAFSAVFFFVPLIISTVCYVSIIRCLSSSAVANRSKKSRALFLSAAVFCIFIICFGPTNVLLIAHYSFLSHTSTTEAAYFAYLLCVCVSSISCCIDPLIYYYASSECQRYVYSILCCKESSDPSSYNSSGQLMASKMDTCSSNLNNSIYKKLLT

SEQ ID NO: 4969 - protein, 102 aa, Homo Sapiens
MGPRRLLLVAACFSLCGPLLSARTRARRPVTFRWGVPPPSRAQPMPLWTRSWRVQPACHGVLDMEEDGAEAPWGSLQSCVALVIVFLPGPPPKRKALTLLHQ

SEQ ID NO: 4970 - protein, 113 aa, Homo Sapiens
MWGRLLLWPLVLGFSLSGGTQTPSVYDESGSTGGGDARPQSCLPPAATQAKSVPMTVTPWSSRTAHGHCFWAGCPPGWCPPSMGWSWWWGCRPMGWRCGCWPRRHLGCPPPCC

SEQ ID NO: 4971 - protein, 385 aa, Homo Sapiens
MWGRLLLWPLVLGFSLSGGTQTPSVYDESGSTGGGDDSTPSILPAPRGYPGQVCANDSDTLELPDSSRALLLGWVPTRLVPALYGLVLVVGLPANGLALWVLATQAPRLPSTMLLMNLAAADLLLALALPPRIAYHLRGQRWPFGEAACRLATAALYGHMYGSVLLLAAVSLDRYLALVHPLRARALRGRRLALGLCMAAWLMAAALALPLTLQRQTFRLARSDRVLCHDALPLDAQASHWQPAFTCLALLGCFLPLLAMLLCYGATLHTLAASGRRYGHALRLTAVVLASAVAFFVPSNLLLLLHYSDPSPSAWGNLYGAYVPSLALSTLNSCVDPFIYYYVSAEFRDKVRAGLFQRSPGDTVASKASAEGGSRGMGTHSSLLQ

SEQ ID NO: 4972 - protein, 2224 aa, Homo Sapiens
MFPGCPRLWVLVVLGTSWVGWGSQGTEAAQLRQFYVAAQGISWSYRPEPTNSSLNLSVTSFKKIVYREYEPYFKKEKPQSTISGLLGPTLYAEVGDIIKVHFKNKADKPLSIHPQGIRYSKLSEGASYLDHTFPAEKMDDAVAPGREYTYEWSISEDSGPTHDDPPCLTHIYYSHENLIEDFNSGLIGPLLICKKGTLTEGGTQKTFDKQIVLLFAVFDESKSWSQSSSLMYTVNGYVNGTMPDITVCAHDHISWHLLGMSSGPELFSIHFNGQVLEQNHHKVSAITLVSATSTTANMTVGPEGKWIISSLTPKHLQAGMQAYIDIKNCPKKTRNLKKITREQRRHMKRWEYFIAAEEVIWDYAPVIPANMDKKYRSQHLDNFSNQIGKHYKKVMYTQYEDESFTKHTVNPNMKEDGILGPIIRAQVRDTLKIVFKNMASRPYSIYPHGVTFSPYEDEVNSSFTSGRNNTMIRAVQPGETYTYKWNILEFDEPTENDAQCLTRPYYSDVDIMRDIASGLIGLLLICKSRSLDRRGIQRAADIEQQAVFAVFDENKSWYLEDNINKFCENPDEVKRDDPKFYESNIMSTINGYVPESITTLGFCFDDTVQWHFCSVGTQNEILTIHFTGHSFIYGKRHEDTLTLFPMRGESVTVTMDNVGTWMLTSMNSSPRSKKLRLKFRDVKCIPDDDEDSYEIFEPPESTVMATRKMHDRLEPEDEESDADYDYQNRLAAALGIRSFRNSSLNQEEEEFNLTALALENGTEFVSSNTDIIVGSNYSSPSNISKFTVNNLAEPQKAPSHQQATTAGSPLRHLIGKNSVLNSSTAEHSSPYSEDPIEDPLQPDVTGIRLLSLGAGEFKSQEHAKHKGPKVERDQAAKHRFSWMKLLAHKVGRHLSQDTGSPSGMRPWEDLPSQDTGSPSRMRPWKDPPSDLLLLKQSNSSKILVGRWHLASEKGSYEIIQDTDEDTAVNNWLISPQNASRAWGESTPLANKPGKQSGHPKFPRVRHKSLQVRQDGGKSRLKKSQFLIKTRKKKKEKHTHHAPLSPRTFHPLRSEAYNTFSERRLKHSLVLHKSNETSLPTDLNQTLPSMDFGWIASLPDHNQNSSNDTGQASCPPGLYQTVPPEEHYQTFPIQDPDQMHSTSDPSHRSSSPELSEMLEYDRSHKSFPTDISQMSPSSEHEVWQTVISPDLSQVTLSPELSQTNLSPDLSHTTLSPELIQRNLSPALGQMPISPDLSHTTLSPDLSHTTLSLDLSQTNLSPELSQTNLSPALGQMPLSPDLSHTTLSLDFSQTNLSPELSHMTLSPELSQTNLSPALGQMPISPDLSHTTLSLDFSQTNLSPELSQTNLSPALGQMPLSPDPSHTTLSLDLSQTNLSPELSQTNLSPDLSEMPLFADLSQIPLTPDLDQMTLSPDLGETDLSPNFGQMSLSPDLSQVTLSPDISDTTLLPDLSQISPPPDLDQIFYPSESSQSLLLQEFNESFPYPDLGQMPSPSSPTLNDTFLSKEFNPLVIVGLSKDGTDYIEIIPKEEVQSSEDDYAEIDYVPYDDPYKTDVRTNINSSRDPDNIAAWYLRSNNGNRRNYYIAAEEISWDYSEFVQRETDIEDSDDIPEDTTYKKVVFRKYLDSTFTKRDPRGEYEEHLGILGPIIRAEVDDVIQVRFKNLASRPYSLHAHGLSYEKSSEGKTYEDDSPEWFKEDNAVQPNSSYTYVWHATERSGPESPGSACRAWAYYSAVNPEKDIHSGLIGPLLICQKGILHKDSNMPMDMREFVLLFMTFDEKKSWYYEKKSRSSWRLTSSEMKKSHEFHAINGMIYSLPGLKMYEQEWVRLHLLNIGGSQDIHVVHFHGQTLLENGNKQHQLGVWPLLPGSFKTLEMKASKPGWWLLNTEVGENQRAGMQTPFLIMDRDCRMPMGLSTGIISDSQIKASEFLGYWEPRLARLNNGGSYNAWSVEKLAAEFASKPWIQVDMQKEVIITGIQTQGAKHYLKSCYTTEFYVAYSSNQINWQIFKGNSTRNVMYFNGNSDASTIKENQFDPPIVARYIRISPTRAYNRPTLRLELQGCEVNGCSTPLGMENGKIENKQITASSFKKSWWGDYWEPFRARLNAQGRVNAWQAKANNNKQWLEIDLLKIKKITAIITQGCKSLSSEMYVKSYTIHYSEQGVEWKPYRLKSSMVDKIFEGNTNTKGHVKNFFNPPIISRFIRVIPKTWNQSIALRLELFGCDIY

SEQ ID NO: 4973 - protein, 2229 aa, Homo Sapiens
MFPGCPRLWVLVVLGTSWVGWGSQGTEAAQLRQFYVAAQGISWSYRPEPTNSSLNLSVTSFKKIVYREYEPYFKKEKPQSTISGLLGPTLYAEVGDIIKVHFKNKADKPLSIHPQGIRYSKLSEGASYLDHTFPAEKMDDAVAPGREYTYEWSISEDSGPTHDDPPCLTHIYYSHENLIEDFNSGLIGPLLICKKGTLTEGGTQKTFDKQIVLLFAVFDESKSWSQSSSLMYTVNGYVNGTMPDITVCAHDHISWHLLGMSSGPELFSIHFNGQVLEQNHHKVSAITLVSATSTTANMTVGPEGKWIISSLTPKHLQAGMQAYIDIKNCPKKTRNLKKITREQRRHMKRWEYFIAAEEVIWDYAPVIPANMDKKYRSQHLDNFSNQIGKHYKKVMYTQYEDESFTKHTVNPNMKEDGILGPIIRAQVRDTLKIVFKNMASRPYSIYPHGVTFSPYEDEVNSSFTSGRNNTMIRAVQPGETYTYKWNILEFDEPTENDAQCLTRPYYSDVDIMRDIASGLIGLLLICKSRSLDRRGIQRAADIEQQAVFAVFDENKSWYLEDNINKFCENPDEVKRDDPKFYESNIMSNFTLSAINGYVPESITTLGFCFDDTVQWHFCSVGTQNEILTIHFTGHSFIYGKRHEDTLTLFPMRGESVTVTMDNVGTWMLTSMNSSPRSKKLRLKFRDVKCIPDDDEDSYEIFEPPESTVMATRKMHDRLEPEDEESDADYDYQNRLAAALGIRSFRNSSLNQEEEEFNLTALALENGTEFVSSNTDIIVGSNYSSPSNISKFTVNNLAEPQKAPSHQQATTAGSPLRHLIGKNSVLNSSTAEHSSPYSEDPIEDPLQPDVTGIRLLSLGAGEFKSQEHAKHKGPKVERDQAAKHRFSWMKLLAHKVGRHLSQDTGSPSGMRPWEDLPSQDTGSPSRMRPWKDPPSDLLLLKQSNSSKILVGRWHLASEKGSYEIIQDTDEDTAVNNWLISPQNASRAWGESTPLANKPGKQSGHPKFPRVRHKSLQVRQDGGKSRLKKSQFLIKTRKKKKEKHTHHAPLSPRTFHPLRSEAYNTFSERRLKHSLVLHKSNETSLPTDLNQTLPSMDFGWIASLPDHNQNSSNDTGQASCPPGLYQTVPPEEHYQTFPIQDPDQMHSTSDPSHRSSSPELSEMLEYDRSHKSFPTDISQMSPSSEHEVWQTVISPDLSQVTLSPELSQTNLSPDLSHTTLSPELIQRNLSPALGQMPISPDLSHTTLSPDLSHTTLSLDLSQTNLSPELSQTNLSPALGQMPLSPDLSHTTLSLDFSQTNLSPELSHMTLSPELSQTNLSPALGQMPISPDLSHTTLSLDFSQTNLSPELSQTNLSPALGQMPLSPDPSHTTLSLDLSQTNLSPELSQTNLSPDLSEMPLFADLSQIPLTPDLDQMTLSPDLGETDLSPNFGQMSLSPDLSQVTLSPDISDTTLLPDLSQISPPPDLDQIFYPSESSQSLLLQEFNESFPYPDLGQMPSPSSPTLNDTFLSKEFNPLVIVGLSKDGTDYIEIIPKEEVQSSEDDYAEIDYVPYDDPYKTDVRTNINSSRDPDNIAAWYLRSNNGNRRNYYIAAEEISWDYSEFVQRETDIEDSDDIPEDTTYKKVVFRKYLDSTFTKRDPRGEYEEHLGILGPIIRAEVDDVIQVRFKNLASRPYSLHAHGLSYEKSSEGKTYEDDSPEWFKEDNAVQPNSSYTYVWHATERSGPESPGSACRAWAYYSAVNPEKDIHSGLIGPLLICQKGILHKDSNMPMDMREFVLLFMTFDEKKSWYYEKKSRSSWRLTSSEMKKSHEFHAINGMIYSLPGLKMYEQEWVRLHLLNIGGSQDIHVVHFHGQTLLENGNKQHQLGVWPLLPGSFKTLEMKASKPGWWLLNTEVGENQRAGMQTPFLIMDRDCRMPMGLSTGIISDSQIKASEFLGYWEPRLARLNNGGSYNAWSVEKLAAEFASKPWIQVDMQKEVIITGIQTQGAKHYLKSCYTTEFYVAYSSNQINWQIFKGNSTRNVMYFNGNSDASTIKENQFDPPIVARYIRISPTRAYNRPTLRLELQGCEVNGCSTPLGMENGKIENKQITASSFKKSWWGDYWEPFRARLNAQGRVNAWQAKANNNKQWLEIDLLKIKKITAIITQGCKSLSSEMYVKSYTIHYSEQGVEWKPYRLKSSMVDKIFEGNTNTKGHVKNFFNPPIISRFIRVIPKTWNQSIALRLELFGCDIY

SEQ ID NO: 4974 - protein, 382 aa, Homo Sapiens
MVSQALRLLCLLLGLQGCLAADGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 4975 - protein, 74 aa, Homo Sapiens
MVSQALRLLCLLLGLQGCLAAGGSPRRPAPAPARQRVPGGAAAGLPGEGVQGGAVLLRGGPGDLQGRGEDVVSG

SEQ ID NO: 4976 - protein, 466 aa, Homo Sapiens
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 4977 - protein, 444 aa, Homo Sapiens
MVSQALRLLCLLLGLQGCLAAVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 4978 - protein, 165 aa, Homo Sapiens [sequence omitted]

SEQ ID NO: 4979 - protein, 222 aa, Homo Sapiens
MHRDARAQKASRGFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYV

SEQ ID NO: 4980 - protein, 262 aa, Homo Sapiens
MLEQEEERENARKGGSAAHFQTIIRSCERSIRRIARGKSAPMIQSPPTRPFLQQVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLY

SEQ ID NO: 4981 - protein, 63 aa, Homo Sapiens
MQIELSTCFFLCLLRFCFSATRRYYLGAVELSWDYMQSDLDFLLECQNLFHSTPQSCTKRLCL

SEQ ID NO: 4982 - protein, 2351 aa, Homo Sapiens
MQIELSTCFFLCLLRFCFSATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHPSTRQKQFNATTIPENDIEKTDPWFAHRTPMPKIQNVSSSDLLMLLRQSPTPHGLSLSDLQEAKYETFSDDPSPGAIDSNNSLSEMTHFRPQLHHSGDMVFTPESGLQLRLNEKLGTTAATELKKLDFKVSSTSNNLISTIPSDNLAAGTDNTSSLGPPSMPVHYDSQLDTTLFGKKSSPLTESGGPLSLSEENNDSKLLESGLMNSQESSWGKNVSSTESGRLFKGKRAHGPALLTKDNALFKVSISLLKTNKTSNNSATNRKTHIDGPSLLIENSPSVWQNILESDTEFKKVTPLIHDRMLMDKNATALRLNHMSNKTTSSKNMEMVQQKKEGPIPPDAQNPDMSFFKMLFLPESARWIQRTHGKNSLNSGQGPSPKQLVSLGPEKSVEGQNFLSEKNKVVVGKGEFTKDVGLKEMVFPSSRNLFLTNLDNLHENNTHNQEKKIQEEIEKKETLIQENVVLPQIHTVTGTKNFMKNLFLLSTRQNVEGSYDGAYAPVLQDFRSLNDSTNRTKKHTAHFSKKGEEENLEGLGNQTKQIVEKYACTTRISPNTSQQNFVTQRSKRALKQFRLPLEETELEKRIIVDDTSTQWSKNMKHLTPSTLTQIDYNEKEKGAITQSPLSDCLTRSHSIPQANRSPLPIAKVSSFPSIRPIYLTRVLFQDNSSHLPAASYRKKDSGVQESSHFLQGAKKNNLSLAILTLEMTGDQREVGSLGTSATNSVTYKKVENTVLPKPDLPKTSGKVELLPKVHIYQKDLFPTETSNGSPGHLDLVEGSLLQGTEGAIKWNEANRPGKVPFLRVATESSAKTPSKLLDPLAWDNHYGTQIPKEEWKSQEKSPEKTAFKKKDTILSLNACESNHAIAAINEGQNKPEIEVTWAKQGRTERLCSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLY

SEQ ID NO: 4983 - protein, 216 aa, Homo Sapiens
MRIQDPGKVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLY

SEQ ID NO: 4984 - protein, 461 aa, Homo Sapiens
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 4985 - protein, 423 aa, Homo Sapiens
MQRVNMIMAESPGLITICLLGYLLSAECTVFLDHENANKILNRPKRYNSGKLEEFVQGNLERECMEEKCSFEEAREVFENTERTTEFWKQYVDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 4986 - protein, 38 aa, Homo Sapiens
LTQVLRAVLSACTWVSRKGDLQRMKQTHKGKRTFSQDG

SEQ ID NO: 4987 - protein, 128 aa, Homo Sapiens
MAFTGKFEMESEKNYDEFMKLLGISSDVIEKARNFKIVTEVQQDGQDFTWSQHYSGGHTMTNKFTVGKESNIQTMGGKTFKATVQMEGGKLVVNFPNYHQTSEIVGDKLVEVSTIGGVTYERVSKRLA

SEQ ID NO: 4988 - protein, 177 aa, Homo Sapiens
MKTVTMMMVVEMQALTQVLRAVLSACTWVSRKGDLQRMKQTHKGKPPSSMAFTGKFEMESEKNYDEFMKLLGISSDVIEKARNFKIVTEVQQDGQDFTWSQHYSGGHTMTNKFTVGKESNIQTMGGKTFKATVQMEGGKLVVNFPNYHQTSEIVGDKLVEVSTIGGVTYERVSKRLA

SEQ ID NO: 4989 - protein, 67 aa, Homo Sapiens
MAEPDYIEDDNPELIRPQKLINPVKTSRNHQDLHRELLMNQKRGLAPQNKPELQKVMEKRKRDQVIK

SEQ ID NO: 4990 - protein, 84 aa, Homo Sapiens
MAEPDYIEDDNPELIRPQKLINPVKTSRNHQDLHRELLMNQKRGLAPQNKPELQKVMEKRKRDQVIKQKEEEAQKKKSDLEIEL

SEQ ID NO: 4991 - protein, 90 aa, Homo Sapiens
MAEPDYIEDDNPELIRPQKLINPVKTSRNHQDLHRELLMNQKRGLAPQNKPELQKVMEKRKRDQVIKQKEEEAQKKKSDLEIELLKRQQK

SEQ ID NO: 4992 - protein, 93 aa, Homo Sapiens
MAEPDYIEDDNPELIRPQKLINPVKTSRNHQDLHRELLMNQKRGLAPQNKPELQKVMEKRKRDQVIKQKEEEAQKKKSDLEIELLKRQQKLEQ

SEQ ID NO: 4993 - protein, 101 aa, Homo Sapiens
MAEPDYIEDDNPELIRPQKLINPVKTSRNHQDLHRELLMNQKRGLAPQNKPELQKVMEKRKRDQVIKQKEEEAQKKKSDLEIELLKRQQKLEQLELEKQKL

SEQ ID NO: 4994 - protein, 125 aa, Homo Sapiens
MAEPDYIEDDNPELIRPQKLINPVKTSRNHQDLHRELLMNQKRGLAPQNKPELQKVMEKRKRDQVIKQKEEEAQKKKSDLEIELLKRQQKLEQLELEKQKLQEEQENAPEFVKVKGNLRRTGQEV

SEQ ID NO: 4995 - protein, 126 aa, Homo Sapiens
MAEPDYIEDDNPELIRPQKLINPVKTSRNHQDLHRELLMNQKRGLAPQNKPELQKVMEKRKRDQVIKQKEEEAQKKKSDLEIELLKRQQKLEQLELEKQKLQEEQENAPEFVKVKGNLRRTGQEVA

SEQ ID NO: 4996 - protein, 128 aa, Homo Sapiens
MAEPDYIEDDNPELIRPQKLINPVKTSRNHQDLHRELLMNQKRGLAPQNKPELQKVMEKRKRDQVIKQKEEEAQKKKSDLEIELLKRQQKLEQLELEKQKLQEEQENAPEFVKVKGNLRRTGQEVAQA

SEQ ID NO: 4997 - protein, 131 aa, Homo Sapiens
MAEPDYIEDDNPELIRPQKLINPVKTSRNHQDLHRELLMNQKRGLAPQNKPELQKVMEKRKRDQVIKQKEEEAQKKKSDLEIELLKRQQKLEQLELEKQKLQEEQENAPEFVKVKGNLRRTGQEVAQAQES

SEQ ID NO: 4998 - protein, 131 aa, Homo Sapiens; identical to SEQ ID NO: 4997

SEQ ID NO: 4999 - protein, 131 aa, Homo Sapiens; identical to SEQ ID NO: 4997

SEQ ID NO: 5000 - protein, 131 aa, Homo Sapiens; identical to SEQ ID NO: 4997

SEQ ID NO: 5001 - protein, 131 aa, Homo Sapiens; identical to SEQ ID NO: 4997

SEQ ID NO: 5002 - protein, 131 aa, Homo Sapiens; identical to SEQ ID NO: 4997

SEQ ID NO: 5003 - protein, 131 aa, Homo Sapiens; identical to SEQ ID NO: 4997

SEQ ID NO: 5004 - protein, 131 aa, Homo Sapiens; identical to SEQ ID NO: 4997

SEQ ID NO: 5005 - protein, 131 aa, Homo Sapiens; identical to SEQ ID NO: 4997

SEQ ID NO: 5006 - protein, 131 aa, Homo Sapiens; identical to SEQ ID NO: 4997

SEQ ID NO: 5007 - protein, 131 aa, Homo Sapiens; identical to SEQ ID NO: 4997

SEQ ID NO: 5008 - protein, 51 aa, Homo Sapiens
MAEPDYIEDDNPELIRPQKLINPVKTSRNHQDLHRELLMNQKRILVWLEIH

SEQ ID NO: 5009 - protein, 306 aa, Homo Sapiens
MSTWKARLTKRLKSPSRSMHPFPCSALLACFGNTRESASFNQSGVADTHSTVRVQPVAKAGRQPRHPSAEGAPEKRQDSSTHAERNGSANRNSSHRTAAQPAETPEDVPGSLDDGADCEAVVFHASIPRPSIIDTPKEEEFREEPKCLELEQKMTSDSPPEDIDHKDSYLITRSIMAEPDYIEDDNPELIRPQKLINPVKTSRNHQDLHRELLMNQKRGLAPQNKPELQKVMEKRKRDQVIKQKEEEAQKKKSDLEIELLKRQQKLEQLELEKQKLQEEQENAPEFVKVKGNLRRTGQEVAQAQES

SEQ ID NO: 5010 - protein, 160 aa, Homo Sapiens
MSTWKARLTKRLKSPSRSMHPFPCSALLACFGNTRESASFNQSGVADTHSTVRVQPVAKAGRQPRHPSAEGAPEKRQDSSTHAERNGSANRNSSHRTAAQPAETPEDVPGSLDDGADCEAVVFHASIPRPSIIDTPKEEEFREEPKCLELEQKMTSGECS

SEQ ID NO: 5011 - protein, 251 aa, Homo Sapiens
MAQGRVAHLIEWKGWSKPSDSPAALESAFSSYSDLSEGEQEARFAAGVAEQFAIAEAKLRAWSSVDGEDSTDDSYDEDFAGGMDTDMAGQLPLGPHLQDLFTGHRFSRPVRQGSVEPESDCSQTVSPDTLCSSLCSLEDGLLGSPARLASQLLGDELLLAKLPPSRESAFRSLGPLEAQDSLYNSPLTEGWLLPSRSLWVEPSLKGPCPAGLVLCFIHLSIVSKSSSFFLKTEGFWSVFSVGSSLLWEALE

SEQ ID NO: 5012 - protein, 335 aa, Homo Sapiens
MFLATLSFLLPFAHPFGTVSCEYMLGSPLSSLAQVNLSPFSHPKVHMDPNYCHPSTSLHLCSLAWSFTRLLHPPLSPGISQVVKDHVTKPTAMAQGRVAHLIEWKGWSKPSDSPAALESAFSSYSDLSEGEQEARFAAGVAEQFAIAEAKLRAWSSVDGEDSTDDSYDEDFAGGMDTDMAGQLPLGPHLQDLFTGHRFSRPVRQGSVEPESDCSQTVSPDTLCSSLCSLEDGLLGSPARLASQLLGDELLLAKLPPSRESAFRSLGPLEAQDSLYNSPLTESCLSPAEEEPAPCKDCQPLCPPLTGSWERQRQASDLASSGVVSLDEDEAEPEEQ

SEQ ID NO: 5013 - protein, 123 aa, Homo Sapiens
MLPKSRRALTIQEIAALARSSLHGISQVVKDHVTKPTAMAQGRVAHLIEWKGWSKPSDSPAALESAFSSYSDLSEGEQEARFAAGVAEQFAIAEAKLRAWSSVDGEDSTDDSYDEDFAGGMDT

SEQ ID NO: 5014 - protein, 232 aa, Homo Sapiens
MLPKSRRALTIQEIAALARSSLHGISQVVKDHVTKPTAMAQGRVAHLIEWKGWSKPSDSPAALESAFSSYSDLSEGEQEARFAAGVAEQFAIAEAKLRAWSSVDGEDSTDDSYDEDFAGGMDTDMAGQLPLGPHLQDLFTGHRFSRPVRQGSVEPESDCSQTVSPDTLCSSLCSLEDGLLGSPARLASQLLGDELLLAKLPPSRESAFRSLGPLEAQDSLYNSPLTESCLSP

SEQ ID NO: 5015 - protein, 281 aa, Homo Sapiens
MLPKSRRALTIQEIAALARSSLHGISQVVKDHVTKPTAMAQGRVAHLIEWKGWSKPSDSPAALESAFSSYSDLSEGEQEARFAAGVAEQFAIAEAKLRAWSSVDGEDSTDDSYDEDFAGGMDTDMAGQLPLGPHLQDLFTGHRFSRPVRQGSVEPESDCSQTVSPDTLCSSLCSLEDGLLGSPARLASQLLGDELLLAKLPPSRESAFRSLGPLEAQDSLYNSPLTESCLSPAEEEPAPCKDCQPLCPPLTGSWERQRQASDLASSGVVSLDEDEAEPEEQ

SEQ ID NO: 5016 - protein, 281 aa, Homo Sapiens; identical to SEQ ID NO: 5015

SEQ ID NO: 5017 - protein, 281 aa, Homo Sapiens; identical to SEQ ID NO: 5015

SEQ ID NO: 5018 - protein, 366 aa, Homo Sapiens
MPMISVLGKMFLWQREGPGGRWTCQTSRRVSSDPAWAVEWIELPRGLSLSSLGSARTLRGWSRSSRPSSVDSQDLPEVNVGDTVAMLPKSRRALTIQEIAALARSSLHGISQVVKDHVTKPTAMAQGRVAHLIEWKGWSKPSDSPAALESAFSSYSDLSEGEQEARFAAGVAEQFAIAEAKLRAWSSVDGEDSTDDSYDEDFAGGMDTDMAGQLPLGPHLQDLFTGHRFSRPVRQGSVEPESDCSQTVSPDTLCSSLCSLEDGLLGSPARLASQLLGDELLLAKLPPSRESAFRSLGPLEAQDSLYNSPLTESCLSPAEEEPAPCKDCQPLCPPLTGSWERQRQASDLASSGVVSLDEDEAEPEEQ

SEQ ID NO: 5019 - protein, 359 aa, Homo Sapiens
MPMISVLGKMFLWQREGPGGRWTCQTSRRVSSDPAWAVEWIELPRGLSLSSLGSARTLRGWSRSSRPSSVDSQDLPEVNVGDTVAMLPKSRRALTIQEIAALARSSLHGISQVVKDHVTKPTAMAQGRVAHLIEWKGWSKPSDSPAALESAFSSYSDLSEGEQEARFAAGVAEQFAIAEAKLRAWSSVDGEDSTDDSYDEDFAGGMDTDMAGQLPLGPHLQDLFTGHRFSRPVRQGSVEPESDCSQTVSPDTLCSSLCSLEDGLLGSPARLASQLLGDELLLAKLPPSRESAFRSLGPLEAQDSLYNSPLTESCLSPAEEEPAPCKDCQPLCPPLTGSWERQRQASDLGLAPALPEPMG

SEQ ID NO: 5020 - protein, 890 aa, Homo Sapiens
MSRSATLLLCLLGCHVWKAVTKTLREPGAGAQEVTLKVHISDASTHQPVADALIEIFTNQASIASGTSGTDGVAFIKFQYKLGSQLIVTASKHAYVPNSAPWKPIRLPVFSSLSLGLLPERSATLMVYEDVVQIVSGFQGARPQPRVHFQRRALRLPENTSYSDLTAFLTAASSPSEVDSFPYLRGLDGNGTGNSTRHDLTPVTAVSVHLLSSNGTPVLVDGPIYVTVPLATQSSLRHNAYVAAWRFDQKLGTWLKSGLGLVHQEGSQLTWTYIAPQLGYWVAAMSPPIPGPVVTQDITTYHTVFLLAILGGMAFILLVLLCLLLYYCRRKCLKPRQHHRKLQLPAGLESSKRDQSTSMSHINLLFSRRASEFPGPLSVTSHGRPEAPGTKELMSGVHLEMMSPGGEGDLHTPMLKLSYSTSQEFSSREELLSCKEEDKSQISFDNLTPSGTLGKDYHKSVEVFPLKARKSMEREGYESSGNDDYRGSYNTVLSQPLFEKQDREGPASTGSKLTIQEHLYPAPSSPEKEQLLDRRPTECMMSRSVDHLERPTSFPRPGQLICCSSVDQVNDSVYRKVLPALVIPAHYMKLPGDHSYVSQPLVVPADQQLEIERLQAELSNPHAGIFPHPSSQIQPQPLSSQAISQQHLQDAGTREWSPQNASMSESLSIPASLNDAALAQMNSEVQLLTEKALMELGGGKPLPHPRAWFVSLDGRSNAHVRHSYIDLQRAGRNGSNDASLDSGVDMNEPKSARKGRGDALSLQQNYPPVQEHQQKEPRAPDSTAYTQLVYLDDVEQSGSECGTTVCTPEDSALRCLLEGSSRRSGGQLPSLQEETTRRTADAPSEPAASPHQRRSAHEEEEDDDDDDQGEDKKSPWQKREERPLMAFNIK

SEQ ID NO: 5021 - protein, 198 aa, Homo Sapiens
MSRSATLLLCLLGCHVWKAVTKTLREPGAGAQEVTLKVHISDASTHQPVADALIEIFTNQASIASGTSGTDGVAFIKFQYKLGSQLIVTASKHAYVPNSAPWKPIRLPVFSSLSLGLLPERSATLMVYEDVVQIVSGFQGNSTRHDLTPVTAVSVHLLSSNGTPVLVDGPIYVTVPLATQSSLRHNAYVAAWRFDQKL

SEQ ID NO: 5022 - protein, 826 aa, Homo Sapiens
MARLCRRVPCTLLLGLAVVLLKARLVPAAARAELSRSDLSLIQQQQQQQQQQQQQQKQLEEAEEERTEVPGATSTLTVPVSVFMLKVQVNDIISRQYLSQAVVEVFVNYTKTNSTVTKSNGAVLIKVPYKLGLSLTIIAYKDGYVLTPLPWKTRRMPIYSSVTLSLFPQSQANIWLFEDTVLITGKLADAKSQPSVQFSKALIKLPDNHHISNVTGYLTVLQQFLKVDNFLHTTGITLNKPGFENIELTPLAAICVKIYSGGKELKVNGSIQVSLPLLRLNDISAGDRIPAWTFDMNTGAWVNHGRGMVKEHNNHLIWTYDAPHLGYWIAAPLPGTRGSGINEDSKDITAYHTVFLTAILGGTIVIVIGFFAVLLCYCRDKCGTPQKRERNITKLEVLKRDQTTSTTHINHISTVKVALKAEDKSQLFNAKNSSYSPQKKEPSKAETEERVSMVKTRDDFKIYNEDVSFLSVNQNNYSRNPTQSLEPNVGSKQPKHINNNLSSSLGDAQDEKRYLTGNEEAYGRSHIPEQLMHIYSQPIAILQTSDLFSTPEQLHTAKSATLPRKGQLVYGQLMEPVNRENFTQTLPKMPIHSHAQPPDAREEDIILEGQQSLPSQASDWSRYSSSLLESVSVPGTLNEAVVMTPFSSELQGISEQTLLELSKGKPSPHPRAWFVSLDGKPVAQVRHSFIDLKKGKRTQSNDTSLDSGVDMNELHSSRKLEREKTFIKSMHQPKILYLEDLDLSSSESGTTVCSPEDPALRHILDGGSGVIMEHPGEESPGRKSTVEDFEANTSPTKRRGRPPLAKRDSKTNIWKKREERPLIPIN

SEQ ID NO: 5023 - protein, 238 aa, Homo Sapiens
MARLCRRVPCTLLLGLAVVLLKARLVPAAARAELSRSDLSLIQQQQQQQQQQQQQQKQLEEAEEERTEVPGATSTLTVPVSVFMLKVQVNDIISRQYLSQAVVEVFVNYTKTNSTVTKSNGAVLIKVPYKLGLSLTIIAYKDGYVLTPLPWKTRRMPIYSSVTLSLFPQSQANIWLFEDTVLITGKLADAKSQPSVQFSKALIKLPDNHHISNVTGYLTVLQQFLKVDNFLHTTGITQ

SEQ ID NO: 5024 - protein, 306 aa, Homo Sapiens
MKKDEPPLDFPDTLEGFEYAFNEKGQLRHIKTGEPFVFNYREDLHRWNQKRYEALGEIITKYVYELLEKDCNLKKVSIPEGYGVIVLNPNENYIEVEKPKIHVQSSSDSSDEPAEKRERKDKVSKETKKRRDFYEKYRNPQREKEMMQLYIRENGSPEEHAIYVWDHFIAQAAAENVFFVAHSYGGLAFVELMIQREADVKNKVTAVALTDSVHNVWHQEAGKTIREWMRENCCNWVSSSEPLDTSVESMLPDCPRVSAGTDRHELTSWKSFPSIFKFFTEASEAKTSSLKPAVTRRSHRIKHEEL

SEQ ID NO: 5025 - protein, 370 aa, Homo Sapiens
MKKDEPPLDFPDTLEGFEYAFNEKGQLRHIKTGEPFVFNYREDLHRWNQKRYEALGEIITKYVYELLEKDCNLKKVSIPVDATESEPKSFIFMSEDALTNPQKLMVLIHGSGVVRAGQWARRLIINEDLDSGTQIPFIKRAVAEGYGVIVLNPNENYIEVEKPKIHVQSSSDSSDEPAEKRERKDKVSKETKKRRDFYEKYRNPQREKEMMQLYIRENGSPEEHAIYVWDHFIAQAAAENVFFVAHSYGGLAFVELMIQREADVKNKVTAVALTDSVHNVWHQEAGKTIREWMRENCCNWVSSSEPLDTSVESMLPDCPRVSAGTDRHELTSWKSFPSIFKFFTEASEAKTSSLKPAVTRRSHRIKHEEL

SEQ ID NO: 5026 - protein, 269 aa, Homo Sapiens
MNRLLIFLIPWKDLNMLLMKIITKYVYELLEKDCNLKKVSIPEGYGVIVLNPNENYIEVEKPKIHVQSSSDSSDEPAEKRERKDKVSKETKKRRDFYEKYRNPQREKEMMQLYIRENGSPEEHAIYVWDHFIAQAAAENVFFVAHSYGGLAFVELMIQREADVKNKVTAVALTDSVHNVWHQEAGKTIREWMRENCCNWVSSSEPLDTSVESMLPDCPRVSAGTDRHELTSWKSFPSIFKFFTEASEAKTSSLKPAVTRRSHRIKHEEL

SEQ ID NO: 5027 - protein, 305 aa, Homo Sapiens
MNRLLIFLIPWKDLNMLLMKIITKYVYELLEKDCNLKKVSIPVDATESEPKSFIFMSEDALTNPQKLMVLIHGSGVVRAGQWARRLIINEDLDSGTQIPFIKRAVAEGYGVIVLNPNENYIEVEKPKIHVQSSSDSSDEPAEKRERKDKVSKETKKRRDFYEKYRNPQREKEMMQLYIRENGSPEEHAIYVWDHFIAQAAAENVFFVAHSYGGLAFVELMIQREADVKNKVTAVALTDSVHNVWHQEAGKTIREWMRENCCNWVSSSEPLDTSVESMLPDCPRVSAGFSCCQMQSHEDLLLCFLL

SEQ ID NO: 5028 - protein, 416 aa, Homo Sapiens
MSISLSSLILLPIWINMAQIQQGGPDEKEKTTALKDLLSRIDLDELMKKDEPPLDFPDTLEGFEYAFNEKGQLRHIKTGEPFVFNYREDLHRWNQKRYEALGEIITKYVYELLEKDCNLKKVSIPVDATESEPKSFIFMSEDALTNPQKLMVLIHGSGVVRAGQWARRLIINEDLDSGTQIPFIKRAVAEGYGVIVLNPNENYIEVEKPKIHVQSSSDSSDEPAEKRERKDKVSKETKKRRDFYEKYRNPQREKEMMQLYIRENGSPEEHAIYVWDHFIAQAAAENVFFVAHSYGGLAFVELMIQREADVKNKVTAVALTDSVHNVWHQEAGKTIREWMRENCCNWVSSSEPLDTSVESMLPDCPRVSAGTDRHELTSWKSFPSIFKFFTEASEAKTSSLKPAVTRRSHRIKHEEL

SEQ ID NO: 5029 - protein, 36 aa, Homo Sapiens
AAAAAFGESAGQVGGAAEADVRGAEPPPCLLRGPLF

SEQ ID NO: 5030 - protein, 76 aa, Homo Sapiens
MDQEPVGGVERGEAVAASGAAAAAAFGESAGQMSNERGFENVELGVIGKKKKVPRRVIHFVSGETMEEYSTDEDEV

SEQ ID NO: 5031 - protein, 213 aa, Homo Sapiens
MDQEPVGGVERGEAVAASGAAAAAAFGESAGQMSNERGFENVELGVIGKKKKVPRRVIHFVSGETMEEYSTDEDEVDGLEKKDVLPTVDPTKLTWGPYLWFYMLRAATSTLSVCDFLGEKIASVLGISTPKYQYAIDEYYRMKKEEEEEEEENRMSEEAEKQYQQNKLQTDSIVQTDQPETVISSSFVNVNFEMEGDSEVIMESKQNPVSVPP

SEQ ID NO: 5032 - protein, 213 aa, Homo Sapiens; identical to SEQ ID NO: 5031

SEQ ID NO: 5033 - protein, 236 aa, Homo Sapiens
MEVGLPAITLFLTSASSPVVATTMDQEPVGGVERGEAVAASGAAAAAAFGESAGQMSNERGFENVELGVIGKKKKVPRRVIHFVSGETMEEYSTDEDEVDGLEKKDVLPTVDPTKLTWGPYLWFYMLRAATSTLSVCDFLGEKIASVLGISTPKYQYAIDEYYRMKKEEEEEEEENRMSEEAEKQYQQNKLQTDSIVQTDQPETVISSSFVNVNFEMEGDSEVIMESKQNPVSVPP

SEQ ID NO: 5034 - protein, 89 aa, Homo Sapiens
MEVGLPAITLFLTSASSPVVATTMDQEPVGGVERGEAVAASGAAAAAAFGESAGQNLTLLPRLKFMARSRLAATSTSRVQAILLPQPPV

SEQ ID NO: 5035 - protein, 140 aa, Homo Sapiens
MSNERGFENVELGVIGKKKKVPRRVIHFVSGETMEEYSTDEDEVDGLEKKDVLPTVDPTKLTWGPYLWFYMLRAATSTLSVCDFLGEKIASVLGISTPKYQYAIDEYYRMKKEEEEEEEENRMSEEAEKQYQQNKLQTDS

SEQ ID NO: 5036 - protein, 39 aa, Homo Sapiens
  misc_feature (1)..(1): Xaa can be any naturally occurring amino acid
XAFGESAGQEIKGSKKLSHGPKGNVDVRTAIAKFYLKDE

SEQ ID NO: 5037 - protein, 7 aa, Homo Sapiens
  misc_feature (1)..(1): Xaa can be any naturally occurring amino acid
XLRGPLF

SEQ ID NO: 5038 - protein, 49 aa, Homo Sapiens
  misc_feature (1)..(1): Xaa can be any naturally occurring amino acid
XNKLQTDSIVQTDQPETVISSSFVNVNFEMEGDSEVIMESKQNPVSVPP

SEQ ID NO: 5039 - protein, 173 aa, Homo Sapiens
MHWKMLLLLLLYYNAEASMCHRWSRAVLFPAAHRPKRSSSLPLNPVLQTSLEEVELLYEFLLAELEISPDLQISIKDEELASLRKASDFRTVCNNVIPKSIPDIRRLSASLSSHPGILKKEDFERTVLTLAYTAYRTALSHGHQKDIWAQSLVSLFQALRHDLMRSSQPGVPP

SEQ ID NO: 5040 - protein, 173 aa, Homo Sapiens; identical to SEQ ID NO: 5039

SEQ ID NO: 5041 - protein, 173 aa, Homo Sapiens; identical to SEQ ID NO: 5039

SEQ ID NO: 5042 - protein, 78 aa, Homo Sapiens
MLLSAVCVMLNLAGSILSCQNAQLVNSLEGCQLIKFDSVEVCVCCELQHQSSGCSNLGETLKLNPLQENCNAVRLTLK

SEQ ID NO: 5043 - protein, 539 aa, Homo Sapiens
MPPAGGPRAPRPAALPRSLSRLRECPGRSRIVLALGATQMALGCLIVAVSFAALALTTSARVRHSCPFWAGFSVLLSGLIGVVSWKRPLSLVITFFMLLSAVCVMLNLAGSILSCQNAQLVNSLEGCQLIKFDSVEVCVCCELQHQSSGCSNLGETLKLNPLQENCNAVRLTLKDLLFSVCALNVLSTIVCALATAMCCMQMVSSDVLQMFLPQRSHPANPTCVTPHGTVLHQTLDFDEFIPPLPPPPYYPPEYTCTPSTEAQRGLHLDFAPSPFGTLYDVAINSPGLLYPAELPPPYEAVVGQPPASQVTSIGQQVAESSSGDPNTSAGFSTPVPADSTSLLVSEGTATPGSSPSPDGPVGAPAPSEPALPPGHVSPEDPGMGSQVQPGPGRVSRSTSDPTLCTSSMAGDASSHRPSCSQDLEAGLSEAVPGSASMSRSATAACRAQLSPAGDPDTWKTDQRPTPEPFPATSKERPRSLVDSKAYADARVLVAKFLEHSHCALPTEAQHMVGAMRLAVTNEERLEEEAVFGADVLDQV

SEQ ID NO: 5044 - protein, 575 aa, Homo Sapiens
MASWLRRKLRGKRRPVIAFCLLMILSAMAVTRFPPQRPSAGPDPGPMEPQGVTGAPATHIRQALSSSRRQRARNMGFWRSRALPRNSILVCAEEQGHRARVDRSRESPGGDLRHPGRVRRDITLSGHPRLSTQHVVLLREDEVGDPGTKDLGHPQHGSPIQETQSEVVTLVSPLPGSDMAALPAWRATSGLTLWPHTAEGRDLLGAENRALTGGQQAEDPTLASGAHQWPGSVEKLQGSVWCDAETLLSSSRTGGQAPPWLTDHDVQMLRLLAQGEVVDKARVPAHGQVLQVGFSTEAALQDLSSPRLSQLCSQGLCGLIKRPGDLPEVLSFHVDRVLGLRRSLPAVARRFHSPLLPYRYTDGGARPVIWWAPDVQHLSDPDEDQNSLALGWLQYQALLAHSCNWPGQAPCPGIHHTEWARLALFDFLLQVHDRLDRYCCGFEPEPSDPCVEERLREKCQNPAELRLVHILVRSSDPSHLVYIDNAGNLQHPEDKLNFRLLEGIDGFPESAVKVLASGCLQNMLLKSLQMDPVFWESQGGAQGLKQVLQTLEQRGQVLLGHIQKHNLTLFRDEDP

SEQ ID NO: 5045 - protein, 575 aa, Homo Sapiens; identical to SEQ ID NO: 5044

SEQ ID NO: 5046 - protein, 140 aa, Homo Sapiens
MVHDRLDRYCCGFEPEPSDPCVEERLREKCQNPAELRLVHILVRSSDPSHLVYIDNAGNLQHPEDKLNFRLLEGIDGFPESAVKVLASGCLQNMLLKSLQMDPVFWESQGGAQGLKQVLQTLEQRGQVLLGHIQKHNLTL

SEQ ID NO: 5047 - protein, 133 aa, Homo Sapiens [sequence omitted]

SEQ ID NO: 5048 - protein, 133 aa, Homo Sapiens [sequence omitted]

SEQ ID NO: 5049 - protein, 52 aa, Homo Sapiens [sequence omitted]

SEQ ID NO: 5050 - protein, 87 aa, Homo Sapiens
MMSKRYLQKATKGKLLIIIFIVTLWGKVVSSANHHKAHHVKTGTCEVVALHRCCNKNKIEERSQTVKCSCFPGQVAGTTRAAPSCVD

SEQ ID NO: 5051 - protein, 110 aa, Homo Sapiens
MMSKRYLQKATKGKLLIIIFIVTLWGKVVSSANHHKAHHVKTGTCEVVALHRCCNKNKIEERSQTVKCSCFPGQVAGTTRAAPSCVDASIVEQKWWCHMQPCLEGEECKV

SEQ ID NO: 5052 - protein, 34 aa, Homo Sapiens
MQPCLEGEECKVLPDRKGWSCSSGNKVKTTRVTH

SEQ ID NO: 5053 - protein, 131 aa, Homo Sapiens
MSKRYLQKATKGKLLIIIFIVTLWGKVVSSANHHKAHHVKTGTCEVVALHRCCNKNKIEERSQTVKCSCFPGQVAGTTRAAPSCVDASIVEQKWWCHMQPCLEGEECKVLPDRKGWSCSSGNKVKTTRANV

SEQ ID NO: 5054 - protein, 131 aa, Homo Sapiens
MSKRYLQKATKGKLLIIIFIVTLWGKVVSSANHHKAHHVKTGTCEVVALHRCCNKNKIEERSQTVKCSCFPGQVAGTTRAAPSCVDASIVEQKWWCHMQPCLEGEECKVLPDRKGWSCSSGNKVKTTRVTH

SEQ ID NO: 5055 - protein, 131 aa, Homo Sapiens; identical to SEQ ID NO: 5054

SEQ ID NO: 5056 - protein, 49 aa, Homo Sapiens
MSKRYLQKATKGKLLIIIFIVTLWGKVVSSANHHKGNPLTQEKSSDPQG

SEQ ID NO: 5057 - protein, 101 aa, Homo Sapiens
MVTPITRMSKRYLQKATKGKLLIIIFIVTLWGKVVSSANHHKAHHVKTGTCEVVALHRCCNKNKIEERSQTVKCSCFPGQVAGTTRAAPSCVDASIVEQKW

SEQ ID NO: 5058 - protein, 133 aa, Homo Sapiens
MSERVERNWSTGGWLLALCLAWLWTHLTLAALQPPTATVLVQQGTCEVIAAHRCCNRNRIEERSQTVKCSCFSGQVAGTTRAKPSCVDASIVLQRWWCQMEPCLPGEECKVLPDLSGWSCSSGHKVKTTKVTR

SEQ ID NO: 5059 - protein, 169 aa, Homo Sapiens
MSERVERNWSTGGWLLALCLAWLWTHLTLAALQPPTATVLVQQGTCEVIAAHRCCNRNRIEERSQTVKCSCFSGQVAGTTRAKPSCVDDLLLAAHCARRDPRAALRLLLPQPPSSCRDGGVRWSPACRGRSVRCSRTCRDGAAAVDTKSKPPRSHDSSWGSRPGQERLD

SEQ ID NO: 5060 - protein, 58 aa, Homo Sapiens
MRSPRMRVCAKSVLLSHWLFLAYVLMVCCKLMSASSQHLRGHAGHHQIKQGTCEVVAV

SEQ ID NO: 5061 - protein, 77 aa, Homo Sapiens
MRSPRMRVCAKSVLLSHWLFLAYVLMVCCKLMSASSQHLRGHAGHHQIKQGTCEVVAVHRCCNKNRIEERSQTVKCS

SEQ ID NO: 5062 - protein, 140 aa, Homo Sapiens
MRSPRMRVCAKSVLLSHWLFLAYVLMVCCKLMSASSQHLRGHAGHHQIKQGTCEVVAVHRCCNKNRIEERSQTVKCSCFPGQVAGTTRAQPSCVEASIVIQKWWCHMNPCLEGEDCKVLPDYSGWSCSSGNKVKTTKVTR

SEQ ID NO: 5063 - protein, 181 aa, Homo Sapiens
MAPSPRTGSRQDATALPSMSSTFWAFMILASLLIAYCSQLAAGTCEIVTLDRDSSQPRRTIARQTARCACRKGQIAGTTRARPACVDARIIKTKQWCDMLPCLEGEGCDLLINRSGWTCTQPGGRIKTTTSPSKPPKRAPPGIPSCRQRAGGSLGSRDLRTSLLCQGSHLADRRRWLRPSQ

SEQ ID NO: 5064 - protein, 132 aa, Homo Sapiens
MAPSPRTGSRQDATALPSMSSTFWAFMILASLLIAYCSQLAAGTCEIVTLDRDSSQPRRTIARQTARCACRKGQIAGTTRARPACVDARIIKTKQWCDMLPCLEGEGCDLLINRSGWTCTQPGGRIKTTTVS

SEQ ID NO: 5065 - protein, 125 aa, Homo Sapiens
MQLLKALWALAGAALCCFLVLVIHAQFLKEGQLAAGTCEIVTLDRDSSQPRRTIARQTARCACRKGQIAGTTRARPACVDARIIKTKQWCDMLPCLEGEGCDLLINRSGWTCTQPGGRIKTTTVS

SEQ ID NO: 5066 - protein, 53 aa, Homo Sapiens
MYHHREWPARIIKTKQWCDMLPCLEGEGCDLLINRSGWTCTQPGGRIKTTTVS

SEQ ID NO: 5067 - protein, 145 aa, Homo Sapiens
MFTSPSEGKPGNMDRHHYEMFTKFGDDGFLIHLDNARGFGRHSHDEISILSPLSQCCMIKKKTLLHLQLLAQADYRLSDVMRESLLEDQLSPVLTEPHLLALDRRLQTILRTVEGCIVAHGQQSVIVDGPVEQLAPDSGQANLTS

SEQ ID NO: 5068 - protein, 541 aa, Homo Sapiens
MPGLRRDRLLTLLLLGALLSADLYFHLWPQVQRQLRPRERPRGCPCTGRASSLARDSAAAASDPGTIVHNFSRTEPRTEPAGGSHSGSSSKLQALFAHPLYNVPEEPPLLGAEDSLLASQEALRYYRRKVARWNRRHKMYREQMNLTSLDPPLQLRLEASWVQFHLGINRHGLYSRSSPVVSKLLQDMRHFPTISADYSQDEKALLGACDCTQIVKPSGVHLKLVLRFSDFGKAMFKPMRQQRDEETPVDFFYFIDFQRHNAEIAAFHLDRILDFRRVPPTVGRIVNVTKEILEVTKNEILQSVFFVSPASNVCFFAKCPYMCKTEYAVCGNPHLLEGSLSAFLPSLNLAPRLSVPNPWIRSYTLAGKEEWEVNPLYCDTVKQIYPYNNSQRLLNVIDMAIFDFLIGNMDRHHYEMFTKFGDDGFLIHLDNARGFGRHSHDEISILSPLSQCCMIKKKTLLHLQLLAQADYRLSDVMRESLLEDQLSPVLTEPHLLALDRRLQTILRTVEGCIVAHGQQSVIVDGPVEQLAPDSGQANLTS

SEQ ID NO: 5069 - protein, 21 aa, Homo Sapiens
QRHNAEIAAFHLDREYGPAPL

SEQ ID NO: 5070 - protein, 127 aa, Homo Sapiens
  misc_feature (1)..(1): Xaa can be any naturally occurring amino acid
XFHLWPQVQRQLRPRERPRGCPCTGRASSLARDSAAAASDPGTIVHNFSRTEPRTEPAGGSHSGSSSKLQALFAHPLYNVPEEPPLLGAEDSLLASQEALRYYRRKVARWNRPQFLLLKGRGGVCDP

SEQ ID NO: 5071 - protein, 584 aa, Homo Sapiens
MKMMLVRRFRVLILMVFLVACALHIALDLLPRLERRGARPSGEPGCSCAQPAAEVAAPGWAQVRGRPGEPPAASSAAGDAGWPNKHTLRILQDFSSDPSSNLSSHSLEKLPPAAEPAERALRGRDPGALRPHDPAHRPLLRDPGPRRSESPPGPGGDASLLARLFEHPLYRVAVPPLTEEDVLFNVNSDTRLSPKAAENPDWPHAGAEGAEFLSPGEAAVDSYPNWLKFHIGINRYELYSRHNPAIEALLHDLSSQRITSVAMKSGGTQLKLIMTFQNYGQALFKPMKQTREQETPPDFFYFSDYERHNAEIAAFHLDRILDFRRVPPVAGRMVNMTKEIRDVTRDKKLWRTFFISPANNICFYGECSYYCSTEHALCGKPDQIEGSLAAFLPDLSLAKRKTWRNPWRRSYHKRKKAEWEVDPDYCEEVKQTPPYDSSHRILDVMDMTIFDFLMGNMDRHHYETFEKFGNETFIIHLDNGRGFGKYSHDELSILVPLQQCCRIRKSTYLRLQLLAKEEYKLSLLMAESLRGDQVAPVLYQPHLEALDRRLRVVLKAVRDCVERNGLHSVVDDDLDTEHRAASAR

SEQ ID NO: 5072 - protein, 218 aa, Homo Sapiens
MGMWSIGAGALGAAALALLLANTDVFLSKPQKAALEYLEDIDLKTLEKEPRTFKAKELWEKNGAVIMAVRRPGCFLCREEAADLSSLKSMLDQLGVPLYAVVKEHIRTEVKDFQPYFKGEIFLDEKKKFYGPQRRKMMFMGFIRLGVWYNFFRAWNGGFSGNLEGEGFILGGVFVVGSGKQGILLEHREKEFGDKVNLLSVLEAAKMIKPQTLASEKK

SEQ ID NO: 5073 - protein, 229 aa, Homo Sapiens
MSFLQDPSFFTMGMWSIGAGALGAAALALLLANTDVFLSKPQKAALEYLEDIDLKTLEKEPRTFKAKELWEKNGAVIMAVRRPGCFLCREEAADLSSLKSMLDQLGVPLYAVVKEHIRTEVKDFQPYFKGEIFLDEKKKFYGPQRRKMMFMGFIRLGVWYNFFRAWNGGFSGNLEGEGFILGGVFVVGSGKQGILLEHREKEFGDKVNLLSVLEAAKMIKPQTLASEKK

SEQ ID NO: 5074 - protein, 229 aa, Homo Sapiens; identical to SEQ ID NO: 5073

SEQ ID NO: 5075 - protein, 229 aa, Homo Sapiens; identical to SEQ ID NO: 5073

SEQ ID NO: 5076 - protein, 229 aa, Homo Sapiens; identical to SEQ ID NO: 5073

SEQ ID NO: 5077 - protein, 229 aa, Homo Sapiens; identical to SEQ ID NO: 5073

SEQ ID NO: 5078 - protein, 425 aa, Homo Sapiens
MMPSESGAERRDRAAAQVGTAAATAVATAAPAGGGPDPEALSAFPGRHLSGLSWPQVKRLDALLSEPIPIHGRGNFPTLSVQPRQIVQVVRSTLEEQGLHVHSVRLHGSAASHVLHPESGLGYKDLDLVFRVDLRSEASFQLTKAVVLACLLDFLPAGVSRAKITPLTLKEAYVQKLVKVCTDSDRWSLISLSNKSGKNVELKFVDSVRRQFEFSIDSFQIILDSLLLFGQCSSTPMSEAFHPTVTGESLYGDFTEALEHLRHRVIATRSPEEIRGGGLLKYCHLLVRGFRPRPSTDVRALQRYMCSRFFIDFPDLVEQRRTLERYLEAHFGGADAARRYACLVTLHRVVNESTVCLMNHERRQTLDLIAALALQALAEQGPAATAALAWRPPGTDGVVPATVNYYVTPVQPLLAHAYPTWLPCN

SEQ ID NO: 5079 - protein, 113 aa, Homo Sapiens
MISTRYRRRRDAPRGPGRCPPHPTRPRGPGRKRGAAGSPGAAPSASRRPEFPKPLRVLPWRERGRGGREWPMSLRSPLPTSACGWGESGRRAGPGSLRSSDRTERARCSLRPR

SEQ ID NO: 5080 - protein, 225 aa, Homo Sapiens
MLLTLAGGALFFPGLFALCTWALRRSQPGWSRTDCVMISTRLVSSVHAVLATGSGIVIIRSCDDVITGRHWLAREYVWFLIPYMIYDSYAMYLCEWCRTRDQNRAPSLTLRNFLSRNRLMITHHAVILFVLVPVAQLKQQHTLLYKVNGILTLATFLSCRILLFPFMYWSYGRQQGLSLLQVPFSIPFYCNVANAFLVAPQIYWFCLLCRKAVRLFDTPQAKKDG

SEQ ID NO: 5081 - protein, 257 aa, Homo Sapiens
MLLTLAGGALFFPGLFALCTWALRRSQPGWSRTDCVMISTRLVSSVHAVLATGSGIVIIRSCDDVITGRHWLAREYVWFLIPYMIYDSYAMYLCEWCRTRDQNRAPSLTLRNFLSRNRLMITHHAVILFVLVPVAQRLRGDLGDFFVGCIFTAELSTPFVSLGRVLIQLKQQHTLLYKVNGILTLATFLSCRILLFPFMYWSYGRQQGLSLLQVPFSIPFYCNVANAFLVAPQIYWFCLLCRKAVRLFDTPQAKKDG

SEQ ID NO: 5082 - protein, 69 aa, Homo Sapiens
MLLTLAGGALFFPGLFALCTWALRRSQPGWSRTDCVMISTRLVSSVHAVLATGSGIVIIRSCDDVITGS

SEQ ID NO: 5083 - protein, 149 aa, Homo Sapiens
MLLTLAGGALFFPGLFALCTWALRRSQPGWSRTDCVMISTRYRRRRDAPRGPGRCPPHPTRPRGPGRKRGAAGSPGAAPSASRRPEFPKPLRVLPWRERGRGGREWPMSLRSPLPTSACGWGESGRRAGPGSLRSSDRTERARCSLRPR

SEQ ID NO: 5084 - protein, 38 aa, Homo Sapiens
  misc_feature (1)..(1): Xaa can be any naturally occurring amino acid
XATGSGIVIIRSCDDVITGRGSGETLGTSLSAASSRQN

SEQ ID NO: 5085 - protein, 252 aa, Homo Sapiens
GQGIAAALIHLPSTGNKHWRPRSPEASTDCCWLHQATGSGSVTQAGVQWYDLGSLQPLPPRFKRFSCLSLPSSWDYRSSWELPDLQEGKIQAISDSDGVNYPWYGNTTETCTIVGPTKRDSKFIISMNDNFYPSVTWAVPVSESNVAKLTNIYRDQSFTTWLVATNTSTNDMIILQTLHWRMQLSIEVNPNRPLGQRARLREPIAQDQPKILSKNEPIPPSALVKPNANDAQVLMWRPKYGQPLVVIPPKHR

SEQ ID NO: 5086 - protein, 283 aa, Homo Sapiens
MPGFFCDCWPSLEIRALLYAMGCIQSIGGKARVFREGITVIDVKASIDPVPTSIDESSSVVLRYRTPHFRASAQVVMPPIPKKETWVVGWIQACSHMEFYNQYGEQGMSSWELPDLQEGKIQAISDSDGVNYPWYGNTTETCTIVGPTKRDSKFIISMNDNFYPSVTWAVPVSESNVAKLTNIYRDQSFTTWLVATNTSTNDMIILQTLHWRMQLSIEVNPNRPLGQRARLREPIAQDQPKILSKNEPIPPSALVKPNANDAQVLMWRPKYGQPLVVIPPKHR

SEQ ID NO: 5087 - protein, 280 aa, Homo Sapiens
MTSYILISFVLLIGVGCIEKDQSCPVFGGRKRLHLLFVGGQLRQVRMLRGSPEASTDCCWLHQATGSGSVTQAGVQWYDLGSLQPLPPRFKRFSCLSLPSSWDYRSSWELPDLQEGKIQAISDSDGVNYPWYGNTTETCTIVGPTKRDSKFIISMNDNFYPSVTWAVPVSESNVAKLTNIYRDQSFTTWLVATNTSTNDMIILQTLHWRMQLSIEVNPNRPLGQRARLREPIAQDQPKILSKNEPIPPSALVKPNANDAQVLMWRPKYGQPLVVIPPKHR

SEQ ID NO: 5088 - protein, 160 aa, Homo Sapiens
MQRVSGLLSWTLSRVLWLSGLSEPGAARQPRIMEEKALEVYDLIRTIRDPEKPNTLEELEVVSESCVEVQEINEEEYLVIIRFTPTVPHCSLATLIGLCLRVKLQRCLPFKHKLEIYISEGTHSTEEDINKQINDKERVAAAMENPNLREIVEQCVLEPD

SEQ ID NO: 5089 - protein, 130 aa, Homo Sapiens
MQRVSGLLSWTLSRVLWLSGLSEPGAARQPRIMEEKALEVYDLIRTIRDPEKPNTLEELEVVSESCVEVQEINEEEYLVIIRFTPTVPHCSLATLIGLCLRVKLQRCLPFKHKLEIYISEGTHSTEEDSK

SEQ ID NO: 5090 - protein, 102 aa, Homo Sapiens
MQRVSGLLSWTLSRVLWLSGLSEPGAARQPRIMEEKALEVYDLIRTIRDPEKPNTLEELEVVSESCVEVQEINEEEYLVIIRFTPTVPHCSLATLIVGNLHF

SEQ ID NO: 5091 - protein, 102 aa, Homo Sapiens; identical to SEQ ID NO: 5090

SEQ ID NO: 5092 - protein, 69 aa, Homo Sapiens
MQRVSGLLSWTLSRVLWLSGLSEPGAARQPRIMEEKALEVYGWNAMAGSRLTATSAFWFQVILLPQSPK

SEQ ID NO: 5093 - protein, 186 aa, Homo Sapiens
MAAWGKKHAGKDPVRDECEERNRFTETREEDVTDEHGEREPFAETDEHTGANTKKPEDTAEDLTAKRKRMKMDKTCSKTKNKSKHALRKKQLKRQKRDYIHSLKLLNVLEEYITDEQKEEEEEEGEEEELIRIFQEQQKKWQQYRSVRRERLKEMKLLRDQFVKALEDFEDLCDRVFSDEDSELDN

SEQ ID NO: 5094 - protein, 186 aa, Homo Sapiens; identical to SEQ ID NO: 5093

SEQ ID NO: 5095 - protein, 90 aa, Homo Sapiens
MKAKKAHPRVEYNKTSGNAFEEQFSLPTKVRGSPLASQDNQPRILWAGGLPRPSWRLNLWRPGGRSMQERIQSVMNVRKETVLQKQGRKM

SEQ ID NO: 5096 - protein, 226 aa, Homo Sapiens
MPGFLSFLSVSLRSPGSGIASSFPGQPATDPVGRRAAKAQLEAQFMAAWGKKHAGKDPVRDECEERNRFTETREEDVTDEHGEREPFAETDEHTGANTKKPEDTAVGANNFKNYPVHIGVSSEQHILLDCSLSRQKRDYIHSLKLLNVLEEYITDEQKEEEEEEGEEEELIRIFQEQQKKWQQYRSVRRERLKEMKLLRDQFVKALEDFEDLCDRVFSDEDSELDN

SEQ ID NO: 5097 - protein, 25 aa, Homo Sapiens
KERCQYYTASFSDYAKYYALVCYGE

SEQ ID NO: 5098 - protein, 155 aa, Homo Sapiens
MCIVLRPSRVHNSEENTMRALTLKDILNGTFSYKTFFPNWISGQEYLHQSADNNIVLYNIETGQSYTILSNRTMKSVNASNYGLSPDRQFVYLESDYSKLWRYSYTATYYIYDLSNGEFVRGNELPRPIQYLCWSPVGSKLAYVYQNNIYLKQRP

SEQ ID NO: 5099 - protein, 121 aa, Homo Sapiens
MCIVLRPSRVHNSEENTMRALTLKDILNGTFSYKTFFPNWISGQEYLHQSADNNIVLYNIETGQSYTILSNRTMKSVNASNYGLSPDRQFVYLESDYSKLWRYSYTATYYIYDLSNGKWQL

SEQ ID NO: 5100 - protein, 760 aa, Homo Sapiens
MKTWVKIVFGVATSAVLALLVMCIVLRPSRVHNSEENTMRALTLKDILNGTFSYKTFFPNWISGQEYLHQSADNNIVLYNIETGQSYTILSNRTMKSVNASNYGLSPDRQFVYLESDYSKLWRYSYTATYYIYDLSNGEFVRGNELPRPIQYLCWSPVGSKLAYVYQNNIYLKQRPGDPPFQITFNGRENKIFNGIPDWVYEEEMLATKYALWWSPNGKFLAYAEFNDTDIPVIAYSYYGDEQYPRTINIPYPKAGAKNPVVRIFIIDTTYPAYVGPQEVPVPAMIASSDYYFSWLTWVTDERVCLQWLKRVQNVSVLSICDFREDWQTWDCPKTQEHIEESRTGWAGGFFVSTPVFSYDAISYYKIFSDKDGYKHIHYIKDTVENAIQITSGKWEAINIFRVTQDSLFYSSNEFEEYPGRRNIYRISIGSYPPSKKCVTCHLRKERCQYYTASFSDYAKYYALVCYGPGIPISTLHDGRTDQEIKILEENKELENALKNIQLPKEEIKKLEVDEITLWYKMILPPQFDRSKKYPLLIQVYGGPCSQSVRSVFAVNWISYLASKEGMVIALVDGRGTAFQGDKLLYAVYRKLGVYEVEDQITAVRKFIEMGFIDEKRIAIWGWSYGGYVSSLALASGTGLFKCGIAVAPVSSWEYYASVYTERFMGLPTKDDNLEHYKNSTVMARAEYFRNVDYLLIHGTADDNVHFQNSAQIAKALVNAQVDFQAMWYSDQNHGLSGLSTNHLYTHMTHFLKQCFSLSD

SEQ ID NO: 5101 - protein, 735 aa, Homo Sapiens
MKTWVKIVFGVATSAVLALLVMCIVLRPSRVHNSEENTMRALTLKDILNGTFSYKTFFPNWISGQEYLHQSADNNIVLYNIETGQSYTILSNRTMLWRYSYTATYYIYDLSNGEFVRGNELPRPIQYLCWSPVGSKLAYVYQNNIYLKQRPGDPPFQITFNGRENKIFNGIPDWVYEEEMLATKYALWWSPNGKFLAYAEFNDTDIPVIAYSYYGDEQYPRTINIPYPKAGAKNPVVRIFIIDTTYPAYVGPQEVPVPAMIASSDYYFSWLTWVTDERVCLQWLKRVQNVSVLSICDFREDWQTWDCPKTQEHIEESRTGWAGGFFVSTPVFSYDAISYYKIFSDKDGYKHIHYIKDTVENAIQITSGKWEAINIFRVTQDSLFYSSNEFEEYPGRRNIYRISIGSYPPSKKCVTCHLRKERCQYYTASFSDYAKYYALVCYGPGIPISTLHDGRTDQEIKILEENKELENALKNIQLPKEEIKKLEVDEITLWYKMILPPQFDRSKKYPLLIQVYGGPCSQSVRSVFAVNWISYLASKEGMVIALVDGRGTAFQGDKLLYAVYRKLGVYEVEDQITAVRKFIEMGFIDEKRIAIWGWSYGGYVSSLALASGTGLFKCGIAVAPVSSWEYYASVYTERFMGLPTKDDNLEHYKNSTVMARAEYFRNVDYLLIHGTADDNVHFQNSAQIAKALVNAQVDFQAMWYSDQNHGLSGLSTNHLYTHMTHFLKQCFSLSD

SEQ ID NO: 5102 - protein, 759 aa, Homo Sapiens
MTWVKIVFGVATSAVLALLVMCIVLRPSRVHNSEENTMRALTLKDILNGTFSYKTFFPNWISGQEYLHQSADNNIVLYNIETGQSYTILSNRTMKSVNASNYGLSPDRQFVYLESDYSKLWRYSYTATYYIYDLSNGEFVRGNELPRPIQYLCWSPVGSKLAYVYQNNIYLKQRPGDPPFQITFNGRENKIFNGIPDWVYEEEMLATKYALWWSPNGKFLAYAEFNDTDIPVIAYSYYGDEQYPRTINIPYPKAGAKNPVVRIFIIDTTYPAYVGPQEVPVPAMIASSDYYFSWLTWVTDERVCLQWLKRVQNVSVLSICDFREDWQTWDCPKTQEHIEESRTGWAGGFFVSTPVFSYDAISYYKIFSDKDGYKHIHYIKDTVENAIQITSGKWEAINIFRVTQDSLFYSSNEFEEYPGRRNIYRISIGSYPPSKKCVTCHLRKERCQYYTASFSDYAKYYALVCYGPGIPISTLHDGRTDQEIKILEENKELENALKNIQLPKEEIKKLEVDEITLWYKMILPPQFDRSKKYPLLIQVYGGPCSQSVRSVFAVNWISYLASKEGMVIALVDGRGTAFQGDKLLYAVYRKLGVYEVEDQITAVRKFIEMGFIDEKRIAIWGWSYGGYVSSLALASGTGLFKCGIAVAPVSSWEYYASVYTERFMGLPTKDDNLEHYKNSTVMARAEYFRNVDYLLIHGTADDNVHFQNSAQIAKALVNAQVDFQAMWYSDQNHGLSGLSTNHLYTHMTHFLKQCFSLSD

SEQ ID NO: 5103 - protein, 47 aa, Homo Sapiens
  misc_feature (1)..(1): Xaa can be any naturally occurring amino acid
XYTERFMGLPTKDDNLEHYKNSTVMARAEYFRNVDYLLIHGTADGEV

SEQ ID NO: 5104 - protein, 86 aa, Homo Sapiens
MLGIWTLLPLVLTSVARLSSKSVNAQVTDINSKGLELRKTVTTVETQNLEGLHHDGQFCHKPCPPDVNMESSRNAHSPATPSAKRK

SEQ ID NO: 5105 - protein, 103 aa, Homo Sapiens
MLGIWTLLPLVLTSVARLSSKSVNAQVTDINSKGLELRKTVTTVETQNLEGLHHDGQFCHKPCPPDVNMESSRNAHSPATPSAKRKDPDLTWGGFVFFFCQFH

SEQ ID NO: 5106 - protein, 132 aa, Homo Sapiens
MLGIWTLLPLVLTSVARLSSKSVNAQVTDINSKGLELRKTVTTVETQNLEGLHHDGQFCHKPCPPGERKARDCTVNGDEPDCVPCQEGKEYTDKAHFSSKCRRCRLCDEGHDVNMESSRNAHSPATPSAKRK

SEQ ID NO: 5107 - protein, 149 aa, Homo Sapiens
MLGIWTLLPLVLTSVARLSSKSVNAQVTDINSKGLELRKTVTTVETQNLEGLHHDGQFCHKPCPPGERKARDCTVNGDEPDCVPCQEGKEYTDKAHFSSKCRRCRLCDEGHDVNMESSRNAHSPATPSAKRKDPDLTWGGFVFFFCQFH

SEQ ID NO: 5108 - protein, 149 aa, Homo Sapiens; identical to SEQ ID NO: 5107

SEQ ID NO: 5109 - protein, 335 aa, Homo Sapiens
MLGIWTLLPLVLTSVARLSSKSVNAQVTDINSKGLELRKTVTTVETQNLEGLHHDGQFCHKPCPPGERKARDCTVNGDEPDCVPCQEGKEYTDKAHFSSKCRRCRLCDEGHGLEVEINCTRTQNTKCRCKPNFFCNSTVCEHCDPCTKCEHGIIKECTLTSNTKCKEEGSRSNLGWLCLLLLPIPLIVWVKRKEVQKTCRKHRKENQGSHESPTLNPETVAINLSDVDLSKYITTIAGVMTLSQVKGFVRKNGVNEAKIDEIKNDNVQDTAEQKVQLLRNWHQLHGKKEAYDTLIKDLKKANLCTLAEKIQTIILKDITSDSENSNFRNEIQSLV

SEQ ID NO: 5110 - protein, 233 aa, Homo Sapiens [sequence omitted]

SEQ ID NO: 5111 - protein, 244 aa, Homo Sapiens
MLGIWTLLPLVLTSVARLSSKSVNAQVTDINSKGLELRKTVTTVETQNLEGLHHDGQFCHKPCPPGERKARDCTVNGDEPDCVPCQEGKEYTDKAHFSSKCRRCRLCDEGHGLEVEINCTRTQNTKCRCKPNFFCNSTVCEHCDPCTKCEHGIIKECTLTSNTKCKEEGSRSNLGWLCLLLLPIPLIVWVKRKEVQKTCRKHRKENQGSHESPTLNPMESCSIAQAGVQGCNHGSLQPQSPGLK

SEQ ID NO: 5112 - protein, 220 aa, Homo Sapiens
MLGIWTLLPLVLTSVARLSSKSVNAQVTDINSKGLELRKTVTTVETQNLEGLHHDGQFCHKPCPPGERKARDCTVNGDEPDCVPCQEGKEYTDKAHFSSKCRRCRLCDEGHGLEVEINCTRTQNTKCRCKPNFFCNSTVCEHCDPCTKCEHGIIKECTLTSNTKCKEEGSRSNLGWLCLLLLPIPLIVWVKRKEVQKTCRKHRKENQGSHESPTLNPMLT

SEQ ID NO: 5113 - protein, 314 aa, Homo Sapiens
MLGIWTLLPLVLTSVARLSSKSVNAQVTDINSKGLELRKTVTTVETQNLEGLHHDGQFCHKPCPPGERKARDCTVNGDEPDCVPCQEGKEYTDKAHFSSKCRRCRLCDEGHGLEVEINCTRTQNTKCRCKPNFFCNSTVCEHCDPCTKCEHGIIKECTLTSNTKCKEEVKRKEVQKTCRKHRKENQGSHESPTLNPETVAINLSDVDLSKYITTIAGVMTLSQVKGFVRKNGVNEAKIDEIKNDNVQDTAEQKVQLLRNWHQLHGKKEAYDTLIKDLKKANLCTLAEKIQTIILKDITSDSENSNFRNEIQSLV

SEQ ID NO: 5114 - protein, 119 aa, Homo Sapiens
LSKKPLEEKPSQPYSARESLSEVQSLSSFQSESCDDNASIVTVMHLVNAVVDTVSTEESLAAPDLSKPRGYHWDTSDWMPSVPLPDIQEFPNYEVIDEQTPLYSADPNAIDTDYYPGGY

SEQ ID NO: 5115 - protein, 4588 aa, Homo Sapiens
MGRHLALLLLLLLLFQHFGDSDGSQRLEQTPLQFTHLEYNVTVQENSAAKTYVGHPVKMGVYITHPAWEVRYKIVSGDSENLFKAEEYILGDFCFLRIRTKGGNTAILNREVKDHYTLIVKALEKNTNVEARTKVRVQVLDTNDLRPLFSPTSYSVSLPENTAIRTSIARVSATDADIGTNGEFYYSFKDRTDMFAIHPTSGVIVLTGRLDYLETKLYEMEILAADRGMKLYGSSGISSMAKLTVHIEQANECAPVITAVTLSPSELDRDPAYAIVTVDDCDQGANGDIASLSIVAGDLLQQFRTVRSFPGSKEYKVKAIGGIDWDSHPFGYNLTLQAKDKGTPPQFSSVKVIHVTSPQFKAGPVKFEKDVYRAEISEFAPPNTPVVMVKAIPAYSHLRYVFKSTPGKAKFSLNYNTGLISILEPVKRQQAAHFELEVTTSDRKASTKVLVKVLGANSNPPEFTQTAYKAAFDENVPIGTTVMSLSAVDPDEGENGYVTYSIANLNHVPFAIDHFTGAVSTSENLDYELMPRVYTLRIRASDWGLPYRREVEVLATITLNNLNDNTPLFEKINCEGTIPRDLGVGEQITTVSAIDADELQLVQYQIEAGNELDFFSLNPNSGVLSLKRSLMDGLGAKVSFHSLRITATDGENFATPLYINITVAASHKLVNLQCEETGVAKMLAEKLLQANKLHNQGEVEDIFFDSHSVNAHIPQFRSTLPTGIQVKENQPVGSSVIFMNSTDLDTGFNGKLVYAVSGGNEDSCFMIDMETGMLKILSPLDRETTDKYTLNITVYDLGIPQKAAWRLLHVVVVDANDNPPEFLQESYFVEVSEDKEVHSEIIQVEATDKDLGPNGHVTYSIVTDTDTFSIDSVTGVVNIARPLDRELQHEHSLKIEARDQAREEPQLFSTVVVKVSLEDVNDNPPTFIPPNYRVKVREDLPEGTVIMWLEAHDPDLGQSGQVRYSLLDHGEGNFDVDKLSGAVRIVQQLDFEKKQVYNLTVRAKDKGKPVSLSSTCYVEVEVVDVNENLHPPVFSSFVEKGTVKEDAPVGSLVMTVSAHDEDARRDGEIRYSIRDGSGVGVFKIGEETGVIETSDRLDRESTSHYWLTVFATDQGVVPLSSFIEIYIEVEDVNDNAPQTSEPVYYPEIMENSPKDVSVVQIEAFDPDSSSNDKLMYKITSGNPQGFFSIHPKTGLITTTSRKLDREQQDEHILEVTVTDNGSPPKSTIARVIVKILDENDNKPQFLQKFYKIRLPEREKPDRERNARREPLYHVIATDKDEGPNAEISYSIEDGNEHGKFFIEPKTGVVSSKRFSAAGEYDILSIKAVDNGRPQKSSTTRLHIEWISKPKPSLEPISFEESFFTFTVMESDPVAHMIGVISVEPPGIPLWFDITGGNYDSHFDVDKGTGTIIVAKPLDAEQKSNYNLTVEATDGTTTILTQVFIKVIDTNDHRPQFSTSKYEVVIPEDTAPETEILQISAVDQDEKNKLIYTLQSSRDPLSLKKFRLDPATGSLYTSEKLDHEAVHQHTLTVMVRDQDVPVKRNFARIVVNVSDTNDHAPWFTASSYKGRVYESAAVGSVVLQVTALDKDKGKNAEVLYSIESGNIGNSFMIDPVLGSIKTAKELDRSNQAEYDLMVKATDKGSPPMSEITSVRIFVTIADNASPKFTSKEYSVELSETVSIGSFVGMVTAHSQSSVVYEIKDGNTGDAFDINPHSGTIITQKALDFETLPIYTLIIQGTNMAGLSTNTTVLVHLQDENDNAPVFMQAEYTGLISESASINSVVLTDRNVPLVIRAADADKDSNALLVYHIVEPSVHTYFAIDSSTGAIHTVLSLDYEETSIFHFTVQVHDMGTPRLFAEYAANVTVHVIDINDCPPVFAKPLYEASLLLPTYKGVKVITVNATDADSSAFSQLIYSITEGNIGEKFSMDYKTGALTVQNTTQLRSRYELTVRASDGRFAGLTSVKINVKESKESHLKFTQDVYSAVVKENSTEAETLAVITAIGNPINEPLFYHILNPDRRFKISRTSGVLSTTGTPFDREQQEAFDVVVEVTEEHKPSAVAHVVVKVIVEDQNDNAPVFVNLPYYAVVKVDTEVGHVIRYVTAVDRDSGRNGEVHYYLKEHHEHFQIGPLGEISLKKQFELDTLNKEYLVTVVAKDGGNPAFSAEVIVPITVMNKAMPVFEKPFYSAEIAESIQVHSPVVHVQANSPEGLKVFYSITDGDPFSQFTINFNTGVINVIAPLDFEAHPAYKLSIRATDSLTGAHAEVFVDIIVDDINDNPPVFAQQSYAVTLSEASVIGTSVVQVRATDSDSEPNRGISYQMFGNHSKSHDHFHVDSSTGLISLLRTLDYEQSRQHTIFVRAVDGGMPTLSSDVIVTVDVTDLNDNPPLFEQQIYEARISEHAPHGHFVTCVKAYDADSSDIDKLQYSILSGNDHKHFVIDSATGIITLSNLHRHALKPFYSLNLSVSDGVFRSSTQVHVTVIGGNLHSPAFLQNEYEVELAENAPLHTLVMEVKTTDGDSGIYGHVTYHIVNDFAKDRFYINERGQIFTLEKLDRETPAEKVISVRLMAKDAGGKVAFCTVNVILTDDNDNAPQFRATKYEVNIGSSAAKGTSVVKVLASDADEGSNADITYAIEADSESVKENLEINKLSGVITTKESLIGLENEFFTFFVRAVDNGSPSKESVVLVYVKILPPEMQLPKFSEPFYTFTVSEDVPIGTEIDLIRAEHSGTVLYSLVKGNTPESNRDESFVIDRQSGRLKLEKSLDHETTKWYQFSILARCTQDDHEMVASVDVSIQVKDANDNSPVFESSPYEAFIVENLPGGSRVIQIRASDADSGTNGQVMYSLDQSQSVEVIESFAINMETGWITTLKELDHEKRDNYQIKVVASDHGEKIQLSSTAIVDVTVTDVNDSPPRFTAEIYKGTVSEDDPQGGVIAILSTTDADSEEINRQVTYFITGGDPLGQFAVETIQNEWKVYVKKPLDREKRDNYLLTITATDGTFSSKAIVEVKVLDANDNSPVCEKTLYSDTIPEDVLPGKLIMQISATDADIRSNAEITYTLLGSGAEKFKLNPDTGELKTSTPLDREEQAVYHLLVRATDGGGRFCQASIVLTLEDVNDNAPEFSADPYAITVFENTEPGTLLTRVQATDADAGLNRKILYSLIDSADGQFSINELSGIIQLEKPLDRELQAVYTLSLKAVDQGLPRRLTATGTVIVSVLDINDNPPVFEYREYGATVSEDILVGTEVLQVYAASRDIEANAEITYSIISGNEHGKFSIDSKTGAVFIIENLDYESSHEYYLTVEATDGGTPSLSDVATVNVNVTDINDNTPVFSQDTYTTVISEDAVLEQSVITVMADDADGPSNSHIHYSIIDGNQGSSFTIDPVRGEVKVTKLLDRETISGYTLTVQASDNGSPPRVNTTTVNIDVSDVNDNAPVFSRGNYSVIIQENKPVGFSVLQLVVTDEDSSHNGPPFFFTIVTGNDEKAFEVNPQGVLLTSSAIKRKEKDHYLLQVKVADNGKPQLSSLTYIDIRVIEESIYPPAILPLEIFITSSGEEYSGGVIGKIHATDQDVYDTLTYSLDPQMDNLFSVSSTGGKLIAHKKLDIGQYLLNVSVTDGKFTTVADITVHIRQVTQEMLNHTIAIRFANLTPEEFVGDYWRNFQRALRNILGVRRNDIQIVSLQSSEPHPHLDVLLFVEKPGSAQISTKQLLHKINSSVTDIEEIIGVRILNVFQKLCAGLDCPWKFCDEKVSVDESVMSTHSTARLSFVTPRHHRAAVCLCKEGRCPPVHHGCEDDPCPEGSECVSDPWEEKHTCVCPSGRFGQCPGSSSMTLTGNSYVKYRLTENENKLEMKLTMRLRTYSTHAVVMYARGTDYSILEIHHGRLQYKFDCGSGPGIVSVQSIQVNDGQWHAVALEVNGNYARLVLDQVHTASGTAPGTLKTLNLDNYVFFGGHIRQQGTRHGRSPQVGNGFRGCMDSIYLNGQELPLNSKPRSYAHIEESVDVSPGCFLTATEDCASNPCQNGGVCNPSPAGGYYCKCSALYIGTHCEISVNPCSSKPCLYGGTCVVDNGGFVCQCRGLYTGQRCQLSPYCKDEPCKNGGTCFDSLDGAVCQCDSGFRGERCQSDIDECSGNPCLHGALCENTHGSYHCNCSHEYRGRHCEDAAPNQYVSTPWNIGLAEGIGIVVFVAGIFLLVVVFVLCRKMISRKKKHQAEPKDKHLGPATAFLQRPYFDSKLNKNIYSDIPPQVPVRPISYTPSIPSDSRNNLDRNSFEGSAIPEHPEFSTFNPESVHGHRKAVAVCSVAPNLPPPPPSNSPSDSDSIQKPSWDFDYDTKVVDLDPCLSKKPLEEKPSQPYSARESLSEVQSLSSFQSESCDDNGYHWDTSDWMPSVPLPDIQEFPNYEVIDEQTPLYSADPNAIDTDYYPGGYDIESDFPPPPEDFPAADELPPLPPEFSNQFESIHPPRDMPAAGSLGSSSRNRQRFNLNQYLPNFYPLDMSEPQTKGTGENSTCREPHAPYPPGYQRHFEAPAVESMPMSVYASTASCSDVSACCEVESEVMMSDYESGDDGHFEEVTIPPLDSQQHTEV

SEQ ID NO: 5116 - protein, 488 aa, Homo Sapiens
MGRHLALLLLLLLLFQHFGDSDGSQRLEQTPLQFTHLEYNVTVQENSAAKTYVGHPVKMGVYITHPAWEVRYKIVSGDSENLFKAEEYILGDFCFLRIRTKGGNTAILNREVKDHYTLIVKALEKNTNVEARTKVRVQVLDTNDLRPLFSPTSYSVSLPENTAIRTSIARVSATDADIGTNGEFYYSFKDRTDMFAIHPTSGVIVLTGRLDYLETKLYEMEILAADRGMKLYGSSGISSMAKLTVHIEQANECAPVITAVTLSPSELDRDPAYAIVTVDDCDQGANGDIASLSIVAGDLLQQFRTVRSFPGSKEYKVKAIGGIDWDSHPFGYNLTLQAKDKGTPPQFSSVKVIHVTSPQFKAGPVKFEKDVYRAEISEFAPPNTPVVMVKAIPAYSHLRYVFKSTPGKAKFSLNYNTGLISILEPVKRQQAAHFELEVTTSDRKASTKVLVKVLGANSNPPEFTQTAYKAAFDENVPIGTTVMSLSAV

SEQ ID NO: 5117 - protein, 4590 aa, Homo Sapiens
MGRHLALLLLLLLLFQHFGDSDGSQRLEQTPLQFTHLEYNVTVQENSAAKTYVGHPVKMGVYITHPAWEVRYKIVSGDSENLFKAEEYILGDFCFLRIRTKGGNTAILNREVKDHYTLIVKALEKNTNVEARTKVRVQVLDTNDLRPLFSPTSYSVSLPENTAIRTSIARVSATDADIGTNGEFYYSFKDRTDMFAIHPTSGVIVLTGRLDYLETKLYEMEILAADRGMKLYGSSGISSMAKLTVHIEQANECAPVITAVTLSPSELDRDPAYAIVTVDDCDQGANGDIASLSIVAGDLLQQFRTVRSFPGSKEYKVKAIGGIDWDSHPFGYNLTLQAKDKGTPPQFSSVKVIHVTSPQFKAGPVKFEKDVYRAEISEFAPPNTPVVMVKAIPAYSHLRYVFKSTPGKAKFSLNYNTGLISILEPVKRQQAAHFELEVTTSDRKASTKVLVKVLGANSNPPEFTQTAYKAAFDENVPIGTTVMSLSAVDPDEGENGYVTYSIANLNHVPFAIDHFTGAVSTSENLDYELMPRVYTLRIRASDWGLPYRREVEVLATITLNNLNDNTPLFEKINCEGTIPRDLGVGEQITTVSAIDADELQLVQYQIEAGNELDFFSLNPNSGVLSLKRSLMDGLGAKVSFHSLRITATDGENFATPLYINITVAASHKLVNLQCEETGVAKMLAEKLLQANKLHNQGEVEDIFFDSHSVNAHIPQFRSTLPTGIQVKENQPVGSSVIFMNSTDLDTGFNGKLVYAVSGGNEDSCFMIDMETGMLKILSPLDRETTDKYTLNITVYDLGIPQKAAWRLLHVVVVDANDNPPEFLQESYFVEVSEDKEVHSEIIQVEATDKDLGPNGHVTYSIVTDTDTFSIDSVTGVVNIARPLDRELQHEHSLKIEARDQAREEPQLFSTVVVKVSLEDVNDNPPTFIPPNYRVKVREDLPEGTVIMWLEAHDPDLGQSGQVRYSLLDHGEGNFDVDKLSGAVRIVQQLDFEKKQVYNLTVRAKDKGKPVSLSSTCYVEVEVVDVNENLHPPVFSSFVEKGTVKEDAPVGSLVMTVSAHDEDARRDGEIRYSIRDGSGVGVFKIGEETGVIETSDRLDRESTSHYWLTVFATDQGVVPLSSFIEIYIEVEDVNDNAPQTSEPVYYPEIMENSPKDVSVVQIEAFDPDSSSNDKLMYKITSGNPQGFFSIHPKTGLITTTSRKLDREQQDEHILEVTVTDNGSPPKSTIARVIVKILDENDNKPQFLQKFYKIRLPEREKPDRERNARREPLYHVIATDKDEGPNAEISYSIEDGNEHGKFFIEPKTGVVSSKRFSAAGEYDILSIKAVDNGRPQKSSTTRLHIEWISKPKPSLEPISFEESFFTFTVMESDPVAHMIGVISVEPPGIPLWFDITGGNYDSHFDVDKGTGTIIVAKPLDAEQKSNYNLTVEATDGTTTILTQVFIKVIDTNDHRPQFSTSKYEVVIPEDTAPETEILQISAVDQDEKNKLIYTLQSSRDPLSLKKFRLDPATGSLYTSEKLDHEAVPAHLTVMVRDQDVPVKRNFARIVVNVSDTNDHAPWFTASSYKGRVYESAAVGSVVLQVTALDKDKGKNAEVLYSIESGTFGNIGNSFMIDPVLGSIKTAKELDRSNQAEYDLMVKATDKGSPPMSEITSVRIFVTIADNASPKFTSKEYSVELSETVSIGSFVGMVTAHSQSSVVYEIKDGNTGDAFDINPHSGTIITQKALDFETLPIYTLIIQGTNMAGLSTNTTVLVHLQDENDNAPVFMQAEYTGLISESASINSVVLTDRNVPLVIRAADADKDSNALLVYHIVEPSVHTYFAIDSSTGAIHTVLSLDYEETSIFHFTVQVHDMGTPRLFAEYAANVTVHVIDINDCPPVFAKPLYEASLLLPTYKGVKVITVNATDADSSAFSQLIYSITEGNIGEKFSMDYKTGALTVQNTTQLRSRYELTVRASDGRFAGLTSVKINVKESKESHLKFTQDVYSAVVKENSTEAETLAVITAIGNPINEPLFYHILNPDRRFKISRTSGVLSTTGTPFDREQQEAFDVVVEVTEEHKPSAVAHVVVKVIVEDQNDNAPVFVNLPYYAVVKVDTEVGHVIRYVTAVDRDSGRNGEVHYYLKEHHEHFQIGPLGEISLKKQFELDTLNKEYLVTVVAKDGGNPAFSAEVIVPITVMNKAMPVFEKPFYSAEIAESIQVHSPVVHVQANSPEGLKVFYSITDGDPFSQFTINFNTGVINVIAPLDFEAHPAYKLSIRATDSLTGAHAEVFVDIIVDDINDNPPVFAQQSYAVTLSEASVIGTSVVQVRATDSDSEPNRGISYQMFGNHSKSHDHFHVDSSTGLISLLRTLDYEQSRQHTIFVRAVDGGMPTLSSDVIVTVDVTDLNDNPPLFEQQIYEARISEHAPHGHFVTCVKAYDADSSDIDKLQYSILSGNDHKHFVIDSATGIITLSNLHRHALKPFYSLNLSVSDGVFRSSTQVHVTVIGGNLHSPAFLQNEYEVELAENAPLHTLVMEVKTTDGDSGIYGHVTYHIVNDFAKDRFYINERGQIFTLEKLDRETPAEKVISVRLMAKDAGGKVAFCTVNVILTDDNDNAPQFRATKYEVNIGSSAAKGTSVVKVLASDADEGSNADITYAIEADSESVKENLEINKLSGVITTKESLIGLENEFFTFFVRAVDNGSPSKESVVLVYVKILPPEMQLPKFSEPFYTFTVSEDVPIGTEIDLIRAEHSGTVLYSLVKGNTPESNRDESFVIDRQSGRLKLEKSLDHETTKWYQFSILARCTQDDHEMVASVDVSIQVKDANDNSPVFESSPYEAFIVENLPGGSRVIQIRASDADSGTNGQVMYSLDQSQSVEVIESFAINMETGWITTLKELDHEKRDNYQIKVVASDHGEKIQLSSTAIVDVTVTDVNDSPPRFTAEIYKGTVSEDDPQGGVIAILSTTDADSEEINRQVTYFITGGDPLGQFAVETIQNEWKVYVKKPLDREKRDNYLLTITATDGTFSSKAIVEVKVLDANDNSPVCEKTLYSDTIPEDVLPGKLIMQISATDADIRSNAEITYTLLGSGAEKFKLNPDTGELKTSTPLDREEQAVYHLLVRATDGGGRFCQASIVLTLEDVNDNAPEFSADPYAITVFENTEPGTLLTRVQATDADAGLNRKILYSLIDSADGQFSINELSGIIQLEKPLDRELQAVYTLSLKAVDQGLPRRLTATGTVIVSVLDINDNPPVFEYREYGATVSEDILVGTEVLQVYAASRDIEANAEITYSIISGNEHGKFSIDSKTGAVFIIENLDYESSHEYYLTVEATDGGTPSLSDVATVNVNVTDINDNTPVFSQDTYTTVISEDAVLEQSVITVMADDADGPSNSHIHYSIIDGNQGSSFTIDPVRGEVKVTKLLDRETISGYTLTVQASDNGSPPRVNTTTVNIDVSDVNDNAPVFSRGNYSVIIQENKPVGFSVLQLVVTDEDSSHNGPPFFFTIVTGNDEKAFEVNPQGVLLTSSAIKRKEKDHYLLQVKVADNGKPQLSSLTYIDIRVIEESIYPPAILPLEIFITSSGEEYSGGVIGKIHATDQDVYDTLTYSLDPQMDNLFSVSSTGGKLIAHKKLDIGQYLLNVSVTDGKFTTVADITVHIRQVTQEMLNHTIAIRFANLTPEEFVGDYWRNFQRALRNILGVRRNDIQIVSLQSSEPHPHLDVLLFVEKPGSAQISTKQLLHKINSSVTDIEEIIGVRILNVFQKLCAGLDCPWKFCDEKVSVDESVMSTHSTARLSFVTPRHHRAAVCLCKEGRCPPVHHGCEDDPCPEGSECVSDPWEEKHTCVCPSGRFGQCPGSSSMTLTGNSYVKYRLTENENKLEMKLTMRLRTYSTHAVVMYARGTDYSILEIHHGRLQYKFDCGSGPGIVSVQSIQVNDGQWHAVALEVNGNYARLVLDQVHTASGTAPGTLKTLNLDNYVFFGGHIRQQGTRHGRSPQVGNGFRGCMDSIYLNGQELPLNSKPRSYAHIEESVDVSPGCFLTATEDCASNPCQNGGVCNPSPAGGYYCKCSALYIGTHCEISVNPCSSKPCLYGGTCVVDNGGFVCQCRGLYTGQRCQLSPYCKDEPCKNGGTCFDSLDGAVCQCDSGFRGERCQSDIDECSGNPCLHGALCENTHGSYHCNCSHEYRGRHCEDAAPNQYVSTPWNIGLAEGIGIVVFVAGIFLLVVVFVLCRKMISRKKKHQAEPKDKHLGPATAFLQRPYFDSKLNKNIYSDIPPQVPVRPISYTPSIPSDSRNNLDRNSFEGSAIPEHPEFSTFNPESVHGHRKAVAVCSVAPNLPPPPPSNSPSDSDSIQKPSWDFDYDTKVVDLDPCLSKKPLEEKPSQPYSARESLSEVQSLSSFQSESCDDNGYHWDTSDWMPSVPLPDIQEFPNYEVIDEQTPLYSADPNAIDTDYYPGGYDIESDFPPPPEDFPAADELPPLPPEFSNQFESIHPPRDMPAAGSLGSSSRNRQRFNLNQYLPNFYPLDMSEPQTKGTGENSTCREPHAPYPPGYQRHFEAPAVESMPMSVYASTASCSDVSACCEVESEVMMSDYESGDDGHFEEVTIPPLDSQQHTEV

SEQ ID NO: 5118 - protein, 52 aa, Homo Sapiens
MTMAVIVRNKEKKVIFEFSGQISGSSFRSHFPPLPYSILFVVHTFLSHLELS

SEQ ID NO: 5119 - protein, 368 aa, Homo Sapiens
  misc_feature (1)..(1): Xaa can be any naturally occurring amino acid
XDSKLNKNIYSDIPPQVPVRPISYTPSIPSDSRNNLDRNSFEGSAIPEHPEFSTFNPESVHGHRKAVAVCSVAPNLPPPPPSNSPSDSDSIQKPSWDFDYDTKVVDLDPCLSKKPLEEKPSQPYSARESLSEVQSLSSFQSESCDDNESLAAPDLSKPRGYHWDTSDWMPSVPLPDIQEFPNYEVIDEQTPLYSADPNAIDTDYYPGGYDIESDFPPPPEDFPAADELPPLPPEFSNQFESIHPPRDMPAAGSLGSSSRNRQRFNLNQYLPNFYPLDMSEPQTKGTGENSTCREPHAPYPPGYQRHFEAPAVESMPMSVYASTASCSDVSACCEVESEVMMSDYESGDDGHFEEVTIPPLDSQQHTEV

SEQ ID NO: 5120 - protein, 285 aa, Homo Sapiens
  misc_feature (1)..(1): Xaa can be any naturally occurring amino acid
XSTTEALFASVEDYILVRGVSLVHTAKMNPVRMAEHALTVWMAPFVSVIRVLGEKGVRVISTSALETLACTGPSVRTRTAPITATAATSTGDVTARMLRPTTKVVDLDPCLSKKPLEEKPSQPYSARESLSEVQSLSSFQSESCDDNGYHWDTSDWMPSVPLPDIQEFPNYEVIDEQTPLYSADPNAIDTDYYPGGYDIESDFPPPPEDFPAADELPPLPPEFSNQFESIHPPRDMPAAGSLGSSSRNRQRFNLNQYLPNFYPLDMSEPQTKGTGENSTCREPHA

SEQ ID NO: 5121 - protein, 92 aa, Homo Sapiens
ALLAAGGRGVPGPPPQLRVPTPSASRSLRVSEPRGLGVRALPCAAPPDCQRRGLGDAPLPHGQLRSSSPPRPGDLFQNRIPPPLKHTVLPQS

SEQ ID NO: 5122 - protein, 181 aa, Homo Sapiens
CRMVQEQCCHSQLEELHCATGISLANEQDRCATPHGDNASLEATFVKRCCHCCLLGRAAQAQGQSCEYSLMVGYQCGQVFQACCVKSQETGDLDVGGLQETGGGPCKQQCRDTGDEVVCSCFVGYQLLSDGVSCEDVNECITGSHSCRLGESCINTVGSFRCQRDSSCGTGYELTEDNSCK

SEQ ID NO: 5123 - protein, 60 aa, Homo Sapiens
DITEGNLRDSFDIIKRYMDGMTVAPLLNCHILKDLQSWEMKTVASAILDSDLYSEHFQSS

SEQ ID NO: 5124 - protein, 65 aa, Homo Sapiens
MATHQKDCSLPYATESKECRMVQEQCCHSQLEELHCATGISLANEQDRCATPHGDNASLEATFVK

SEQ ID NO: 5125 - protein, 139 aa, Homo Sapiens
MATHQKDCSLPYATESKECRMVQEQCCHSQLEELHCATGISLANEQDRCATPHGDNASLEATFVKRCCHCCLLGRAAQAQGQSCEYSLMVGYQCGQVFQACCVKSQETGDLDVGGLQETDKIIEVEEEQEDPYLNDRCR

SEQ ID NO: 5126 - protein, 721 aa, Homo Sapiens
MERAAPSRRVPLPLLLLGGLALLAAGVDADVLLEACCADGHRMATHQKDCSLPYATESKECRAVGLASLCQDLNGAWAVWKVGRASQAEGTASARAQRRGMVQEQCCHSQLEELHCATGISLANEQDRCATPHGDNASLEATFVKRCCHCCLLGRAAQAQGQSCEYSLMVGYQCGQVFQACCVKSQETGDLDVGGLQETDKIIEVEEEQEDPYLNDRCRGGGPCKQQCRDTGDEVVCSCFVGYQLLSDGVSCEDVNECITGSHSCRLGESCINTVGSFRCQRDSSCGTGYELTEDNSCKDIDECESGIHNCLPDFICQNTLGSFRCRPKLQCKSGFIQDALGNCIDINECLSISAPCPIGHTCINTEGSYTCQKNVPNCGRGYHLNEEGTRCVDVDECAPPAEPCGKGHRCVNSPGSFRCECKTGYYFDGISRMCVDVNECQRYPGRLCGHKCENTLGSYLCSCSVGFRLSVDGRSCEDINECSSSPCSQECANVYGSYQCYCRRGYQLSDVDGVTCEDIDECALPTGGHICSYRCINIPGSFQCSCPSSGYRLAPNGRNCQDIDECVTGIHNCSINETCFNIQGGFRCLAFECPENYRRSAATRCERLPCHENRECSKLPLRITYYHLSFPTNIQAPAVVFRMGPSSAVPGDSMQLAITGGNEEGFFTTRKVSPHSGVVALTKPVPEPRDLLLTVKMDLSRHGTVSSFVAKLFIFVSAEL

SEQ ID NO: 5127 - protein, 683 aa, Homo Sapiens
MERAAPSRRVPLPLLLLGGLALLAAGVDADVLLEACCADGHRMATHQKDCSLPYATESKECRMVQEQCCHSQLEELHCATGISLANEQDRCATPHGDNASLEATFVKRCCHCCLLGRAAQAQGQSCEYSLMVGYQCGQVFQACCVKSQETGDLDVGGLQETDKIIEVEEEQEDPYLNDRCRGGGPCKQQCRDTGDEVVCSCFVGYQLLSDGVSCEDVNECITGSHSCRLGESCINTVGSFRCQRDSSCGTGYELTEDNSCKDIDECESGIHNCLPDFICQNTLGSFRCRPKLQCKSGFIQDALGNCIDINECLSISAPCPIGHTCINTEGSYTCQKNVPNCGRGYHLNEEGTRCVDVDECAPPAEPCGKGHRCVNSPGSFRCECKTGYYFDGISRMCVDVNECQRYPGRLCGHKCENTLGSYLCSCSVGFRLSVDGRSCEDINECSSSPCSQECANVYGSYQCYCRRGYQLSDVDGVTCEDIDECALPTGGHICSYRCINIPGSFQCSCPSSGYRLAPNGRNCQDIDECVTGIHNCSINETCFNIQGGFRCLAFECPENYRRSAATRCERLPCHENRECSKLPLRITYYHLSFPTNIQAPAVVFRMGPSSAVPGDSMQLAITGGNEEGFFTTRKVSPHSGVVALTKPVPEPRDLLLTVKMDLSRHGTVSSFVAKLFIFVSAEL

SEQ ID NO: 5128 - protein, 703 aa, Homo Sapiens
MERAAPSRRVPLPLLLLGGLALLAAGVDADVLLEACCADGHRMATHQKDCSLPYATESKECRMVQEQCCHSQLEELHCATGISLANEQDRCATPHGDNASLEATFVKRCCHCCLLGRAAQAQGQSCEYSLMVGYQCGQVFQACCVKSQETGDLDVGGLQETDKIIEVEEEQEDPYLNDRCRGGGPCKQQCRDTGDEVVCSCFVGYQLLSDGVSCEDVNECITGSHSCRLGESCINTVGSFRCQRDSSCGTGYELTEDNSCKDIDECESGIHNCLPDFICQNTLGSFRCRPKLQCKSGFIQDALGNCIDINECLSISAPCPIGHTCINTEGSYTCQKNVPNCGRGYHLNEEGTRCVDVDECAPPAEPCGKGHRCVNSPGSFRCECKTGYYFDGISRMCVDVNECQRYPGRLCGHKCENTLGSYLCSCSVGFRLSVDGRSCEDINECSSSPCSQECANVYGSYQCYCRRGYQLSDVDGVTCEDIDECALPTGGHICSYRCINIPGSFQCSCPSSGYRLAPNGRNCQDIDECVTGIHNCSINETCFNIQGGFRCLAFECPENYRRSAATLQQEKTDTVRCIKSCRPNDVTCVFDPVHTISHTVISLPTFREFTRPEEIIFLRAITPPHPASQANIIFDITEGNLRDSFDIIKRYMDGMTVGVVRQVRPIVGPFHAVLKLEMNYVVGGVVSHRNVVNVHIFVSEYWF

SEQ ID NO: 5129 - protein, 566 aa, Homo Sapiens
MERAAPSRRVPLPLLLLGGLALLAAGVDADVLLEACCADGHRMATHQKDCSLPYATESKECRMVQEQCCHSQLEELHCATGISLANEQDRCATPHGDNASLEATFVKRCCHCCLLGRAAQAQGQSCEYSLMVGYQCGQVFQACCVKSQETGDLDVGGLQETDKIIEVEEEQEDPYLNDRCRGGGPCKQQCRDTGDEVVCSCFVGYQLLSDGVSCEDVNECITGSHSCRLGESCINTVGSFRCQRDSSCGTGYELTEDNSCKDIDECESGIHNCLPDFICQNTLGSFRCRPKLQCKSGFIQDALGNCIDINECLSISAPCPIGHTCINTEGSYTCQKNVPNCGRGYHLNEEGTRCVDVDECAPPAEPCGKGHRCVNSPGSFRCECKTGYYFDGISRMCVDVNECQRYPGRLCGHKCENTLGSYLCSCSVGFRLSVDGRSCEDINECSSSPCSQECANVYGSYQCYCRRGYQLSDVDGVTCEDIDECALPTGGHICSYRCINIPGSFQCSCPSSGYRLAPNGRNCQDIDECVTGIHNCSINETCFNIQGGFRCLAFECPENYRRSAAT

SEQ ID NO: 5130 - protein, 601 aa, Homo Sapiens
MERAAPSRRVPLPLLLLGGLALLAAGVDADVLLEACCADGHRMATHQKDCSLPYATESKECRMVQEQCCHSQLEELHCATGISLANEQDRCATPHGDNASLEATFVKRCCHCCLLGRAAQAQGQSCEYSLMVGYQCGQVFQACCVKSQETGDLDVGGLQETDKIIEVEEEQEDPYLNDRCRGGGPCKQQCRDTGDEVVCSCFVGYQLLSDGVSCEDVNECITGSHSCRLGESCINTVGSFRCQRDSSCGTGYELTEDNSCKDIDECESGIHNCLPDFICQNTLGSFRCRPKLQCKSGFIQDALGNCIDINECLSISAPCPIGHTCINTEGSYTCQKNVPNCGRGYHLNEEGTRCVDVDECAPPAEPCGKGHRCVNSPGSFRCECKTGYYFDGISRMCVDVNECQRYPGRLCGHKCENTLGSYLCSCSVGFRLSVDGRSCEDINECSSSPCSQECANVYGSYQCYCRRGYQLSDVDGVTCEDIDECALPTGGHICSYRCINIPGSFQCSCPSSGYRLAPNGRNCQDIDECVTGIHNCSINETCFNIQGGFRCLAFECPENYRRSAATQKSKKGRQNTPAGSSKEDCRVLPWKQGLEDTHLDA

SEQ ID NO: 5131 - protein, 172 aa, Homo Sapiens
MERAAPSRRVPLPLLLLGGLALLAAGVDADVLLEACCADGHRMATHQKDCSLPYATESKECRMVQEQCCHSQLEELHCATGISLANEQDRCATPHGDNASLEATFVKRCCHCCLLGRAAQAQGQSCEYSLMVGYQCGQVFQACCVKSQETGDLDVGGLQETGGGPCKQQCRD

SEQ ID NO: 5132 - protein, 189 aa, Homo Sapiens
MNSYTRGSRRPSAKAASPAASVTSRVSPSGPGVPVDADVLLEACCADGHRMATHQKDCSLPYATESKECRMVQEQCCHSQLEELHCATGISLANEQDRCATPHGDNASLEATFVKRCCHCCLLGRAAQAQGQSCEYSLMVGYQCGQVFQACCVKSQETGDLDVGGLQETDKIIEVEEEQEDPYLNDRCR

SEQ ID NO: 5133 - protein, 183 aa, Homo Sapiens
  misc_feature (1)..(1): Xaa can be any naturally occurring amino acid
XKRCCHCCLLGRAAQAQGQSCEYSLMVGYQCGQVFQACCVKSQETGDLDVGGLQETDKIIEVEEEQEDPYLNDRCRGGGPCKQQCRDTGDEVVCSCFVGYQLLSDGVSCEDVNECITGSHSCRLGESCINTVGSFRCQRDSSCGTGYELTEDNSCKEYSGILPLPTQATVQEWLYTRCSRQLY

SEQ ID NO: 5134 - protein, 159 aa, Homo Sapiens
MVLLWEPAGAWLALGLALALGPSVAAAAPRQDCTGVECPPLENCIEEALEPGACCATCVQQGCACEGYQYYDCLQGGFVRGRVPAGQSYFVDFGSTECSCPPGGGKISCQFMLCPELPPNCIEAVVVADSCPQCGQVGCVHAGHKYAAGHTVHLPPCRA

SEQ ID NO: 5135 - protein, 1184 aa, Homo Sapiens
MVLLWEPAGAWLALGLALALGPSVAAAAPRQDCTGVECPPLENCIEEALEPGACCATCVQQGCACEGYQYYDCLQGGFVRGRVPAGQSYFVDFGSTECSCPPGGGKISCQFMLCPELPPNCIEAVVVADSCPQCGQVGCVHAGHKYAAGHTVHLPPCRACHCPDAGGELICYQLPGCHGNFSDAEEGDPERHYEDPYSYDQEVAEVEAATALGGEVQAGAVQAGAGGPPAALGGGSQPLSTIQAPPWPAVLPRPTAAAALGPPAPVQAKARRVTEDSEEEEEEEEEREEMAVTEQLAAGGHRGLDGLPTTAPAGPSLPIQEERAEAGARAEAGARPEENLILDAQATSRSTGPEGVTHAPSLGKAALVPTQAVPGSPRDPVKPSPHNILSTSLPDAAWIPPTREVPRKPQVLPHSHVEEDTDPNSVHSIPRSSPEGSTKDLIETCCAAGQQWAIDNDECLEIPESGTEDNVCRTAQRHCCVSYLQEKSCMAGVLGAKEGETCGAEDNDSCGISLYKQCCDCCGLGLRVRAEGQSCESNPNLGYPCNHVMLSCCEGEEPLIVPEVRRPPEPAAAPRRVSEAEMAGREALSLGTEAELPNSLPGDDQDECLLLPGELCQHLCINTVGSYHCACFPGFSLQDDGRTCRPEGHPPQPEAPQEPALKSEFSQVASNTIPLPLPQPNTCKDNGPCKQVCSTVGGSAICSCFPGYAIMADGVSCEDINECVTDLHTCSRGEHCVNTLGSFHCYKALTCEPGYALKDGECEDVDECAMGTHTCQPGFLCQNTKGSFYCQARQRCMDGFLQDPEGNCVDINECTSLSEPCRPGFSCINTVGSYTCQRNPLICARGYHASDDGTKCVDVNECETGVHRCGEGQVCHNLPGSYRCDCKAGFQRDAFGRGCIDVNECWASPGRLCQHTCENTLGSYRCSCASGFLLAADGKRCEDVNECEAQRCSQECANIYGSYQCYCRQGYQLAEDGHTCTDIDECAQGAGILCTFRCLNVPGSYQCACPEQGYTMTANGRSCKDVDECALGTHNCSEAETCHNIQGSFRCLRFECPPNYVQVSKTKCERTTCHDFLECQNSPARITHYQLNFQTGLLVPAHIFRIGPAPAFTGDTIALNIIKGNEEGYFGTRRLNAYTGVVYLQRAVLEPRDFALDVEMKLWRQGSVTTFLAKMHIFFTTFAL

SEQ ID NO: 5136 - protein, 1231 aa, Homo Sapiens
MVLLWEPAGAWLALGLALALGPSVAAAAPRQDCTGVECPPLENCIEEALEPGACCATCVQQGCACEGYQYYDCLQGGFVRGRVPAGQSYFVDFGSTECSCPPGGGKISCQFMLCPELPPNCIEAVVVADSCPQCGQVGCVHAGHKYAAGHTVHLPPCRACHCPDAGGELICYQLPGCHGNFSDAEEGDPERHYEDPYSYDQEVAEVEAATALGGEVQAGAVQAGAGGPPAALGGGSQPLSTIQAPPWPAVLPRPTAAAALGPPAPVQAKARRVTEDSEEEEEEEEEREEMAVTEQLAAGGHRGLDGLPTTAPAGPSLPIQEERAEAGARAEAGARPEENLILDAQATSRSTGPEGVTHAPSLGKAALVPTQAVPGSPRDPVKPSPHNILSTSLPDAAWIPPTREVPRKPQVLPHSHVEEDTDPNSVHSIPRSSPEGSTKDLIETCCAAGQQWAIDNDECLEIPESGTEDNVCRTAQRHCCVSYLQEKSCMAGVLGAKEGETCGAEDNDSCGISLYKQCCDCCGLGLRVRAEGQSCESNPNLGYPCNHVMLSCCEGEEPLIVPEVRRPPEPAAAPRRVSEAEMAGREALSLGTEAELPNSLPGDDQDECLLLPGELCQHLCINTVGSYHCACFPGFSLQDDGRTCRPEGHPPQPEAPQEPALKSEFSQVASNTIPLPLPQPNTCKDNGPCKQVCSTVGGSAICSCFPGYAIMADGVSCEDQDECLMGAHDCSRRQFCVNTLGSFYCVNHTVLCADGYILNAHRKCVDINECVTDLHTCSRGEHCVNTLGSFHCYKALTCEPGYALKDGECEDVDECAMGTHTCQPGFLCQNTKGSFYCQARQRCMDGFLQDPEGNCVDINECTSLSEPCRPGFSCINTVGSYTCQRNPLICARGYHASDDGTKCVDVNECETGVHRCGEGQVCHNLPGSYRCDCKAGFQRDAFGRGCIDVNECWASPGRLCQHTCENTLGSYRCSCASGFLLAADGKRCEDVNECEAQRCSQECANIYGSYQCYCRQGYQLAEDGHTCTDIDECAQGAGILCTFRCLNVPGSYQCACPEQGYTMTANGRSCKDVDECALGTHNCSEAETCHNIQGSFRCLRFECPPNYVQVSKTKCERTTCHDFLECQNSPARITHYQLNFQTGLLVPAHIFRIGPAPAFTGDTIALNIIKGNEEGYFGTRRLNAYTGVVYLQRAVLEPRDFALDVEMKLWRQGSVTTFLAKMHIFFTTFAL

SEQ ID NO: 5137 - protein, 1231 aa, Homo Sapiens; identical to SEQ ID NO: 5136

SEQ ID NO: 5138 - protein, 109 aa, Homo Sapiens
  misc_feature (1)..(1): Xaa can be any naturally occurring amino acid
XIDECAQGAGILCTFRCLNVPGSYQCACPEQGYTMTANGRSCKDVDECALGTHNCSEAETCHNIQGSFRCLRFECPPNYVQVSKTWCVPTQAPSGSLHGGPRPWRVPCG

SEQ ID NO: 5139 - protein, 101 aa, Homo Sapiens
  misc_feature (1)..(1): Xaa can be any naturally occurring amino acid
XVDECALGTHNCSEAETCHNIQGSFRCLRFECPPNYVQVSKTKCERTKWKLARWATAVAGALWVRLGDDLRTRDTRPCWGSWTPLDDPSPKLTFHFMFHCD

SEQ ID NO: 5140 - protein, 44 aa, Homo Sapiens
MPGIKRILTVTILALCLPSPGNAQAQCTNGFDLDRQSGQCLASL

SEQ ID NO: 5141 - protein, 489 aa, Homo Sapiens
MPGIKRILTVTILALCLPSPGNAQAQCTNGFDLDRQSGQCLDGVSLSSPRLECNGAISAHCNLCLPGSSDSSASASQVAGITDIDECRTIPEACRGDMMCVNQNGGYLCIPRTNPVYRGPYSNPYSTPYSGPYPAAAPPLSAPNYPTISRPLICRFGYQMDESNQCVDVDECATDSHQCNPTQICINTEGGYTCSCTDGYWLLEGQCLDIDECRYGYCQQLCANVPGSYSCTCNPGFTLNEDGRSCQDVNECATENPCVQTCVNTYGSFICRCDPGYELEEDGVHCSDMDECSFSEFLCQHECVNQPGTYFCSCPPGYILLDDNRSCQDINECEHRNHTCNLQQTCYNLQGGFKCIDPIRCEEPYLRISDNRCMCPAENPGCRDQPFTILYRDMDVVSGRSVPADIFQMQATTRYPGAYYIFQIKSGNEGREFYMRQTGPISATLVMTRPIKGPREIQLDLEMITVNTVINFRGSSVIRLRIYVSQYPF

SEQ ID NO: 5142 - protein, 91 aa, Homo Sapiens
MPGIKRILTVTILALCLPSPGNAQAQCTNGFDLDRQSGQCLDIDECRTIPEACRGDMMCVNQNGGYLCIPRTNPVYRGPYSNPYSTPYSGP

SEQ ID NO: 5143 - protein, 448 aa, Homo Sapiens
MPGIKRILTVTILALCLPSPGNAQAQCTNGFDLDRQSGQCLDIDECRTIPEACRGDMMCVNQNGGYLCIPRTNPVYRGPYSNPYSTPYSGPYPAAAPPLSAPNYPTISRPLICRFGYQMDESNQCVDVDECATDSHQCNPTQICINTEGGYTCSCTDGYWLLEGQCLDIDECRYGYCQQLCANVPGSYSCTCNPGFTLNEDGRSCQDVNECATENPCVQTCVNTYGSFICRCDPGYELEEDGVHCSDMDECSFSEFLCQHECVNQPGTYFCSCPPGYILLDDNRSCQDINECEHRNHTCNLQQTCYNLQGGFKCIDPIRCEEPYLRISDNRCMCPAENPGCRDQPFTILYRDMDVVSGRSVPADIFQMQATTRYPGAYYIFQIKSGNEGREFYMRQTGPISATLVMTRPIKGPREIQLDLEMITVNTVINFRGSSVIRLRIYVSQYPF

SEQ ID NO: 5144 - protein, 35 aa, Homo Sapiens
MPGIKRILTVTILALCLPSPGNAQQQERWTPVCQP

SEQ ID NO: 5145 - protein, 453 aa, Homo Sapiens
MRSGNCRQRYMILTVTILALCLPSPGNAQAQCTNGFDLDRQSGQCLDIDECRTIPEACRGDMMCVNQNGGYLCIPRTNPVYRGPYSNPYSTPYSGPYPAAAPPLSAPNYPTISRPLICRFGYQMDESNQCVDVDECATDSHQCNPTQICINTEGGYTCSCTDGYWLLEGQCLDIDECRYGYCQQLCANVPGSYSCTCNPGFTLNEDGRSCQDVNECATENPCVQTCVNTYGSFICRCDPGYELEEDGVHCSDMDECSFSEFLCQHECVNQPGTYFCSCPPGYILLDDNRSCQDINECEHRNHTCNLQQTCYNLQGGFKCIDPIRCEEPYLRISDNRCMCPAENPGCRDQPFTILYRDMDVVSGRSVPADIFQMQATTRYPGAYYIFQIKSGNEGREFYMRQTGPISATLVMTRPIKGPREIQLDLEMITVNTVINFRGSSVIRLRIYVSQYPF

SEQ ID NO: 5146 - protein, 261 aa, Homo Sapiens
AGSARTLGTARGGHGAGKGLSPTALLPARVASCARSQKAWPLCIIDVNECELYGQEGRPRLCMHACVNTPGSYRCTCPGGYRTLADGKSCEDVDECVGLQPVCPQGTTCINTGGSFQCVSPECPEGSGNVSYVKTSPFQCERNPCPMDSRPCRHLPKTISFHYLSLPSNLKTPITLFRMATASAPGRAGPNSLRFGIVGGNSRGHFVMQRSDRQTGDLILVQNLEGPQTLEVDVDMSEYLDRSFQANHVSKVTIFVSPYDF

SEQ ID NO: 5147 - protein, 305 aa, Homo Sapiens
MVPSSPRALFLLLLILACPEPRASQNCLSKQQLLSAIRQLQQLLKGQETRFAEGIRHMKSRLAALQNSVGRVGPDALPVSCPALNTPADGRKFGSKYLVDHEVHFTCNPGFRLVGPSSVVCLPNGTWTGEQPHCRDVDECVGLQPVCPQGTTCINTGGSFQCVSPECPEGSGNVSYVKTSPFQCERNPCPMDSRPCRHLPKTISFHYLSLPSNLKTPITLFRMATASAPGRAGPNSLRFGIVGGNSRGHFVMQRSDRQTGDLILVQNLEGPQTLEVDVDMSEYLDRSFQANHVSKVTIFVSPYDF

SEQ ID NO: 5148 - protein, 439 aa, Homo Sapiens
MVPSSPRALFLLLLILACPEPRASQNCLSKQQLLSAIRQLQQLLKGQETRFAEGIRHMKSRLAALQNSVGRVGPDALPVSCPALNTPADGRKFGSKYLVDHEVHFTCNPGFRLVGPSSVVCLPNGTWTGEQPHCRGISECSSQPCQNGGTCVEGVNQYRCICPPGRTGNRCQHQAQTAAPEGSVAGDSAFSRAPRCAQVERAQHCSCEAGFHLSGAAGDSVCQDVNECELYGQEGRPRLCMHACVNTPGSYRCTCPGGYRTLADGKSCEDVDECVGLQPVCPQGTTCINTGGSFQCVSPECPEGSGNVSYVKTSPFQCERNPCPMDSRPCRHLPKTISFHYLSLPSNLKTPITLFRMATASAPGRAGPNSLRFGIVGGNSRGHFVMQRSDRQTGDLILVQNLEGPQTLEVDVDMSEYLDRSFQANHVSKVTIFVSPYDF

SEQ ID NO: 5149 - protein, 366 aa, Homo Sapiens
MVPSSPRALFLLLLILACPEPRASQNCLSKQQLLSAIRQLQQLLKGQETRFAEGIRHMKSRLAALQNSVGRVGPDALPVSCPALNTPADGRKFGSKYLVDHEVHFTCNPGFRLVGPSSVVCLPNGTWTGEQPHCRGISECSSQPCQNGGTCVEGVNQYRCICPPGRTGNRCQHQAQTAAPEGSVAGDSAFSRAPRCAQVERAQHCSCEAGFHLSGAAGDSVCQDVNECELYGQEGRPRLCMHACVNTPGSYRCTCPGGYRTLADGKSCEDVDECVGLQPVCPQGTTCINTGGSFQCVSPECPEGSGNVSYVKTSPLTWRGLRRWRWTSTCRNTWTAPSRPTTCPRSPSLYPPMTSEGTQGHWGVES

SEQ ID NO: 5150 - protein, 393 aa, Homo Sapiens
MVPSSPRALFLLLLILACPEPRASQNCLSKQQLLSAIRQLQQLLKGQETRFAEGIRHMKSRLAALQNSVGRVGPDALPVSCPALNTPADGRKFGSKYLVDHEVHFTCNPGFRLVGPSSVVCLPNGTWTGEQPHCRGISECSSQPCQNGGTCVEGVNQYRCICPPGRTGNRCQHQAQTDVNECELYGQEGRPRLCMHACVNTPGSYRCTCPGGYRTLADGKSCEDVDECVGLQPVCPQGTTCINTGGSFQCVSPECPEGSGNVSYVKTSPFQCERNPCPMDSRPCRHLPKTISFHYLSLPSNLKTPITLFRMATASAPGRAGPNSLRFGIVGGNSRGHFVMQRSDRQTGDLILVQNLEGPQTLEVDVDMSEYLDRSFQANHVSKVTIFVSPYDF

SEQ ID NO: 5151 - protein, 273 aa, Homo Sapiens
RFAEGIRHMKSRLAALQNSVGRVGPDALPGISECSSQPCQNGGTCVEGVNQYRCICPPGRTGNRCQHQAQTAAPEGSVAGDSAFSRAPRCAQVERAQHCSCEAGFHLSGAAGDSVCQDVNECELYGQEGRPRLCMHACVNTPGSYRCTCPGGYRTLADGKSCEDVDECVGLQPVCPQGTTCINTGGSFQCVSPECPEGSGNVSYVKTSPFQCERNPCPMDSRPCRHLPKTISFHYLSLPSNLKTPITLFRMATASAPGRAGPNSLRFGIVGGN

SEQ ID NO: 5152 - protein, 55 aa, Homo Sapiens
MRRGRLLEIALGFTVLLASYTSHGADANLEAGNVKETRASRAKRRGGGGHDALKG

SEQ ID NO: 5153 - protein, 302 aa, Homo Sapiens
MRRGRLLEIALGFTVLLASYTSHGADANLEAGNVKETRASRAKRRGGGGHDALKGPNVCGSRYNAYCCPGWKTLPGGNQCIVPICRHSCGDGFCSRPNMCTCPSGQIAPSCGSRSIQHCNIRCMNGGSCSDDHCLCQKGYIGTHCGQPVCESGCLNGGRCVAPNRCACTYGFTGPQCERDYRTGPCFTVISNQMCQGQLSGIVCTKTLCCATTSMNVKLEHTTVANMLYVPIQQEASNVAAVPGGLEMALSALIWTNVPMEPICAASMQTARIPWDLTAVCARKDTQVMASLVQTLMSALRT

SEQ ID NO: 5154 - protein, 2871 aa, Homo Sapiens
MRRGRLLEIALGFTVLLASYTSHGADANLEAGNVKETRASRAKRRGGGGHDALKGPNVCGSRYNAYCCPGWKTLPGGNQCIVPICRHSCGDGFCSRPNMCTCPSGQIAPSCGSRSIQHCNIRCMNGGSCSDDHCLCQKGYIGTHCGQPVCESGCLNGGRCVAPNRCACTYGFTGPQCERDYRTGPCFTVISNQMCQGQLSGIVCTKTLCCATVGRAWGHPCEMCPAQPHPCRRGFIPNIRTGACQDVDECQAIPGLCQGGNCINTVGSFECKCPAGHKLNEVSQKCEDIDECSTIPGICEGGECTNTVSSYFCKCPPGFYTSPDGTRCIDVRPGYCYTALTNGRCSNQLPQSITKMQCCCDAGRCWSPGVTVAPEMCPIRATEDFNKLCSVPMVIPGRPEYPPPPLGPIPPVLPVPPGFPPGPQIPVPRPPVEYLYPSREPPRVLPVNVTDYCQLVRYLCQNGRCIPTPGSYRCECNKGFQLDLRGECIDVDECEKNPCAGGECINNQGSYTCQCRAGYQSTLTRTECRDIDECLQNGRICNNGRCINTDGSFHCVCNAGFHVTRDGKNCEDMDECSIRNMCLNGMCINEDGSFKCICKPGFQLASDGRYCKDINECETPGICMNGRCVNTDGSYRCECFPGLAVGLDGRVCVDTHMRSTCYGGYKRGQCIKPLFGAVTKSECCCASTEYAFGEPCQPCPAQNSAEYQALCSSGPGMTSAGSDINECALDPDICPNGICENLRGTYKCICNSGYEVDSTGKNCVDINECVLNSLLCDNGQCRNTPGSFVCTCPKGFIYKPDLKTCEDIDECESSPCINGVCKNSPGSFICECSSESTLDPTKTICIETIKGTCWQTVIDGRCEININGATLKSQCCSSLGAAWGSPCTLCQVDPICGKGYSRIKGTQCEDIDECEVFPGVCKNGLCVNTRGSFKCQCPSGMTLDATGRICLDIRLETCFLRYEDEECTLPIAGRHRMDACCCSVGAAWGTEECEECPMRNTPEYEELCPRGPGFATKEITNGKPFFKDINECKMIPSLCTHGKCRNTIGSFKCRCDSGFALDSEERNCTDIDECRISPDLCGRGQCVNTPGDFECKCDEGYESGFMMMKNCMDIDECQRDPLLCRGGVCHNTEGSYRCECPPGHQLSPNISACIDINECELSAHLCPNGRCVNLIGKYQCACNPGYHSTPDRLFCVDIDECSIMNGGCETFCTNSEGSYECSCQPGFALMPDQRSCTDIDECEDNPNICDGGQCTNIPGEYRCLCYDGFMASEDMKTCVDVNECDLNPNICLSGTCENTKGSFICHCDMGYSGKKGKTGCTDINECEIGAHNCGKHAVCTNTAGSFKCSCSPGWIGDGIKCTDLDECSNGTHMCSQHADCKNTMGSYRCLCKEGYTGDGFTCTDLDECSENLNLCGNGQCLNAPGGYRCECDMGFVPSADGKACEDIDECSLPNICVFGTCHNLPGLFRCECEIGYELDRSGGNCTDVNECLDPTTCISGNCVNTPGSYICDCPPDFELNPTRVGCVDTRSGNCYLDIRPRGDNGDTACSNEIGVGVSKASCCCSLGKAWGTPCEMCPAVNTSEYKILCPGGEGFRPNPITVILEDIDECQELPGLCQGGKCINTFGSFQCRCPTGYYLNEDTRVCDDVNECETPGICGPGTCYNTVGNYTCICPPDYMQVNGGNNCMDMRRSLCYRNYYADNQTCDGELLFNMTKKMCCCSYNIGRAWNKPCEQCPIPSTDEFATLCGSQRPGFVIDIYTGLPVDIDECREIPGVCENGVCINMVGSFRCECPVGFFYNDKLLVCEDIDECQNGPVCQRNAECINTAGSYRCDCKPGYRFTSTGQCNDRNECQEIPNICSHGQCIDTVGSFYCLCHTGFKTNDDQTMCLDINECERDACGNGTCRNTIGSFNCRCNHGFILSHNNDCIDVDECASGNGNLCRNGQCINTVGSFQCQCNEGYEVAPDGRTCVDINECLLEPRKCAPGTCQNLDGSYRCICPPGYSLQNEKCEDIDECVEEPEICALGTCSNTEGSFKCLCPEGFSLSSSGRRCQDLRMSYCYAKFEGGKCSSPKSRNHSKQECCCALKGEGWGDPCELCPTEPDEAFRQICPYGSGIIVGPDDSAVDMDECKEPDVCKHGQCINTDGSYRCECPFGYILAGNECVDTDECSVGNPCGNGTCKNVIGGFECTCEEGFEPGPMMTCEDINECAQNPLLCAFRCVNTYGSYECKCPVGYVLREDRRMCKDEDECEEGKHDCTEKQMECKNLIGTYMCICGPGYQRRPDGEGCVDENECQTKPGICENGRCLNTRGSYTCECNDGFTASPNQDECLDNREGYCFTEVLQNMCQIGSSNRNPVTKSECCCDGGRGWGPHCEICPFQGTVAFKKLCPHGRGFMTNGADIDECKVIHDVCRNGECVNDRGSYHCICKTGYTPDITGTSCVDLNECNQAPKPCNFICKNTEGSYQCSCPKGYILQEDGRSCKDLDECATKQHNCQFLCVNTIGGFTCKCPPGFTQHHTSCIDNNECTSDINLCGSKGICQNTPGSFTCECQRGFSLDQTGSSCEDVDECEGNHRCQHGCQNIIGGYRCSCPQGYLQHYQWNQCVDENECLSAHICGGASCHNTLGSYKCMCPAGFQYEQFSGGCQDINECGSAQAPCSYGCSNTEGGYLCGCPPGYFRIGQGHCVSGMGMGRGNPEPPVSGEMDDNSLSPEACYECKINGYPKRGRKRRSTNETDASNIEDQSETEANVSLASWDVEKTAIFAFNISHVSNKVRILELLPALTTLTNHNRYLIESGNEDGFFKINQKEGISYLHFTKKKPVAGTYSLQISSTPLYKKKELNQLEDKYDKDYLSGELGDNLKMKIQVLLH

SEQ ID NO: 5155 - protein, 853 aa, Homo Sapiens
  misc_feature (1)..(1): Xaa can be any naturally occurring amino acid
XLGKAWGTPCEMCPAVNTSEYKILCPGGEGFRPNPITVILEDIDECQELPGLCQGGKCINTFGSFQCRCPTGYYLNEDTRVCDDVNECETPGICGPGTCYNTVGNYTCICPPDYMQVNGGNNCMDMRRSLCYRNYYADNQTCDGELLFNMTKKMCCCSYNIGRAWNKPCEQCPIPSTDEFATLCGSQRPGFVIDIYTGLPVDIDECREIPGVCENGVCINMVGSFRCECPVGFFYNDKLLVCEDIDECQNGPVCQRNAECINTAGSYRCDCKPGYRFTSTGQCNDRNECQEIPNICSHGQCIDTVGSFYCLCHTGFKTNDDQTMCLDINECERDACGNGTCRNTIGSFNCRCNHGFILSHNNDCIDVDECASGNGNLCRNGQCINTVGSFQCQCNEGYEVAPDGRTCVDINECLLEPRKCAPGTCQNLDGSYRCICPPGYSLQNEKCEDIDECVEEPEICALGTCSNTEGSFKCLCPEGFSLSSSGRRCQDLRMSYCYAKFEGGKCSSPKSRNHSKQECCCALKGEGWGDPCELCPTEPDEAFRQICPYGSGIIVGPDDSAVDMDECKEPDVCKHGQCINTDGSYRCECPFGYILAGNECVDTDECSVGNPCGNGTCKNVIGGFECTCEEGFEPGPMMTCEDINECAQNPLLCAFRCVNTYGSYECKCPVGYVLREDRRMCKDEDECEEGKHDCTEKQMECKNLIGTYMCICGPGYQRRPDGEGCVDENECQTKPGICENGRCLNTRGSYTCECNDGFTASPNQDECLDVILSLLLLSPAFPSCFFSPRTIGKGTASQRCYKTCVRSAPATGTPSPNRNAAVTEGEAGVPTVRSALSRGLWLSRNSVPMAEDS

SEQ ID NO: 5156 - protein, 1473 aa, Homo Sapiens
MGRRRRLCLQLYFLWLGCVVLWAQGTAGQPQPPPPKPPRPQPPPQQVRSATAGSEGGFLAPEYREEGAAVASRVRRRGQQDVLRGPNVCGSRFHSYCCPGWKTLPGGNQCIVLQQCSVRCMNGGTCADDHCQCQKGYIGTYCGQPVCENGCQNGGRCIGPNRCACVYGFTGPQCERDYRTGPCFTQVNNQMCQGQLTGIVCTKTLCCATIGRAWGHPCEMCPAQPQPCRRGFIPNIRTGACQDVDECQAIPGICQGGNCINTVGSFECRCPAGHKQSETTQKCEDIDECSIIPGICETGECSNTVGSYFCVCPRGYVTSTDGSRCIDQRTGMCFSGLVNGRCAQELPGRMTKMQCCCEPGRCWGIGTIPEACPVRGSEEYRRLCMDGLPMGGIPGSAGSRPGGTGGNGFAPSGNGNGYGPGGTGFIPIPGGNGFSPGVGGAGVGAGGQGPIITGLTILNQTIDICKHHANLCLNGRCIPTVSSYRCECNMGYKQDANGDCIDVDECTSNPCTNGDCVNTPGSYYCKCHAGFQRTPTKQACIDIDECIQNGVLCKNGRCVNTDGSFQCICNAGFELTTDGKNCVDHDECTTTNMCLNGMCINEDGSFKCICKPGFVLAPNGRYCTDVDECQTPGICMNGHCINSEGSFRCDCPPGLAVGMDGRVCVDTHMRSTCYGGIKKGVCVRPFPGAVTKSECCCANPDYGFGEPCQPCPAKNSAEFHGLCSSGVGITVDGRDINECALDPDICANGICENLRGSYRCNCNSGYEPDASGRNCIDIDECLVNRLLCDNGLCRNTPGSYSCTCPPGYVFRTETETCEDINECESNPCVNGACRNNLGSFNCECSPGSKLSSTGLICIDSLKGTCWLNIQDSRCEVNINGATLKSECCATLGAAWGSPCERCELDTACPRGLARIKGVTCEDVNECEVFPGVCPNGRCVNSKGSFHCECPEGLTLDGTGRVCLDIRMEQCYLKWDEDECIHPVPGKFRMDACCCAVGAAWGTECEECPKPGTKEYETLCPRGAGFANRGDVLTGRPFYKDINECKAFPGMCTYGKCRNTIGSFKCRCNSGFALDMEERNCTDIDECRISPDLCGSGICVNTPGSFECECFEGYESGFMMMKNCMDIDECERNPLLCRGGTCVNTEGSFQCDCPLGHELSPSREDCVDINECSLSDNLCRNGKCVNMIGTYQCSCNPGYQATPDRQGCTDIDECMIMNGGCDTQCTNSEGSYECSCSEGYALMPDGRSCADIDECENNPDICDGGQCTNIPGEYRCLCYDGFMASMDMKTCIDVNECDLNSNICMFGECENTKGSFICHCQLGYSVKKGTTGCTDVDECEIGAHNCDMHASCLNIPGSFKCSCREGWIGNGIKCIDLDECSNGTHQCSINAQCVNTPGSYRCACSEGFTGDGFTCSDVDECAENINLCENGQCLNVPGAYRCECEMGFTPASDSRSCQGGSPGFQLIFKLDQPQ

SEQ ID NO: 5157 - protein, 2912 aa, Homo Sapiens
MGRRRRLCLQLYFLWLGCVVLWAQGTAGQPQPPPPKPPRPQPPPQQVRSATAGSEGGFLAPEYREEGAAVASRVRRRGQQDVLRGPNVCGSRFHSYCCPGWKTLPGGNQCIVPICRNSCGDGFCSRPNMCTCSSGQISSTCGSKSIQQCSVRCMNGGTCADDHCQCQKGYIGTYCGQPVCENGCQNGGRCIGPNRCACVYGFTGPQCERDYRTGPCFTQVNNQMCQGQLTGIVCTKTLCCATIGRAWGHPCEMCPAQPQPCRRGFIPNIRTGACQDVDECQAIPGICQGGNCINTVGSFECRCPAGHKQSETTQKCEDIDECSIIPGICETGECSNTVGSYFCVCPRGYVTSTDGSRCIDQRTGMCFSGLVNGRCAQELPGRMTKMQCCCEPGRCWGIGTIPEACPVRGSEEYRRLCMDGLPMGGIPGSAGSRPGGTGGNGFAPSGNGNGYGPGGTGFIPIPGGNGFSPGVGGAGVGAGGQGPIITGLTILNQTIDICKHHANLCLNGRCIPTVSSYRCECNMGYKQDANGDCIDVDECTSNPCTNGDCVNTPGSYYCKCHAGFQRTPTKQACIDIDECIQNGVLCKNGRCVNTDGSFQCICNAGFELTTDGKNCVDHDECTTTNMCLNGMCINEDGSFKCICKPGFVLAPNGRYCTDVDECQTPGICMNGHCINSEGSFRCDCPPGLAVGMDGRVCVDTHMRSTCYGGIKKGVCVRPFPGAVTKSECCCANPDYGFGEPCQPCPAKNSAEFHGLCSSGVGITVDGRDINECALDPDICANGICENLRGSYRCNCNSGYEPDASGRNCIDIDECLVNRLLCDNGLCRNTPGSYSCTCPPGYVFRTETETCEDINECESNPCVNGACRNNLGSFNCECSPGSKLSSTGLICIDSLKGTCWLNIQDSRCEVNINGATLKSECCATLGAAWGSPCERCELDTACPRGLARIKGVTCEDVNECEVFPGVCPNGRCVNSKGSFHCECPEGLTLDGTGRVCLDIRMEQCYLKWDEDECIHPVPGKFRMDACCCAVGAAWGTECEECPKPGTKEYETLCPRGAGFANRGDVLTGRPFYKDINECKAFPGMCTYGKCRNTIGSFKCRCNSGFALDMEERNCTDIDECRISPDLCGSGICVNTPGSFECECFEGYESGFMMMKNCMDIDECERNPLLCRGGTCVNTEGSFQCDCPLGHELSPSREDCVDINECSLSDNLCRNGKCVNMIGTYQCSCNPGYQATPDRQGCTDIDECMIMNGGCDTQCTNSEGSYECSCSEGYALMPDGRSCADIDECENNPDICDGGQCTNIPGEYRCLCYDGFMASMDMKTCIDVNECDLNSNICMFGECENTKGSFICHCQLGYSVKKGTTGCTDVDECEIGAHNCDMHASCLNIPGSFKCSCREGWIGNGIKCIDLDECSNGTHQCSINAQCVNTPGSYRCACSEGFTGDGFTCSDVDECAENINLCENGQCLNVPGAYRCECEMGFTPASDSRSCQDIDECSFQNICVFGTCNNLPGMFHCICDDGYELDRTGGNCTDIDECADPINCVNGLCVNTPGRYECNCPPDFQLNPTGVGCVDNRVGNCYLKFGPRGDGSLSCNTEIGVGVSRSSCCCSLGKAWGNPCETCPPVNSTEYYTLCPGGEGFRPNPITIILEDIDECQELPGLCQGGNCINTFGSFQCECPQGYYLSEDTRICEDIDECFAHPGVCGPGTCYNTLGNYTCICPPEYMQVNGGHNCMDMRKSFCYRSYNGTTCENELPFNVTKRMCCCTYNVGKAWNKPCEPCPTPGTADFKTICGNIPGFTFDIHTGKAVDIDECKEIPGICANGVCINQIGSFRCECPTGFSYNDLLLVCEDIDECSNGDNLCQRNADCINSPGSYRCECAAGFKLSPNGACVDRNECLEIPNVCSHGLCVDLQGSYQCICHNGFKASQDQTMCMDVDECERHPCGNGTCKNTVGSYNCLCYPGFELTHNNDCLDIDECSSFFGQVCRNGRCFNEIGSFKCLCNEGYELTPDGKNCIDTNECVALPGSCSPGTCQNLEGSFRCICPPGYEVKSENCIDINECDEDPNICLFGSCTNTPGGFQCLCPPGFVLSDNGRRCFDTRQSFCFTNFENGKCSVPKAFNTTKAKCCCSKMPGEGWGDPCELCPKDDEVAFQDLCPYGHGTVPSLHDTREDVNECLESPGICSNGQCINTDGSFRCECPMGYNLDYTGVRCVDTDECSIGNPCGNGTCTNVIGSFECNCNEGFEPGPMMNCEDINECAQNPLLCAFRCMNTFGSYECTCPIGYALREDQKMCKDLDECAEGLHDCESRGMMCKNLIGTFMCICPPGMARRPDGEGCVDENECRTKPGICENGRCVNIIGSYRCECNEGFQSSSSGTECLDNRQGLCFAEVLQTICQMASSSRNLVTKSECCCDGGRGWGHQCELCPLPGTAQYKKICPHGPGYTTDGRDIDECKVMPNLCTNGQCINTMGSFRCFCKVGYTTDISGTSCIDLDECSQSPKPCNYICKNTEGSYQCSCPRGYVLQEDGKTCKDLDECQTKQHNCQFLCVNTLGGFTCKCPPGFTQHHTACIDNNECGSQPSLCGAKGICQNTPGSFSCECQRGFSLDATGLNCEDVDECDGNHRCQHGCQNILGGYRCGCPQGYIQHYQWNQCVDENECSNPNACGSASCYNTLGSYKCACPSGFSFDQFSSACHDVNECSSSKNPCNYGCSNTEGGYLCGCPPGYYRVGQGHCVSGMGFNKGQYLSLDTEVDEENALSPEACYECKINGYSKKDSRQKRSIHEPDPTAVEQISLESVDMDSPVNMKFNLSHLGSKEHILELRPAIQPLNNHIRYVISQGNDDSVFRIHQRNGLSYLHTAKKKLMPGTYTLEITSIPLYKKKELKKLEESNEDDYLLGELGEALRMRLQIQLY

SEQ ID NO: 5158 - protein, 341 aa, Homo Sapiens
MGRRRRLCLQLYFLWLGCVVLWAQGTAGQPQPPPPKPPRPQPPPQQVRSATAGSEGGFLAPEYREEGAAVASRVRRRGQQDVLRGPNVCGSRFHSYCCPGWKTLPGGNQCIVPICRNSCGDGFCSRPNMCTCSSGQISSTCGSKSIQQCSVRCMNGGTCADDHCQCQKGYIGTYCGQPVCENGCQNGGRCIGPNRCACVYGFTGPQCERDYRTGPCFTQVNNQMCQGQLTGIVCTKTLCCATIGRAWGHPCEMCPAQPQPCRRGFIPNIRTGACQDVDECQAIPGICQGGNCINTVGSFECRCPAGHKQSETTQKCEVHVDKAQAGARCPCVILPSRLYLR

SEQ ID NO: 5159 - protein, 2912 aa, Homo Sapiens; identical to SEQ ID NO: 5157

SEQ ID NO: 5160 - protein, 2911 aa, Homo Sapiens
MGRRRRLCLQLYFLWLGCVVLWAQGTAGQPQPPPPKPPRPQPPPQQVRSATAGSEGGFLAPEYREEGAAVASRVRRRGQQDVLRGPNVCGSRFHSYCCPGWKTLPGGNQCIVPICRNSCGDGFCSRPNMCTCSSGQISSTCGSKSIQQCSVRCMNGGTCADDHCQCQKGYIGTYCGQPVCENGCQNGGRCITQPCACVYGFTGPQCERDYRTGPCFTQVNNQMCQGQLTGIVCTKTLCCATIGRAWGHPCEMCPAQPQPCRRGFIPNIRTGACQDVDECQAIPGICQGGNCINTVGSFECRCPAGHKQSETTQKCEDIDECSIIPGICETGECSNTVGSYFCVCPRGYVTSTDGSRCIDQRTGMCFSGLVNGRCAQELPGRMTKMQCCCEPGRCWGIGTIPEACPVRGSEEYRRLCMDGLPMGGIPGSAGSRPGGTGGNGFAPSGNGNGYGPGGTGFIPIPGGNGFSPGVGGAGVGAGGQGPIITGLTILNQTIDICKHHANLCLNGRCIPTVSSYRCECNMGYKQDANGDCIDVDECTSNPCTNGDCVNTPGSYYCKCHAGFQRTPTKQACIDIDECIQNGVLCKNGRCVNTDGSFQCICNAGFELTTDGKNCVDHDECTTTNMCLNGMCINEDGSFKCICKPGFVLAPNGRYCTDVDECQTPGICMNGHCINSEGSFRCDCPPGLAVGMDGRVCVDTHMRSTCYGGIKKGVCVRPFPGAVTKSECCCANPDYGFGEPCQPCPAKNSAEFHGLCSSGVGITVDGRDINECALDPDICANGICENLRGSYRCNCNSGYEPDASGRNCIDIDECLVNRLLCDNGLCRNTPGSYSCTCPPGYVFRTETETCEDINECESNPCVNGACRNNLGSFNCECSPGSKLSSTGLICIDSLKGTCWLNIQDSRCEVNINGATLKSECCATLGAAWGSPCERCELDTACPRGLARIKGVTCEDVNECEVFPGVCPNGRCVNSKGSFHCECPEGLTLDGTGRVCLDIRMEQCYLKWDEDECIHPVPGKFRMDACCCAVGAAWGTECEECPKPGTKEYETLCPRGAGFANRGDVLTGRPFYKDINECKAFPGMCTYGKCRNTIGSFKCRCNSGFALDMEERNCTDIDECRISPDLCGSGICVNTPGSFECECFEGYESGFMMMKNCMDIDECERNPLLCRGGTCVNTEGSFQCDCPLGHELSPSREDCVDINECSLSDNLCRNGKCVNMIGTYQCSCNPGYQATPDRQGCTDIDECMIMNGGCDTQCTNSEGSYECSCSEGYALMPDGRSCADIDECENNPDICDGGQCTNIPGEYRCLCYDGFMASMDMKTCIDVNECDLNSNICMFGECENTKGSFICHCQLGYSVKKGTTGCTDVDECEIGAHNCDMHASCLNIPGSFKCSCREGWIGNGIKCIDLDECSNGTHQCSINAQCVNTPGSYRCACSEGFTGDGFTCSDVDECAENINLCENGQCLNVPGAYRCECEMGFTPASDSRSCQDIDECSFQNICVFGTCNNLPGMFHCICDDGYELDRTGGNCTDIDECADPINCVNGLCVNTPGRYECNCPPDFQLNPTGVGCVDNRVGNCYLKFGPRGDGSLSCNTEIGVGVSRSSCCCSLGKAWGNPCETCPPVNSTEYYTLCPGGEGFRPNPITIILEDIDECQELPGLCQGGNCINTFGSFQCECPQGYYLSEDTRICEDIDECFAHPGVCGPGTCYNTLGNYTCICPPEYMQVNGGHNCMDMRKSFCYRSYNGTTCENELPFNVTKRMCCCTYNVGKAWNKPCEPCPTPGTADFKTICGNIPGFTFDIHTGKAVDIDECKEIPGICANGVCINQIGSFRCECPTGFSYNDLLLVCEDIDECSNGDNLCQRNADCINSPGSYRCECAAGFKLSPNGACVDRNECLEIPNVCSHGLCVDLQGSYQCICHNGFKASQDQTMCMDVDECERHPCGNGTCKNTVGSYNCLCYPGFELTHNNDCLDIDECSSFFGQVCRNGRCFNEIGSFKCLCNEGYELTPDGKNCIDTNECVALPGSCSPGTCQNLEGSFRCICPPGYEVKSENCIDINECDEDPNICLFGSCTNTPGGFQCLCPPGFVLSDNGRRCFDTRQSFCFTNFENGKCSVPKAFNTTKAKCCCSKMPGEGWGDPCELCPKDDEVAFQDLCPYGHGTVPSLHDTREDVNECLESPGICSNGQCINTDGSFRCECPMGYNLDYTGVRCVDTDECSIGNPCGNGTCTNVIGSFECNCNEGFEPGPMMNCEDINECAQNPLLCAFRCMNTFGSYECTCPIGYALREDQKMCKDLDECAEGLHDCESRGMMCKNLIGTFMCICPPGMARRPDGEGCVDENECRTKPGICENGRCVNIIGSYRCECNEGFQSSSSGTECLDNRQGLCFAEVLQTICQMASSSRNLVTKSECCCDGGRGWGHQCELCPLPGTAQYKKICPHGPGYTTDGRDIDECKVMPNLCTNGQCINTMGSFRCFCKVGYTTDISGTSCIDLDECSQSPKPCNYICKNTEGSYQCSCPRGYVLQEDGKTCKDLDECQTKQHNCQFLCVNTLGGFTCKCPPGFTQHHTACIDNNECGSQPSLCGAKGICQNTPGSFSCECQRGFSLDATGLNCEDVDECDGNHRCQHGCQNILGGYRCGCPQGYIQHYQWNQCVDENECSNPNACGSASCYNTLGSYKCACPSGFSFDQFSSACHDVNECSSSKNPCNYGCSNTEGGYLCGCPPGYYRVGQGHCVSGMGFNKGQYLSLDTEVDEENALSPEACYECKINGYSKKDSRQKRSIHEPDPTAVEQISLESVDMDSPVNMKFNLSHLGSKEHILELRPAIQPLNNHIRYVISQGNDDSVFRIHQRNGLSYLHTAKKKLMPGTYTLEITSIPLYKKKELKKLEESNEDDYLLGELGEALRMRLQIQLY

SEQ ID NO: 5161 - protein, 356 aa, Homo Sapiens
MMMKNCMDIDECERNPLLCRGGTCVNTEGSFQCDCPLGHELSPSREDCVDINECSLSDNLCRNGKCVNMIGTYQCSCNPGYQATPDRQGCTDIDECMIMNGGCDTQCTNSEGSYECSCSEGYALMPDGRSCADIDECENNPDICDGGQCTNIPGEYRCLCYDGFMASMDMKTCIDVNECDLNSNICMFGECENTKGSFICHCQLGYSVKKGTTGCTDVDECEIGAHNCDMHASCLNIPGSFKCSCREGWIGNGIKCIDLDECSNGTHQCSINAQCVNTPGSYRCACSEGFTGDGFTCSDVDECAENINLCENGQCLNVPGAYRCECEMGFTPASDSRSCQGGSPGFQLIFKLDQPQ

SEQ ID NO: 5162 - protein, 2809 aa, Homo Sapiens
MTLEGLYLARGPLARLLLAWSALLCMAGGQGRWDGALEAAGPGRVRRRGSPGILQGPNVCGSRFHAYCCPGWRTFPGRSQCVVPICRRACGEGFCSQPNLCTCADGTLAPSCGVSRGSGCSVSCMNGGTCRGASCLCQKGYTGTVCGQPICDRGCHNGGRCIGPNRCACVYGFMGPQCERDYRTGPCFGQVGPEGCQHQLTGLVCTKALCCATVGRAWGLPCELCPAQPHPCRRGFIPNIHTGACQDVDECQAVPGLCQGGSCVNMVGSFHCRCPVGHRLSDSSAACEDYRAGACFSVLFGGRCAGDLAGHYTRRQCCCDRGRCWAAGPVPELCPPRGSNEFQQLCAQRLPLLPGHPGLFPGLLGFGSNGMGPPLGPARLNPHGSDARGIPSLGPGNSNIGTATLNQTIDICRHFTNLCLNGRCLPTPSSYRCECNVGYTQDVRGECIDVDECTSSPCHHGDCVNIPGTYHCRCYPGFQATPTRQACVDVDECIVSGGLCHLGRCVNTEGSFQCVCNAGFELSPDGKNCVDHNECATSTMCVNGVCLNEDGSFSCLCKPGFLLAPGGHYCMDIDECQTPGICVNGHCTNTEGSFRCQCLGGLAVGTDGRVCVDTHVRSTCYGAIEKGSCARPFPGTVTKSECCCANPDHGFGEPCQLCPAKDSAEFQALCSSGLGITTDGRDINECALDPEVCANGVCENLRGSYRCVCNLGYEAGASGKDCTDVDECALNSLLCDNGWCQNSPGSYSCSCPPGFHFWQDTEICKDVDECLSSPCVSGVCRNLAGSYTCKCGPGSRLDPSGTFCLDSTKGTCWLKIQESRCEVNLQGASLRSECCATLGAAWGSPCERCEIDPACARGFARMTGVTCDDVNECESFPGVCPNGRCVNTAGSFRCECPEGLMLDASGRLCVDVRLEPCFLRWDEDECGVTLPGKYRMDVCCCSIGAVWGVECEACPDPESLEFASLCPRGLGFASRDFLSGRPFYKDVNECKVFPGLCTHGTCRNTVGSFHCACAGGFALDAQERNCTDIDECRISPDLCGQGTCVNTPGSFECECFPGYESGFMLMKNCMDVDECARDPLLCRGGTCTNTDGSYKCQCPPGHELTAKGTACEDIDECSLSDGLCPHGQCVNVIGAFQCSCHAGFQSTPDRQGCVDINECRVQNGGCDVHCINTEGSYRCSCGQGYSLMPDGRACADVDECEENPRVCDQGHCTNMPGGHRCLCYDGFMATPDMRTCVDVDECDLNPHICLHGDCENTKGSFVCHCQLGYMVRKGATGCSDVDECEVGGHNCDSHASCLNIPGSFSCRCLPGWVGDGFECHDLDECVSQEHRCSPRGDCLNVPGSYRCTCRQGFAGDGFFCEDRDECAENVDLCDNGQCLNAPGGYRCECEMGFDPTEDHRACQDVDECAQGNLCAFGSCENLPGMFRCICNGGYELDRGGGNCTDINECADPVNCINGVCINTPGSYLCSCPQDFELNPSGVGCVDTRAGNCFLETHDRGDSGISCSAEIGVGVTRASCCCSLGRAWGNPCELCPMANTTEYRTLCPGGEGFQPNRITVILEDIDECQELPGLCQGGDCVNTFGSFQCECPPGYHLSEHTRICEDIDECSTHSGICGPGTCYNTLGNYTCVCPAEYLQVNGGNNCMDMRKSVCFRHYNGTCQNELAFNVTRKMCCCSYNIGQAWNRPCEACPTPISPDYQILCGNQAPGFLTDIHTGKPLDIDECGEIPAICANGICINQIGSFRCECPAGFNYNSILLACEDVDECGSRESPCQQNADCINIPGSYRCKCTRGYKLSPGGACVGRNECREIPNVCSHGDCMDTEGSYMCLCHRGFQASADQTLCMDIDECDRQPCGNGTCKNIIGSYNCLCFPGFVVTHNGDCVDFDECTTLVGQVCRFGHCLNTAGSFHCLCQDGFELTADGKNCVDTNECLSLAGTCLPGTCQNLEGSFRCICPPGFQVQSDHCIDIDECSEEPNLCLFGTCTNSPGSFQCLCPPGFVLSDNGHRCFDTRQSFCFTRFEAGKCSVPKAFNTTKTRCCCSKRPGEGWGDPCELCPQEGSAAFQELCPFGHGAVPGPDDSREDVNECAENPGVCTNGVCVNTDGSFRCECPFGYSLDFTGINCVDTDECSVGHPCGQGTCTNVIGGFECACADGFEPGLMMTCEDIDECSLNPLLCAFRCHNTEGSYLCTCPAGYTLREDGAMCRDVDECADGQQDCHARGMECKNLIGTFACVCPPGMRPLPGSGEGCTDDNECHAQPDLCVNGRCVNTAGSFRCDCDEGFQPSPTLTECHDIRQGPCFAEVLQTMCRSLSSSSEAVTRAECCCGGGRGWGPRCELCPLPGTSAYRKLCPHGSGYTAEGRDVDECRMLAHLCAHGECINSLGSFRCHCQAGYTPDATATTCLDMDECSQVPKPCTFLCKNTKGSFLCSCPRGYLLEEDGRTCKDLDECTSRQHNCQFLCVNTVGAFTCRCPPGFTQHHQACFDNDECSAQPGPCGAHGHCHNTPGSFRCECHQGFTLVSSGHGCEDVNECDGPHRCQHGCQNQLGGYRCSCPQGFTQHSQWAQCVDENECALSPPTCGSASCRNTLGGFRCVCPSGFDFDQALGGCQEVDECAGRRGPCSYSCANTPGGFLCGCPQGYFRAGQGHCVSGLGFSPGPQDTPDKEELLSSEACYECKINGLSPRDRPRRSAHRDHQVNLATLDSEALLTLGLNLSHLGRAERILELRPALEGLEGRIRYVIVRGNEQGFFRMHHLRGVSSLQLGRRRPGPGTYRLEVVSHMAGPWGVQPEGQPGPWGQALRLKVQLQLL

SEQ ID NO: 5163 - protein, 2809 aa, Homo Sapiens; identical to SEQ ID NO: 5162

SEQ ID NO: 5164 - protein, 2809 aa, Homo Sapiens; identical to SEQ ID NO: 5162

SEQ ID NO: 5165 - protein, 171 aa, Homo Sapiens
  misc_feature (1)..(1): Xaa can be any naturally occurring amino acid
XFTRFEAGKCSVPKAFNTTKTRCCCSKRPGEGWGDPCELCPQEGSDVNECAENPGVCTNGVCVNTDGSFRCECPFGYSLDFTGINCVDTDECSVGHPCGQGTCTNVIGGFECACADGFEPGLMMTCEDIDECSLNPLLCAFRCHNTEGSYLCTCPAGYTLREDGAMCRDVD

SEQ ID NO: 5166 - protein, 188 aa, Homo Sapiens
  misc_feature (1)..(1): Xaa can be any naturally occurring amino acid
XYQILCGNQAPGFLTDIHTGKPLDVDECGSRESPCQQNADCINIPGSYRCKCTRGYKLSPGGACVGRNECREIPNVCSHGDCMDTEGSYMCLCHRGFQASADQTLCMDIDECDRQPCGNGTCKNIIGSYNCLCFPGFVVTHNGDCVDFDECTTLVGQVCRFGHCLNTAGSFHCLCQDGFELTADGKNC

SEQ ID NO: 5167 - protein, 627 aa, Homo Sapiens
MCVPRSGLILSCICLYCGVLLPVLLPNLPFLTCLSMSTLESVTYLPEKGLYCQRLPSSRTHGGTESLKGKNTENMGFYGTLKMIFYKMKRKLDHGSEVRSFSLGKKPCKVSEYTSTTGLVPCSATPTTFGDLRAANGQGQQRRRITSVQPPTGLQEWLKMFQSWSGPEKLLALDELIDSCEPTQVKHMMQVIEPQFQRDFISLLPKELALYVLSFLEPKDLLQAAQTCRYWRILAEDNLLWREKCKEEGIDEPLHIKRRKVIKPGFIHSPWKSAYIRQHRIDTNWRRGELKSPKVLKGHDDHVITCLQFCGNRIVSGSDDNTLKVWSAVTGKCLRTLVGHTGGVWSSQMRDNIIISGSTDRTLKVWNAETGECIHTLYGHTSTVRCMHLHEKRVVSGSRDATLRVWDIETGQCLHVLMGHVAAVRCVQYDGRRVVSGAYDFMVKVWDPETETCLHTLQGHTNRVYSLQFDGIHVVSGSLDTSIRVWDVETGNCIHTLTGHQSLTSGMELKDNILVSGNADSTVKIWDIKTGQCLQTLQGPNKHQSAVTCLQFNKNFVITSSDDGTVKLWDLKTGEFIRNLVTLESGGSGGVVWRIRASNTKLVCAVGSRNGTEETKLLVLDFDVDMK

SEQ ID NO: 5168 - protein, 627 aa, Homo Sapiens; identical to SEQ ID NO: 5167

SEQ ID NO: 5169 - protein, 70 aa, Homo Sapiens
MNQELLSVGSKRRRTGGSLRGNPSSSQVDEEQMNRVVEEEQQQQLRQQEEEHTARNGEVVGVEPRPGGQN

SEQ ID NO: 5170 - protein, 70 aa, Homo Sapiens; identical to SEQ ID NO: 5169

SEQ ID NO: 5171 - protein, 70 aa, Homo Sapiens; identical to SEQ ID NO: 5169

SEQ ID NO: 5172 - protein, 158 aa, Homo Sapiens
MNQELLSVGSKRRRTGGSLRGNPSSSQVDEEQMNRVVEEEQQQQLRQQEEEHTARNGEVVGVEPRPGGQNDSQQGQLEENNNRFISVDEDSSGNQEEQEEDEEHAGEQDEEDEEEEEMDQESDDFDQSDDSSREDEHTHTNSVTNSSSIVDLPVHQLS

SEQ ID NO: 5173 - protein, 707 aa, Homo Sapiens
MNQELLSVGSKRRRTGGSLRGNPSSSQVDEEQMNRVVEEEQQQQLRQQEEEHTARNGEVVGVEPRPGGQNDSQQGQLEENNNRFISVDEDSSGNQEEQEEDEEHAGEQDEEDEEEEEMDQESDDFDQSDDSSREDEHTHTNSVTNSSSIVDLPVHQLSSPFYTKTTKMKRKLDHGSEVRSFSLGKKPCKVSEYTSTTGLVPCSATPTTFGDLRAANGQGQQRRRITSVQPPTGLQEWLKMFQSWSGPEKLLALDELIDSCEPTQVKHMMQVIEPQFQRDFISLLPKELALYVLSFLEPKDLLQAAQTCRYWRILAEDNLLWREKCKEEGIDEPLHIKRRKVIKPGFIHSPWKSAYIRQHRIDTNWRRGELKSPKVLKGHDDHVITCLQFCGNRIVSGSDDNTLKVWSAVTGKCLRTLVGHTGGVWSSQMRDNIIISGSTDRTLKVWNAETGECIHTLYGHTSTVRCMHLHEKRVVSGSRDATLRVWDIETGQCLHVLMGHVAAVRCVQYDGRRVVSGAYDFMVKVWDPETETCLHTLQGHTNRVYSLQFDGIHVVSGSLDTSIRVWDVETGNCIHTLTGHQSLTSGMELKDNILVSGNADSTVKIWDIKTGQCLQTLQGPNKHQSAVTCLQFNKNFVITSSDDGTVKLWDLKTGEFIRNLVTLESGGSGGVVWRIRASNTKLVCAVGSRNGTEETKLLVLDFDVDMK

SEQ ID NO: 5174 - protein, 707 aa, Homo Sapiens; identical to SEQ ID NO: 5173

SEQ ID NO: 5175 - protein, 707 aa, Homo Sapiens; identical to SEQ ID NO: 5173

SEQ ID NO: 5176 - protein, 176 aa, Homo Sapiens
MNQELLSVGSKRRRTGGSLRGNPSSSQVDEEQMNRVVEEEQQQQLRQQEEEHTARNGEVVGVEPRPGGQNDSQQGQLEENNNRFISVDEDSSGNQEEQEEDEEHAGEQDEEDEEEEEMDQESDDFDQSDDSSREDEHTHTNSVTNSSSIVDLPVHQLSSPFYTKTTKVSIFNILLT

SEQ ID NO: 5177 - protein, 589 aa, Homo Sapiens
MSKPGKPTLNHGLVPVDLKSAKEPLPHQTVMKIFSISIIAQGLPFCRRRMKRKLDHGSEVRSFSLGKKPCKVSEYTSTTGLVPCSATPTTFGDLRAANGQGQQRRRITSVQPPTGLQEWLKMFQSWSGPEKLLALDELIDSCEPTQVKHMMQVIEPQFQRDFISLLPKELALYVLSFLEPKDLLQAAQTCRYWRILAEDNLLWREKCKEEGIDEPLHIKRRKVIKPGFIHSPWKSAYIRQHRIDTNWRRGELKSPKVLKGHDDHVITCLQFCGNRIVSGSDDNTLKVWSAVTGKCLRTLVGHTGGVWSSQMRDNIIISGSTDRTLKVWNAETGECIHTLYGHTSTVRCMHLHEKRVVSGSRDATLRVWDIETGQCLHVLMGHVAAVRCVQYDGRRVVSGAYDFMVKVWDPETETCLHTLQGHTNRVYSLQFDGIHVVSGSLDTSIRVWDVETGNCIHTLTGHQSLTSGMELKDNILVSGNADSTVKIWDIKTGQCLQTLQGPNKHQSAVTCLQFNKNFVITSSDDGTVKLWDLKTGEFIRNLVTLESGGSGGVVWRIRASNTKLVCAVGSRNGTEETKLLVLDFDVDMK

SEQ ID NO: 5178 - protein, 179 aa, Homo Sapiens
MDPKQTTLLCLGDFPMPFISAKSSPVIPLDGSVKIQCQAIREAYLTQLMIIKNSTYREIGRRLKFWNETDPEFVIDHMDANKAGRYQCQYRIGHYRFRYSDTLELVVTDSIHQDYTTQNLIRMAVAGLVLVALLAILVENWHSHTALNKEASADVAEPSWSQQMCQPGLTFARTPSVCK

SEQ ID NO: 5179 - protein, 253 aa, Homo Sapiens
MDPKQTTLLCLGDFPMPFISAKSSPVIPLDGSVKIQCQAIREAYLTQLMIIKNSTYREIGRRLKFWNETDPEFVIDHMDANKAGRYQCQYRIGHYRFRYSDTLELVVTGLYGKPFLSADRGLVLMPGENISLTCSSAHIPFDRFSLAKEGELSLPQHQSGEHPANFSLGPVDLNVSGIYRCYDSIHQDYTTQNLIRMAVAGLVLVALLAILVENWHSHTALNKEASADVAEPSWSQQMCQPGLTFARTPSVCK

SEQ ID NO: 5180 - protein, 275 aa, Homo Sapiens
MDPKQTTLLCLGDFPMPFISAKSSPVIPLDGSVKIQCQAIREAYLTQLMIIKNSTYREIGRRLKFWNETDPEFVIDHMDANKAGRYQCQYRIGHYRFRYSDTLELVVTGLYGKPFLSADRGLVLMPGENISLTCSSAHIPFDRFSLAKEGELSLPQHQSGEHPANFSLGPVDLNVSGIYRCYGWYNRSPYLWSFPSNALELVVTDSIHQDYTTQNLIRMAVAGLVLVALLAILVENWHSHTALNKEASADVAEPSWSQQMCQPGLTFARTPSVCK

SEQ ID NO: 5181 - protein, 227 aa, Homo Sapiens
MDPKQTTLLCLGDFPMPFISAKSSPVIPLDGSVKIQCQAIREAYLTQLMIIKNSTYREIGRRLKFWNETDPEFVIDHMDANKAGRYQCQYRIGHYRFRYSDTLELVVTGLYGKPFLSADRGLVLMPGENISLTCSSAHIPFDRFSLAKEGELSLPQHQSGEHPANFSLGPVDLNVSGIYRCYGWYNRSPYLWSFPSNALELVVTGRYRPVQPCVWVGCPGPCHRAGI

SEQ ID NO: 5182 - protein, 209 aa, Homo Sapiens
MDPKQTTLLCLGDFPMPFISAKSSPVIPLDGSVKIQCQAIREAYLTQLMIIKNSTYREIGRRLKFWNETDPEFVIDHMDANKAGRYQCQYRIGHYRFRYSDTLELVVTGLYGKPFLSADRGLVLMPGENISLTCSSAHIPFDRFSLAKEGELSLPQHQSGEHPANFSLGPVDLNVSGIYRLHPPRLHDAELDPHGRGRTGPRGSLGHTG

SEQ ID NO: 5183 - protein, 178 aa, Homo Sapiens
MDPKQTTLLCLGLYGKPFLSADRGLVLMPGENISLTCSSAHIPFDRFSLAKEGELSLPQHQSGEHPANFSLGPVDLNVSGIYRCYGWYNRSPYLWSFPSNALELVVTDSIHQDYTTQNLIRMAVAGLVLVALLAILVENWHSHTALNKEASADVAEPSWSQQMCQPGLTFARTPSVCK

SEQ ID NO: 5184 - protein, 191 aa, Homo Sapiens
MDPKQTTLLCLVLCLGQRIQAQEGDFPMPFISAKSSPVIPLDGSVKIQCQAIREAYLTQLMIIKNSTYREIGRRLKFWNETDPEFVIDHMDANKAGRYQCQYRIGHYRFRYSDTLELVVTDSIHQDYTTQNLIRMAVAGLVLVALLAILVENWHSHTALNKEASADVAEPSWSQQMCQPGLTFARTPSVCK

SEQ ID NO: 5185 - protein, 265 aa, Homo Sapiens
MDPKQTTLLCLVLCLGQRIQAQEGDFPMPFISAKSSPVIPLDGSVKIQCQAIREAYLTQLMIIKNSTYREIGRRLKFWNETDPEFVIDHMDANKAGRYQCQYRIGHYRFRYSDTLELVVTGLYGKPFLSADRGLVLMPGENISLTCSSAHIPFDRFSLAKEGELSLPQHQSGEHPANFSLGPVDLNVSGIYRCYDSIHQDYTTQNLIRMAVAGLVLVALLAILVENWHSHTALNKEASADVAEPSWSQQMCQPGLTFARTPSVCK

SEQ ID NO: 5186 - protein, 287 aa, Homo Sapiens
MDPKQTTLLCLVLCLGQRIQAQEGDFPMPFISAKSSPVIPLDGSVKIQCQAIREAYLTQLMIIKNSTYREIGRRLKFWNETDPEFVIDHMDANKAGRYQCQYRIGHYRFRYSDTLELVVTGLYGKPFLSADRGLVLMPGENISLTCSSAHIPFDRFSLAKEGELSLPQHQSGEHPANFSLGPVDLNVSGIYRCYGWYNRSPYLWSFPSNALELVVTDSIHQDYTTQNLIRMAVAGLVLVALLAILVENWHSHTALNKEASADVAEPSWSQQMCQPGLTFARTPSVCK

SEQ ID NO: 5187 - protein, 239 aa, Homo Sapiens
MDPKQTTLLCLVLCLGQRIQAQEGDFPMPFISAKSSPVIPLDGSVKIQCQAIREAYLTQLMIIKNSTYREIGRRLKFWNETDPEFVIDHMDANKAGRYQCQYRIGHYRFRYSDTLELVVTGLYGKPFLSADRGLVLMPGENISLTCSSAHIPFDRFSLAKEGELSLPQHQSGEHPANFSLGPVDLNVSGIYRCYGWYNRSPYLWSFPSNALELVVTGRYRPVQPCVWVGCPGPCHRAGI

SEQ ID NO: 5188 - protein, 1642 aa, Homo Sapiens
CPPHSHYEACSYGCPLSCGDLPVPEGCESACREGCVCDAGFVLSGDTCVPVGQCGCLHDDRYYPLGQTFYPGPGCDSLCRCREGGEVSCEPSSCGPHETCRPSGGSLGCVAVGSTTCQASGDPHYTTFDGHRFDFMGTCVYVLAQTCGTRPGLHRFAVLQENVAWGNGRVSVTRVITVQVANFTLRLEQRQWKVTVNGVDMKLPVVLANGQIRASQHGSDVVIETDFGLRVAYDLVYYVRVTVPGNYYQLMCGLCGNYNGDPKDDFQKPNGSQAGNANEFGNSWEEVVSDSPCLPPPTCPPGSEGCIPSEECPPELEKKYQKEEFCGLLSSPTGPLSSCHKLVDPQGPLKDCIFDLCLGGGNLSILCSNIHAYVSACQVAGGHVEPWRNETFCPMECPQNSHYELCADTCSLGCSALSAPLQCPDGCAEGCQCDSGFLYNGQACVPIQQCGCYHNGAYYEPEQTVLIDNCRQQCTCHAGKVVVCQEHSCKPGQVCQPSGGILSCVTKDPCHGVTCRPQETCKEQGGQGVCLPNYEATCWLWGDPHYHSFDGRKFDFQGTCNYVLATTGCPGVSTQGLTPFTVTTKNQNRGNPAVSYVRVVTVAALGTNISIHKDEIGKVRVNGVLTALPVSVADGRISVTQGASKALLVADFGLQVSYDWNWRVDVTLPSSYHGAVCGLCGNMDRNPNNDQVFPNGTLAPSIPIWGGSWRAPGWDPLCWDECRGSCPTCPEDRLEQYEGPGFCGPLAPGTGGPFTTCHAHVPPESFFKGCVLDVCMGGGDRDILCKALASYVAACQAAGVVIEDWRAQVGCEITCPENSHYEVCGPPCPASCPSPAPLTTPAVCEGPCVEGCQCDAGFVLSADRCVPLNNGCGCWANGTYHEAGSEFWADGTCSQWCRCGPGGGSLVCTPASCGLGEVCGLLPSGQHGCQPVSTAECQAWGDPHYVTLDGHRFDFQGTCEYLLSAPCHGPPLGAENFTVTVANEHRGSQAVSYTRSVTLQIYNHSLTLSARWPRKLQVDGVFVTLPFQLDSLLHAHLSGADVVVTTTSGLSLAFDGDSFVRLRVPAAYAGSLCGLCGNYNQDPADDLKAVGGKPAGWQVGGAQGCGECVSKPCPSPCTPEQQESFGGPDACGVISATDGPLAPCHGLVPPAQYFQGCLLDACQVQGHPGGLCPAVATYVAACQAAGAQLREWRRPDFCPFQCPAHSHYELCGDSCPGSCPSLSAPEGCESACREGCVCDAGFVLSGDTCVPVGQCGCLHDDRYYPLGQTFYPGPGCDSLCRCREGGEVSCEPSSCGPHETCRPSGGSLGCVAVGSTTCQASGDPHYTTFDGHRFDFMGTCVYVLAQTCGTRPGLHRFAVLQENVAWGNGRVSVTRVITVQVANFTLRLEQRQWKVTVNGVDMKLPVVLANGQIRASQHGSDVVIETDFGLRVAYDLVYYVRVTVPGNYYQLMCGLCGNYNGDPKDDFQKPNGSQAGNANEFGNSWEEVVPDSPCLPPPTCPPGSAGCIPSDKCPPELEKKYQKEEFCGLLSSPTGPLSSCHKLVDPQGPLKDCIFDLCLGGGNLSILCSNIHAYVSACQAAGGHVEPWRNETFCPMECPQNSHYELCADTCSLGCSALSAPLQCPDGCAEGCQCDSGFLYNG

SEQ ID NO: 5189 - protein, 1132 aa, Homo Sapiens
MGALWSWWILWAGATLLWGLTQEASVDLKNTGREEFLTAFLQNYQLAYSKAYPRLLISSLSESPASVSILSQADNTSKKVTVRPGESVMVNISAKAEMIGSKIFQHAVVIHSDYAISVQALNAKPDTAELTLLRPIQALGTEYFVLTPPGTSARNVKEFAVVAGAAGASVSVTLKGSVTFNGKFYPAGDVLRVTLQPYNVAQLQSSVDLSGSKVTASSPVAVLSGHSCAQKHTTCNHVVEQLLPTSAWGTHYVVPTLASQSRYDLAFVVASQATKLTYNHGGITGSRGLQAGDVVEFEVRPSWPLYLSANVGIQVLLFGTGAIRNEVTYDPYLVLIPDVAAYCPAYVVKSVPGCEGVALVVAQTKAISGLTIDGHAVGAKLTWEAVPGSEFSYAEVELGTADMIHTAEATTNLGLLTFGLAKAIGYATAADCGRTVLSPVEPSCEGMQCAAGQRCQVVGGKAGCVAESTAVCRAQGDPHYTTFDGRRYDMMGTCSYTMVELCSEDDTLPAFSVEAKNEHRGSRRVSYVGLVTVRAYSHSVSLTRGEVGFVLVDNQRSRLPVSLSEGRLRVYQSGPRAVVELVFGLVVTYDWDCQLALSLPARFQDQVCGLCGNYNGDPADDFLTPDGALAPDAVEFASSWKLDDGDYLCEDGCQNNCPACTPGQAQHYEGDRLCGMLTKLDGPFAVCHDTLDPRPFLEQCVYDLCVVGGERLSLCRGLSAYAQACLELGISVGDWRSPANCPLSCPANSRYELCGPACPTSCNGAAAPSNCSGRPCVEGCVCLPGFVASGGACVPASSCGCTFQGLQLAPGQEVWADELCQRRCTCNGATHQVTCRDKQSCPAGERCSVQNGLLGCYPDRFGTCQGSGDPHYVSFDGRRFDFMGTCTYLLVGSCGQNAALPAFRVLVENEHRGSQTVSYTRAVRVEARGVKVAVRREYPGQVLVDDVLQYLPFQAADGQVQVFRQGRDAVVRTDFGLTVTYDWNARVTAKVPSSYAEALCGLCGNFNGDPADDLALRGGGQAANALAFGNSWQEETRPGCGATEPGDCPKLDSLVAQQLQSKNECGILADPKGPFRECHSKLDPQGAVRDCVYDRCLLPGQSGPLCDALATYAAACQAAGATVHPWRSEELC

SEQ ID NO: 5190 - protein, 3072 aa, Homo Sapiens
  misc_feature (1)..(1): Xaa can be any naturally occurring amino acid
XLSCPPHSHYEACSYGCPLSCGDLPVPEGCESACREGCVCDAGFVLSGDTCVPVGQCGCLHDDRYYPLGQTFYPGPGCDSLCRCREGGEVSCEPSSCGPHETCRPSGGSLGCVAVGSTTCQASGDPHYTTFDGHRFDFMGTCVYVLAQTCGTRPGLHRFAVLQENVAWGNGRVSVTRVITVQVANFTLRLEQRQWKVTVNGVDMKLPVVLANGQIRASQHGSDVVIETDFGLRVAYDLVYYVRVTVPGNYYQLMCGLCGNYNGDPKDDFQKPNGSQAGNANEFGNSWEEVVSDSPCLPPPTCPPGSEGCIPSEECPPELEKKYQKEEFCGLLSSPTGPLSSCHKLVDPQGPLKDCIFDLCLGGGNLSILCSNIHAYVSACQVAGGHVEPWRNETFCPMECPQNSHYELCADTCSLGCSALSAPLQCPDGCAEGCQCDSGFLYNGQACVPIQQCGCYHNGAYYEPEQTVLIDNCRQQCTCHAGKVVVCQEHSCKPGQVCQPSGGILSCVTKDPCHGVTCRPQETCKEQGGQGVCLPNYEATCWLWGDPHYHSFDGRKFDFQGTCNYVLATTGCPGVSTQGLTPFTVTTKNQNRGNPAVSYVRVVTVAALGTNISIHKDEIGKVRVNGVLTALPVSVADGRISVTQGASKALLVADFGLQVSYDWNWRVDVTLPSSYHGAVCGLCGNMDRNPNNDQVFPNGTLAPSIPIWGGSWRAPGWDPLCWDECRGSCPTCPEDRLEQYEGPGFCGPLAPGTGGPFTTCHAHVPPESFFKGCVLDVCMGGGDRDILCKALASYVAACQAAGVVIEDWRAQVGCEITCPENSHYEVCGPPCPASCPSPAPLTTPAVCEGPCVEGCQCDAGFVLSADRCVPLNNGCGCWANGTYHEAGSEFWADGTCSQWCRCGPGGGSLVCTPASCGLGEVCGLLPSGQHGCQPVSTAECQAWGDPHYVTLDGHRFDFQGTCEYLLSAPCHGPPLGAENFTVTVANEHRGSQAVSYTRSVTLQIYNHSLTLSARWPRKLQVDGVFVTLPFQLDSLLHAHLSGADVVVTTTSGLSLAFDGDSFVRLRVPAAYAGSLCGLCGNYNQDPADDLKAVGGKPAGWQVGGAQGCGECVSKPCPSPCTPEQQESFGGPDACGVISATDGPLAPCHGLVPPAQYFQGCLLDACQVQGHPGGLCPAVATYVAACQAAGAQLREWRRPDFCPFQCPAHSHYELCGDSCPGSCPSLSAPEGCESACREGCVCDAGFVLSGDTCVPVGQCGCLHDDRYYPLGQTFYPGPGCDSLCRCREGGEVSCEPSSCGPHETCRPSGGSLGCVAVGSTTCQASGDPHYTTFDGHRFDFMGTCVYVLAQTCGTRPGLHRFAVLQENVAWGNGRVSVTRVITVQVANFTLRLEQRQWKVTVNGVDMKLPVVLANGQIRASQHGSDVVIETDFGLRVAYDLVYYVRVTVPGNYYQLMCGLCGNYNGDPKDDFQKPNGSQAGNANEFGNSWEEVVPDSPCLPPPTCPPGSAGCIPSDKCPPELEKKYQKEEFCGLLSSPTGPLSSCHKLVDPQGPLKDCIFDLCLGGGNLSILCSNIHAYVSACQAAGGHVEPWRNETFCPMECPQNSHYELCADTCSLGCSALSAPLQCPDGCAEGCQCDSGFLYNGQACVPIQQCGCYHNGVYYEPEQTVLIDNCRQQCTCHVGKVVVCQEHSCKPGQVCQPSGGILSCVTKDPCHGVTCRPQETCKEQGGQGVCLPNYEATCWLWGDPHYHSFDGRKFDFQGTCNYVLATTGCPGVSTQGLTPFTVTTKNQNRGNPAVSYVRVVTVAALGTNISIHKDEIGKVRVNGVLTALPVSVADGRISVAQGASKALLVADFGLQVSYDWNWRVDVTLPSSYHGAVCGLCGNMDRNPNNDQVFPNGTLAPSIPIWGGSWRAPGWDPLCWDECRGSCPTCPEDRLEQYEGPGFCGPLSSGTGGPFTTCHAHVPPESFFKGCVLDVCMGGGDRDILCKALASYVAACQAAGVVIEDWRAQVGCEITCPENSHYEVCGPPCPASCPSPAPLTTPAVCEGPCVEGCQCDAGFVLSADRCVPLNNGCGCWANGTYHEAGSEFWADGTCSQWCRCGPGGGSLVCTPASCGLGEVCGLLPSGQHGCQPVSTAECQAWGDPHYVTLDGHRFDFQGTCEYLLSAPCHGPPLGAENFTVTVANEHRGSQAVSYTRSVTLQIYNHSLTLSARWPRKLQVDGVFVALPFQLDSLLHAHLSGADVVVTTTSGLSLAFDGDSFVRLRVPAAYAASLCGLCGNYNQDPADDLKAVGGKPAGWQVGGAQGCGECVSKPCPSPCTPEQQESFGGPDACGVISATDGPLAPCHGLVPPAQYFQGCLLDACQVQGHPGGLCPAVATYVAACQAAGAQLGEWRRPDFCPLQCPAHSHYELCGDSCPVSCPSLSAPEGCESACREGCVCDAGFVLSGDTCVPVGQCGCLHDGRYYPLGEVFYPGPECERRCECGPGGHVTCQEGAACGPHEECRLEDGVQACHATGCGRCLANGGIHYITLDGRVYDLHGSCSYVLAQVCHPKPGDEDFSIVLEKNAAGDLQRLLVTVAGQVVSLAQGQQVTVDGEAVALPVAVGRVRVTAEGRNMVLQTTKGLRLLFDGDAHLLMSIPSPFRGRLCGLCGNFNGNWSDDFVLPNGSAASSVETFGAAWRAPGSSKGCGEGCGPQGCPVCLAEETAPYESNEACGQLRNPQGPFATCQAVLSPSEYFRQCVYDLCAQKGDKAFLCRSLAAYTAACQAAGVAVKPWRTDSFCPLHCPAHSHYSICTRTCQGSCAALSGLTGCTTRCFEGCECDDRFLLSQGVCIPVQDCGCTHNGRYLPVNSSLLTSDCSERCSCSSSSGLTCQAAGCPPGRVCEVKAEARNCWATRGLCVLSVGANLTTFDGARGATTSPGVYELSSRCPGLQNTIPWYRVVAEVQICHGKTEAVGQVHIFFQDGMVTLTPNKGVWVNGLRVDLPAEKLASVSVSRTPDGSLLVRQKAGVQVWLGANGKVAVIVSNDHAGKLCGACGNFDGDQTNDWHDSQEKPAMEKWRAQDFSPCYG

SEQ ID NO: 5191 - protein, 250 aa, Homo Sapiens
MGKWPPWVSVFQEETITLHCEVLHLPGSSSTQWFLNGTATQTSTPSYRITSASVNDSGEYRCQRGLSGRSDPIQLEIHRGWLLLQVSSRVFMEGEPLALRCHAWKDKLVYNVLYYRNGKAFKFFHWNSNLTILKTNISHNGTYHCSGMGKHRYTSAGISQYTVKGLQLPTPVWFHVLFYLAVGIMFLVNTVLWVTIRKELKRKKKWNLEISLDSGHEKKVISSLQEDRHLEEELKCQEQKEEQLQEGVHR

SEQ ID NO: 5192 - protein, 188 aa, Homo Sapiens
MWFLTTLLLWGWLLLQVSSRVFMEGEPLALRCHAWKDKLVYNVLYYRNGKAFKFFHWNSNLTILKTNISHNGTYHCSGMGKHRYTSAGISQYTVKGLQLPTPVWFHVLFYLAVGIMFLVNTVLWVTIRKELKRKKKWNLEISLDSGHEKKVISSLQEDRHLEEELKCQEQKEEQLQEGVHRKEPQGAT

SEQ ID NO: 5193 - protein, 224 aa, Homo Sapiens
MWFLTTLLLWVPVDGQVDTTKAVITLQPPWVSVFQEETITLHCEVLHLPGSSSTQWFLNGTATQTSTPSYRITSASVNDSGEYRCQRGLSGRSDPIQLEIHRGWLLLQVSSRVFMEGEPLALRCHAWKDKLVYNVLYYRNGKAFKFFHWNSNLTILKTNISHNGTYHCSGMGKHRYTSAGISQYTVKELFPAPVLNASVTSPLLEGNLVTLSCETKLLLQRPGL

SEQ ID NO: 5194 - protein, 224 aa, Homo Sapiens; identical to SEQ ID NO: 5193

SEQ ID NO: 5195 - protein, 280 aa, Homo Sapiens
MWFLTTLLLWVPVDGQVDTTKAVITLQPPWVSVFQEETITLHCEVLHLPGSSSTQWFLNGTATQTSTPSYRITSASVNDSGEYRCQRGLSGRSDPIQLEIHRGWLLLQVSSRVFMEGEPLALRCHAWKDKLVYNVLYYRNGKAFKFFHWNSNLTILKTNISHNGTYHCSGMGKHRYTSAGISQYTVKGLQLPTPVWFHVLFYLAVGIMFLVNTVLWVTIRKELKRKKKWNLEISLDSGHEKKVISSLQEDRHLEEELKCQEQKEEQLQEGVHRKEPQGAT

SEQ ID NO: 5196 - protein, 225 aa, Homo Sapiens
MWFLTTLLLWVPVDGQVVDTTKAVITLQPPWVSVFQEETITLHCEVLHLPGSSSTQWFLNGTATQTSTPSYRITSASVNDSGEYRCQRGLSGRSDPIQLEIHRGWLLLQVSSRVFMEGEPLALRCHAWKDKLVYNVLYYRNGKAFKFFHWNSNLTILKTNISHNGTYHCSGMGKHRYTSAGISQYTVKELFPAPVLNASVTSPLLEGNLVTLSCETKLLLQRPGL

SEQ ID NO: 5197 - protein, 359 aa, Homo Sapiens
MAEGTLWQILCVSSDAQPQTFEGVKGADPPTLPPGSFLPGPVLWWGSLARLQTEKSDEVSRKGNWWVTEMGGGAGERLFTSSCLVGLVPLGLRISLVTCPLQCGIMWQLLLPTALLLLVSAGMRTEDLPKAVVFLEPQWYRVLEKDSVTLKCQGAYSPEDNSTQWFHNESLISSQASSYFIDAATVDDSGEYRCQTNLSTLSDPVQLEVHIGWLLLQAPRWVFKEEDPIHLRCHSWKNTALHKVTYLQNGKGRKYFHHNSDFYIPKATLKDSGSYFCRGLFGSKNVSSETVNITITQGLAVSTISSFFPPGYQVSFCLVMVLLFAVDTGLYFSVKTNIRSSTRDWKDHKFKWRKDPQDK

SEQ ID NO: 5198 - protein, 290 aa, Homo Sapiens
MGGGAGERLFTSSCLVGLVPLGLRISLVTCPLQCGIMWQLLLPTALLLLVSAGMRTEDLPKAVVFLEPQWYRVLEKDSVTLKCQGAYSPEDNSTQWFHNESLISSQASSYFIDAATVDDSGEYRCQTNLSTLSDPVQLEVHIGWLLLQAPRWVFKEEDPIHLRCHSWKNTALHKVTYLQNGKGRKYFHHNSDFYIPKATLKDSGSYFCRGLFGSKNVSSETVNITITQGLAVSTISSFFPPGYQVSFCLVMVLLFAVDTGLYFSVKTNIRSSTRDWKDHKFKWRKDPQDK

SEQ ID NO: 5199 - protein, 105 aa, Homo Sapiens
MWQLLLPTALLLLVSAGMRTDLPKAVVFLEPQWYRVLEKDSVTLKCQGAYSPEDNSTQWFHNESLISSQASSYFIDAATVDDSGEYRCQTNLSTLSDPVQLEVHI

SEQ ID NO: 5200 - protein, 254 aa, Homo Sapiens
MWQLLLPTALLLLVSAGMRTEDLPKAVVFLEPQWYRVLEKDSVTLKCQGAYSPEDNSTQWFHNESLISSQASSYFIDAATVDDSGEYRCQTNLSTLSDPVQLEVHIGWLLLQAPRWVFKEEDPIHLRCHSWKNTALHKVTYLQNGKGRKYFHHNSDFYIPKATLKDSGSYFCRGLFGSKNVSSETVNITITQGLAVSTISSFFPPGYQVSFCLVMVLLFAVDTGLYFSVKTNIRSSTRDWKDHKFKWRKDPQDK

SEQ ID NO: 5201 - protein, 254 aa, Homo Sapiens; identical to SEQ ID NO: 5200

SEQ ID NO: 5202 - protein, 254 aa, Homo Sapiens; identical to SEQ ID NO: 5200

SEQ ID NO: 5203 - protein, 307 aa, Homo Sapiens
QTEKSDEVSRKGNWWVTEMGGGAGERLFTSSCLVGLVPLGLRISLVTCPLQCGIMWQLLLPTALLLLVSAGMRTDLPKAVVFLEPQWYRVLEKDSVTLKCQGAYSPEDNSTQWFHNESLISSQASSYFIDAATVDDSGEYRCQTNLSTLSDPVQLEVHIGWLLLQAPRWVFKEEDPIHLRCHSWKNTALHKVTYLQNGKGRKYFHHNSDFYIPKATLKDSGSYFCRGLFGSKNVSSETVNITITQGLAVSTISSFFPPGYQVSFCLVMVLLFAVDTGLYFSVKTNIRSSTRDWKDHKFKWRKDPQDK

SEQ ID NO: 5204 - protein, 211 aa, Homo Sapiens
GVPRPQPWALGLLLFLLPGSLGAESHLSLLYHLTAVSSPAPGTPAFWVSGWLGPQQYLSYNSLRGEAEPCGAWVWENQVSWYWEKETTDLRIKEKLFLEAFKALGGKGPYTLQGLLGCELGPDNTSVPTAKFALNGEEFMNFDLKQGTWGGDWPEALAISQRWQQQDKAANKELTFLLFSCPHRLREHLERGRGNLEWKEPKARQIFCAWI

SEQ ID NO: 5205 - protein, 273 aa, Homo Sapiens
MGVPRPQPWALGLLLFLLPGSLGAESHLSLLYHLTAVSSPAPGTPAFWVSGWLGPQQYLSYNSLRGEAEPCGAWVWENQVSWYWEKETTDLRIKEKLFLEAFKALGGKEPPSMRLKARPSSPGFSVLTCSAFSFYPPELQLRFLRNGLAAGTGQGDFGPNSDGSFHASSSLTVKSGDEHHYCCIVQHAGLAQPLRVELESPAKSSVLVVGIVIGVLLLTAAAVGGALLWRRMRSGLPAPWISLRGDDTGVLLPTPGEAQDADLKDVNVIPATA

SEQ ID NO: 5206 - protein, 141 aa, Homo Sapiens
MGVPRPQPWALGLLLFLLPGSLGAESHLSLLYHLTAVSSPAPGTPAFWVSGWLGPQQYLSYNSLRGEAEPCGAWVWENQVSWYWEKETTDLRIKEKLFLEAFKALGGKGPYTLQGLLGCELGPDNTSVPTAKFALNGEEFM

SEQ ID NO: 5207 - protein, 167 aa, Homo Sapiens
MGVPRPQPWALGLLLFLLPGSLGAESHLSLLYHLTAVSSPAPGTPAFWVSGWLGPQQYLSYNSLRGEAEPCGAWVWENQVSWYWEKETTDLRIKEKLFLEAFKALGGKGPYTLQGLLGCELGPDNTSVPTAKFALNGEEFMNFDLKQGTWGGDWPEALAISQRWQQQ

SEQ ID NO: 5208 - protein, 225 aa, Homo Sapiens
MGVPRPQPWALGLLLFLLPGSLGAESHLSLLYHLTAVSSPAPGTPAFWVSGWLGPQQYLSYNSLRGEAEPCGAWVWENQVSWYWEKETTDLRIKEKLFLEAFKALGGKGPYTLQGLLGCELGPDNTSVPTAKFALNGEEFMNFDLKQGTWGGDWPEALAISQRWQQQDKAANKELTFLLFSCPHRLREHLERGRGNLEWKDTVSHYVAQAGLELLGSSDSPALVS

SEQ ID NO: 5209 - protein, 365 aa, Homo Sapiens
MGVPRPQPWALGLLLFLLPGSLGAESHLSLLYHLTAVSSPAPGTPAFWVSGWLGPQQYLSYNSLRGEAEPCGAWVWENQVSWYWEKETTDLRIKEKLFLEAFKALGGKGPYTLQGLLGCELGPDNTSVPTAKFALNGEEFMNFDLKQGTWGGDWPEALAISQRWQQQDKAANKELTFLLFSCPHRLREHLERGRGNLEWKEPPSMRLKARPSSPGFSVLTCSAFSFYPPELQLRFLRNGLAAGTGQGDFGPNSDGSFHASSSLTVKSGDEHHYCCIVQHAGLAQPLRVELESPAKSSVLVVGIVIGVLLLTAAAVGGALLWRRMRSGLPAPWISLRGDDTGVLLPTPGEAQDADLKDVNVIPATA

SEQ ID NO: 5210 - protein, 365 aa, Homo Sapiens; identical to SEQ ID NO: 5209

SEQ ID NO: 5211 - protein, 99 aa, Homo Sapiens
MGVPRPQPWALGLLLFLLPGSLGAESPAKSSVLVVGIVIGVLLLTAAAVGGALLWRRMRSGLPAPWISLRGDDTGVLLPTPGEAQDADLKDVNVIPATA

SEQ ID NO: 5212 - protein, 39 aa, Homo Sapiens
MNFDLKQGTWGGDWPEALAISQRWQQQDKAANKELTFLL

SEQ ID NO: 5213 - protein, 153 aa, Homo Sapiens
WEKETTDLRIKEKLFLEAFKALGGKGPYTLQGLLGCELGPDNTSVPTAKFALNGEEFMNFDLKQGTWGGDWPEALAISQRWQQQDKAANKELTFLLFSCPHRLREHLERGRGNLEWKAPWISLRGDDTGVLLPTPGEAQDADLKDVNVIPATA

SEQ ID NO: 5214 - protein, 189 aa, Homo Sapiens
  misc_feature (1)..(1): Xaa can be any naturally occurring amino acid
XSSPAPGTPAFWVSGWLGPQQYLSYNSLRGEAEPCGAWVWENQVSWYWEKETTDLRIKEKLFLEAFKALGGKGPYTLQGLLGCELGPDNTSVPTAKFALNGEEFMNFDLKQGTWGGDWPEALAISQRWQQQDKAANKELTFLLFSCPHRLREHLERGRGNLEWKAPSPSTLRSCNFGSCGMGWPLAPAR

SEQ ID NO: 5215 - protein, 141 aa, Homo Sapiens
MDFWLWPLYFLPEMESCCVAQDGLELVALSDPPGSASQSAGITVSGALRILPEVKVEGELGGSVTIKCPLPEMHVRIYLCREMAGSGTCGTVVSTTNFIKAEYKGRVTLKQYPRKNLFLVEVTQLTESDSGVYACGAGMNT

SEQ ID NO: 5216 - protein, 278 aa, Homo Sapiens
MDFWLWPLYFLPEYEPSWEEQPMPETPKWFHLPYLFQMPAYASSSKFVTRVTTPAQRGKVPPVHHSSPTTQITHRPRVSRASSVAGDKPRTFLPSTTASKISALEGLLKPQTPSYNHHTRLHRQRALDYGSQSGREGQGFHILIPTILGLFLLALLGLVVKRAVERRKALSRRARRLAVRMRALESSQRPRGSPRPRSQNNIYSACPRRARGADAAGTGEAPVPGPGAPLPPAPLQVSESPWLHAPSLKTSCEYVSLYHQPAAMMEDSDSDDYINVPA

SEQ ID NO: 5217 - protein, 125 aa, Homo Sapiens
MDFWLWPLYFLPVSGALRILPEVKVEGELGGSVTIKCPLPEMHVRIYLCREMAGSGTCGTVVSTTNFIKAEYKGRVTLKQYPRKNLFLVENTSHHGKSSQCLRLQNGFICPICSRCLHMPVLPNS

SEQ ID NO: 5218 - protein, 147 aa, Homo Sapiens
MDFWLWPLYFLPVSGALRILPEVKVEGELGGSVTIKCPLPEMHVRIYLCREMAGSGTCGTVVSTTNFIKAEYKGRVTLKQYPRKNLFLVEVTQLTESDSGVYACGAGMNTDRGKTQKVTLNVHSEYEPSWEEQPMPETPKWFHLPYL

SEQ ID NO: 5219 - protein, 151 aa, Homo Sapiens
MDFWLWPLYFLPVSGALRILPEVKVEGELGGSVTIKCPLPEMHVRIYLCREMAGSGTCGTVVSTTNFIKAEYKGRVTLKQYPRKNLFLVEVTQLTESDSGVYACGAGMNTDRGKTQKVTLNVHSEYEPSWEEQPMPETPKWFHLPYLFQMP

SEQ ID NO: 5220 - protein, 390 aa, Homo Sapiens
MDFWLWPLYFLPVSGALRILPEVKVEGELGGSVTIKCPLPEMHVRIYLCREMAGSGTCGTVVSTTNFIKAEYKGRVTLKQYPRKNLFLVEVTQLTESDSGVYACGAGMNTDRGKTQKVTLNVHSEYEPSWEEQPMPETPKWFHLPYLFQMPAYASSSKFVTRVTTPAQRGKVPPVHHSSPTTQITHRPRVSRASSVAGDKPRTFLPSTTASKISALEGLLKPQTPSYNHHTRLHRQRALDYGSQSGREGQGFHILIPTILGLFLLALLGLVVKRAVERRKALSRRARRLAVRMRALESSQRPRGSPRPRSQNNIYSACPRRARGADAAGTGEAPVPGPGAPLPPAPLQVSESPWLHAPSLKTSCEYVSLYHQPAAMMEDSDSDDYINVPA

SEQ ID NO: 5221 - protein, 306 aa, Homo Sapiens
MDFWLWPLYFLPVSGALRILPEVKVEGELGGSVTIKCPLPEMHVRIYLCREMAGSGTCGTVVSTTNFIKAEYKGRVTLKQYPRKNLFLVEVTQLTESDSGVYACGAGMNTDRGKTQKVTLNVHSEYEPSWEEQPMPETPKWFHLPYLFQMPAYASSSKFVTRVTTPAQRGKVPPVHHSSPTTQITHRPRVSRASSVAGDKPRTFLPSTTASKISALEGLLKPQTPSYNHHTRLHRQSPLQAGPPTGREDARPGELPEAPRVAATALPKQHLQRLPAARSWSGRCRHRGGPRSRPRSAVAPRPAAGV

SEQ ID NO: 5222 - protein, 326 aa, Homo Sapiens
MELSGATMARGLAVLLVLFLHIKNLPAQAADTCPEVKVVGLEGSDKLTILRGCPGLPGAPGPKGEAGVIGERGERGLPGAPGKAGPVGPKGDRGEKGMRGEKGDAGQSQSCATGPRNCKDLLDRGYFLSGWHTIYLPDCRPLTVLCDMDTDGGGWTVFQRRMDGSVDFYRDWAAYKQGFGSQLGEFWLGNDNIHALTAQGSSELRVDLVDFEGNHQFAKYKSFKVADEAEKYKLVLGAFVGGSAGNSLTGHNNNFFSTKDQDNDVSSSNCAEKFQGAWWYADCHASNLNGLYLMGPHESYANGINWSAAKGYKYSYKVSEMKVRPA

SEQ ID NO: 5223 - protein, 360 aa, Homo Sapiens
MELSGATMARGLAVLLVLFLHIKNLPAQAADTCPEVKVVGLEGSDKLTILRGCPGLPGAPGPKGEAGVIGERGERGLPGAPGKAGPVGPKGDRGEKGMRGEKGDAGQSQSCATGPRNCKDLLDRGYFLSGWHTIYLPDCRPLTVLCDMDTDGGGWTVFQRRMDGSVDFYRDWAAYKQGFGSQTHSHDAHSCPFAPSSVKPPHAHNLTRGRIMFLNMFTLGQKSFTSFNVCFLNTSGFDHFPVSVARQVFPWNLVSREESGPLFSRWHYRCSGRLSDFCEDFPPPVIDTGRSSPPPPSLPHPPMPHSQHFTLLEKGHFGVQKTLTKKGESLVGTFLLPTTAEFMLWAGWLLGRDKHLALTK

SEQ ID NO: 5224 - protein, 313 aa, Homo Sapiens
MELDRAVGVLGAATLLLSFLGMAWALQAADTCPEVKMVGLEGSDKLTILRGCPGLPGAPGPKGEAGTNGKRGERGPPGPPGKAGPPGPNGAPGEPQPCLTGPRTCKDLLDRGHFLSGWHTIYLPDCRPLTVLCDMDTDGGGWTVFQRRVDGSVDFYRDWATYKQGFGSRLGEFWLGNDNIHALTAQGTSELRVDLVDFEDNYQFAKYRSFKVADEAEKYNLVLGAFVEGSAGDSLTFHNNQSFSTKDQDNDLNTGNCAVMFQGAWWYKNCHVSNLNGRYLRGTHGSFANGINWKSGKGYNYSYKVSEMKVRPA

SEQ ID NO: 5225 - protein, 275 aa, Homo Sapiens
MELDRAVGVLGAATLLLSFLGMAWALQAADTCPGERGPPGPPGKAGPPGPNGAPGEPQPCLTGPRTCKDLLDRGHFLSGWHTIYLPDCRPLTVLCDMDTDGGGWTVFQRRVDGSVDFYRDWATYKQGFGSRLGEFWLGNDNIHALTAQGTSELRVDLVDFEDNYQFAKYRSFKVADEAEKYNLVLGAFVEGSAGDSLTFHNNQSFSTKDQDNDLNTGNCAVMFQGAWWYKNCHVSNLNGRYLRGTHGSFANGINWKSGKGYNYSYKVSEMKVRPA

SEQ ID NO: 5226 - protein, 299 aa, Homo Sapiens
MDLLWILPSLWLLLLGGPACLKTQEHPSCPGPRELEASKVVLLPSCPGAPGSPGEKGAPGPQGPPGPPGKMGPKGEPGDPVNLLRCQEGPRNCRELLSQGATLSGWYHLCLPEGRALPVFCDMDTEGGGWLVFQRRQDGSVDFFRSWSSYRAGFGNQESEFWLGNENLHQLTLQGNWELRVELEDFNGNRTFAHYATFRLLGEVDHYQLALGKFSEGTAGDSLSLHSGRPFTTYDADHDSSNSNCAVIVHGAWWYASCYRSNLNGRYAVSEAAAHKYGIDWASGRGVGHPYRRVRMMLR

SEQ ID NO: 5227 - protein, 288 aa, Homo Sapiens
MDLLWILPSLWLLLLGGPACLKTQEHPSCPGPRELEASKVVLLPSCPGAPGSPGEKGAPGPQGPPGPPGKMGPKGEPGPRNCRELLSQGATLSGWYHLCLPEGRALPVFCDMDTEGGGWLVFQRRQDGSVDFFRSWSSYRAGFGNQESEFWLGNENLHQLTLQGNWELRVELEDFNGNRTFAHYATFRLLGEVDHYQLALGKFSEGTAGDSLSLHSGRPFTTYDADHDSSNSNCAVIVHGAWWYASCYRSNLNGRYAVSEAAAHKYGIDWASGRGVGHPYRRVRMMLR

SEQ ID NO: 5228 - protein, 429 aa, Homo Sapiens
MLPRLLLLICAPLCEPAELFLIASPSHPTEGSPVTLTCKMPFLQSSDAQFQFCFFRDTRALGPGWSSSPKLQIAAMWKEDTGSYWCEAQTMASKVLRSRRSQINVHRVPVADVSLETQPPGGQVMEGDRLVLICSVAMGTGDITFLWYKGAVGLNLQSKTQRSLTAEYEIPSVRESDAEQYYCVAENGYGPSPSGLVSITVRIPVSRPILMLRAPRAQAAVEDVLELHCEALRGSPPILYWFYHEDITLGSRSAPSGGGASFNLSLTEEHSGNYSCEANNGLGAQRSEAVTLNFTVPTGARSNHLTSGVIEGLLSTLGPATVALLFCYGLKRKIGRRSARDPLRSLPSPLPQEFTYLNSPTPGQLQPIYENVNVVSGDEVYSLAYYNQPEQESVAAETLGTHMEDKVSLDIYSRLRKANITDVDYEDAM

SEQ ID NO: 5229 - protein, 366 aa, Homo Sapiens
MLPRLLLLICAPLCEPAELFLIASPSHPTEGSPVTLTCKMPFLQSSDAQFQFCFFRDTRALGPGWSSSPKLQIAAMWKEDTGSYWCEAQTMASKVLRSRRSQINVHRVPVADVSLETQPPGGQVMEGDRLVLICSVAMGTGDITFLWYKGAVGLNLQSKTQRSLTAEYEIPSVRESDAEQYYCVAENGYGPSPSGLVSITVRIPVSRPILMLRAPRAQAAVEDVLELHCEALRGSPPILYWFYHEDITLGSRSAPSGGGASFNLSLTEEHSGNYSCEANNGLGAQRSEAVTLNFTGRRSARDPLRSLPSPLPQEFTYLNSPTPGQLQPIYENEPREQSVAVHGRQQHSSEQKAQKPWGHIWRTRFP

SEQ ID NO: 5230 - protein, 428 aa, Homo Sapiens
MLPRLLLLICAPLCEPAELFLIASPSHPTEGSPVTLTCKMPFLQSSDAQFQFCFFRDTRALGPGWSSSPKLQIAAMWKEDTGSYWCEAQTMASKVLRSRRSQINVHRVPVADVSLETQPPGGQVMEGDRLVLICSVAMGTGDITFLWYKGAVGLNLQSKTQRSLTAEYEIPSVRESDAEQYYCVAENGYGPSPSGLVSITVRIPVSRPILMLRAPRAQAAVEDVLELHCEALRGSPPILYWFYHEDITLGSRSAPSGGGASFNLSLTEEHSGNYSCEANNGLGAQRSEAVTLNFTVPTGARSNHLTSGVIEGLLSTLGPATVALLFCYGLKRKIGRRSARDPLRSLPSPLPQEFTYLNSPTPGQLQPIYENVNVVSGDEVYSLAYYNQPEQESVAETLGTHMEDKVSLDIYSRLRKANITDVDYEDAM

SEQ ID NO: 5231 - protein, 742 aa, Homo Sapiens
MLLWLLLLILTPGREQSGVAPKAVLLLNPPWSTAFKGEKVALICSSISHSLAQGDTYWYHDEKLLKIKHDKIQITEPGNYQCKTRGSSLSDAVHVEFSPDWLILQALHPVFEGDNVILRCQGKDNKNTHQKVYYKDGKQLPNSYNLEKITVNSVSRDNSKYHCTAYRKFYILDIEVTSKPLNIQVQELFLHPVLRASSSTPIEGSPMTLTCETQLSPQRPDVQLQFSLFRDSQTLGLGWSRSPRLQIPAMWTEDSGSYWCEVETVTHSIKKRSLRSQIRVQRVPVSNVNLEIRPTGGQLIEGENMVLICSVAQGSGTVTFSWHKEGRVRSLGRKTQRSLLAELHVLTVKESDAGRYYCAADNVHSPILSTWIRVTVRIPVSHPVLTFRAPRAHTVVGDLLELHCESLRGSPPILYRFYHEDVTLGNSSAPSGGGASFNLSLTAEHSGNYSCDADNGLGAQHSHGVSLRVTVPVSRPVLTLRAPGAQAVVGDLLELHCESLRGSFPILYWFYHEDDTLGNISAHSGGGASFNLSLTTEHSGNYSCEADNGLGAQHSKVVTLNVTGTSRNRTGLTAAGITGLVLSILVLAAAAALLHYARARRKPGGLSATGTSSHSPSECQEPSSSRPSRIDPQEPTHSKPLAPMELEPMYSNVNPGDSNPIYSQIWSIQHTKENSANCPMMHQEHEELTVLYSELKKTHPDDSAGEASSRGRAHEEDDEENYENILNPRKNKVQDFPCLCNT

SEQ ID NO: 5232 - protein, 734 aa, Homo Sapiens
MLLWLLLLILTPGREQSGVAPKAVLLLNPPWSTAFKGEKVALICSSISHSLAQGDTYWYHDEKLLKIKHDKIQITEPGNYQCKTRGSSLSDAVHVEFSPDWLILQALHPVFEGDNVILRCQGKDNKNTHQKVYYKDGKQLPNSYNLEKITVNSVSRDNSKYHCTAYRKFYILDIEVTSKPLNIQVQELFLHPVLRASSSTPIEGSPMTLTCETQLSPQRPDVQLQFSLFRDSQTLGLGWSRSPRLQIPAMWTEDSGSYWCEVETVTHSIKKRSLRSQIRVQRVPVSNVNLEIRPTGGQLIEGENMVLICSVAQGSGTVTFSWHKEGRVRSLGRKTQRSLLAELHVLTVKESDAGRYYCAADNVHSPILSTWIRVTVRIPVSHPVLTFRAPRAHTVVGDLLELHCESLRGSPPILYRFYHEDVTLGNSSAPSGGGASFNLSLTAEHSGNYSCDADNGLGAQHSHGVSLRVTVPVSRPVLTLRAPGAQAVVGDLLELHCESLRGSFPILYWFYHEDDTLGNISAHSGGGASFNLSLTTEHSGNYSCEADNGLGAQHSKVVTLNVTGTSRNRTGLTAAGITGLVLSILVLAAAAALLHYARARRKPGGLSATGTSSHSPSECQEPSSSRPSRIDPQEPTHSKPLAPMELEPMYSNVNPGDSNPIYSQIWSIQHTKENSANCPMMHQEHEELTVLYSELKKTHPDDSAGEASSRGRAHEEDDEENYENVPRVLLASDH

SEQ ID NO: 5233 - protein, 256 aa, Homo Sapiens
MLLWLLLLILTPGREQSGVAPKAVLLLNPPWSTAFKGEKVALICSSISHSLAQGDTYWYHDEKLLKIKHDKIQITEPGNYQCKTRGSSLSDAVHVEFSPDWLILQALHPVFEGDNVILRCQGKDNKNTHQKVYYKDGKQLPNSYNLEKITVNSVSRDNSKYHCTAYRKFYILDIEVTSKPLNIQVQELFLHPVLRASSSTPIEGSPMTLTCETQLSPQRPDVQLQFSLFRDSQTLGLGWSRSPRLQIPAMWTEDSG

SEQ ID NO: 5234 - protein, 740 aa, Homo Sapiens
MLLWLLLLILTPGREQSGVAPKAVLLLNPPWSTAFKGEKVALICSSISHSLAQGDTYWYHDEKLLKIKHDKIQITEPGNYQCKTRGSSLSDAVHVEFSPDWLILQALHPVFEGDNVILRCQGKDNKNTHQKVYYKDGKQLPNSYNLEKITVNSVSRDNSKYHCTAYRKFYILDIEVTSKPLNIQVQELFLHPVLRASSSTPIEGSPMTLTCETQLSPQRPDVQLQFSLFRDSQTLGLGWSRSPRLQIPAMWTEDSGSYWCEVETVTHSIKKRSLRSQIRVQRVPVSNVNLEIRPTGGQLIEGENMVLICSVAQGSGTVTFSWHKEGRVRSLGRKTQRSLLAELHVLTVKESDAGRYYCAADNVHSPILSTWIRVTVRTLLSPSVPVSHPVLTFRAPRAHTVVGDLLELHCESLRGSPPILYRFYHEDVTLGNSSAPSGGGASFNLSLTAEHSGNYSCDADNGLGAQHSHGVSLRVTVPVSRPVLTLRAPGAQAVVGDLLELHCESLRGSFPILYWFYHEDDTLGNISAHSGGGASFNLSLTTEHSGNYSCEADNGLGAQHSKVVTLNVTGTSRNRTGLTAAGITGLVLSILVLAAAAALLHYARARRKPGGLSATGTSSHSPSECQEPSSSRPSRIDPQEPTHSKPLAPMELEPMYSNVNPGDSNPIYSQIWSIQHTKENSANCPMMHQEHEELTVLYSELKKTHPDDSAGEASSRGRAHEEDDEENYENVPRVLLASDH

SEQ ID NO: 5235 - protein, 734 aa, Homo Sapiens; identical to SEQ ID NO: 5232

SEQ ID NO: 5236 - protein, 639 aa, Homo Sapiens
MLLWLLLLILTPGREQSGVAPKAVLLLNPPWSTAFKGEKVALICSSISHSLAQGDTYWYHDEKLLKIKHDKIQITEPGNYQCKTRGSSLSDAVHVEFSPDWLILQALHPVFEGDNVILRCQGKDNKNTHQKVYYKDGKQLPNSYNLEKITVNSVSRDNSKYHCTAYRKFYILDIEVTSKPLNIQVQGVPVSNVNLEIRPTGGQLIEGENMVLICSVAQGSGTVTFSWHKEGRVRSLGRKTQRSLLAELHVLTVKESDAGRYYCAADNVHSPILSTWIRVTVRIPVSHPVLTFRAPRAHTVVGDLLELHCESLRGSPPILYRFYHEDVTLGNSSAPSGGGASFNLSLTAEHSGNYSCDADNGLGAQHSHGVSLRVTVPVSRPVLTLRAPGAQAVVGDLLELHCESLRGSFPILYWFYHEDDTLGNISAHSGGGASFNLSLTTEHSGNYSCEADNGLGAQHSKVVTLNVTGTSRNRTGLTAAGITGLVLSILVLAAAAALLHYARARRKPGGLSATGTSSHSPSECQEPSSSRPSRIDPQEPTHSKPLAPMELEPMYSNVNPGDSNPIYSQIWSIQHTKENSANCPMMHQEHEELTVLYSELKKTHPDDSAGEASSRGRAHEEDDEENYENVPRVLLASDH

SEQ ID NO: 5237 - protein, 592 aa, Homo Sapiens
MLLWVILLVLAPVSGQFARTPRPIIFLQPPWTTVFQGERVTLTCKGFRFYSPQKTKWYHRYLGKEILRETPDNILEVQESGEYRCQAQGSPLSSPVHLDFSSASLILQAPLSVFEGDSVVLRCRAKAEVTLNNTIYKNDNVLAFLNKRTDFHIPHACLKDNGAYRCTGYKESCCPVSSNTVKIQVQEPFTRPVLRASSFQPISGNPVTLTCETQLSLERSDVPLRFRFFRDDQTLGLGWSLSPNFQITAMWSKDSGFYWCKAATMPYSVISDSPRSWIQVQIPASHPVLTLSPEKALNFEGTKVTLHCETQEDSLRTLYRFYHEGVPLRHKSVRCERGASISFSLTTENSGNYYCTADNGLGAKPSKAVSLSVTVPVSHPVLNLSSPEDLIFEGAKVTLHCEAQRGSLPILYQFHHEGAALERRSANSAGGVAISFSLTAEHSGNYYCTADNGFGPQRSKAVSLSVTVPVSHPVLTLSSAEALTFEGATVTLHCEVQRGSPQILYQFYHEDMPLWSSSTPSVGRVSFSFSLTEGHSGNYYCTADNGFGPQRSEVVSLFVTGKCWVLASHPPLAEFSLTHSFKNLFALSSFLP

SEQ ID NO: 5238 - protein, 977 aa, Homo Sapiens
MLLWVILLVLAPVSGQFARTPRPIIFLQPPWTTVFQGERVTLTCKGFRFYSPQKTKWYHRYLGKEILRETPDNILEVQESGEYRCQAQGSPLSSPVHLDFSSASLILQAPLSVFEGDSVVLRCRAKAEVTLNNTIYKNDNVLAFLNKRTDFHIPHACLKDNGAYRCTGYKESCCPVSSNTVKIQVQEPFTRPVLRASSFQPISGNPVTLTCETQLSLERSDVPLRFRFFRDDQTLGLGWSLSPNFQITAMWSKDSGFYWCKAATMPYSVISDSPRSWIQVQIPASHPVLTLSPEKALNFEGTKVTLHCETQEDSLRTLYRFYHEGVPLRHKSVRCERGASISFSLTTENSGNYYCTADNGLGAKPSKAVSLSVTVPVSHPVLNLSSPEDLIFEGAKVTLHCEAQRGSLPILYQFHHEGAALERRSANSAGGVAISFSLTAEHSGNYYCTADNGFGPQRSKAVSLSVTVPVSHPVLTLSSAEALTFEGATVTLHCEVQRGSPQILYQFYHEDMPLWSSSTPSVGRVSFSFSLTEGHSGNYYCTADNGFGPQRSEVVSLFVTVPVSRPILTLRVPRAQAVVGDLLELHCEAPRGSPPILYWFYHEDVTLGSSSAPSGGEASFNLSLTAEHSGNYSCEANNGLVAQHSDTISLSVIVPVSRPILTFRAPRAQAVVGDLLELHCEALRGSSPILYWFYHEDVTLGKISAPSGGGASFNLSLTTEHSGIYSCEADNGLEAQRSEMVTLKVAVPVSRPVLTLRAPGTHAAVGDLLELHCEALRGSPLILYRFFHEDVTLGNRSSPSGGASLNLSLTAEHSGNYSCEADNGLGAQRSETVTLYITGLTANRSGPFATGVAGGLLSIAGLAAGALLLYCWLSRKAGRKPASDPARSPSDSDSQEPTYHNVPAWEELQPVYTNANPRGENVVYSEVRIIQEKKKHAVASDPRHLRNKGSPIIYSEVKVASTPVSGSLFLASSAPHR

SEQ ID NO: 5239 - protein, 759 aa, Homo Sapiens
MLLWVILLVLAPVSGQFARTPRPIIFLQPPWTTVFQGERVTLTCKGFRFYSPQKTKWYHRYLGKEILRETPDNILEVQESGEYRCQAQGSPLSSPVHLDFSSASLILQAPLSVFEGDSVVLRCRAKAEVTLNNTIYKNDNVLAFLNKRTDFHIPHACLKDNGAYRCTGYKESCCPVSSNTVKIQVQEPFTRPVLRASSFQPISGNPVTLTCETQLSLERSDVPLRFRFFRDDQTLGLGWSLSPNFQITAMWSKDSGFYWCKAATMPYSVISDSPRSWIQVQIPASHPVLTLSPEKALNFEGTKVTLHCETQEDSLRTLYRFYHEGVPLRHKSVRCERGASISFSLTTENSGNYYCTADNGLGAKPSKAVSLSVTVPVSHPVLNLSSPEDLIFEGAKVTLHCEAQRGSLPILYQFHHEGAALERRSANSAGGVAISFSLTAEHSGNYYCTADNGFGPQRSKAVSLSVTVPVSHPVLTLSSAEALTFEGATVTLHCEVQRGSPQILYQFYHEDMPLWSSSTPSVGRVSFSFSLTEGHSGNYYCTADNGFGPQRSEVVSLFVTVPVSRPILTLRVPRAQAVVGDLLELHCEAPRGSPPILYWFYHEDVTLGSSSAPSGGEASFNLSLTAEHSGNYSCEANNGLVAQHSDTISLSVIVPVSRPILTFRAPRAQAVVGDLLELHCEALRGSSPILYWFYHEDVTLGKISAPSGGGASFNLSLTTEHSGIYSCEADNGLEAQRSEMVTLKVAGEWALPTSSTSEN

SEQ ID NO: 5240 - protein, 365 aa, Homo Sapiens
MKLGCVLMAWALYLSLGVLWVAQMLLAAGCHAAASFETLQCEGPVCTEESSCHTEDDLTDAREAGFQVKAYTFSEPFHLIVSYDWLILQGPAKPVFEGDLLVLRCQAWQDWPLTQVTFYRDGSALGPPGPNREFSITVVQKADSGHYHCSGIFQSPGPGIPETASVVAITVQELFPAPILRAVPSAEPQAGSPMTLSCQTKLPLQRSAARLLFSFYKDGRIVQSRGLSSEFQIPTASEDHSGSYWCEAATEDNQVWKQSPQLEIRVQGASSSAAPPTLNPAPQKSAAPGTAPEEAPGPLPPPPTPSSEDPGFSSPLGMPDPHLYHQMGLLLKHMQDVRVLLGHLLMELRELSGHRKPGTTKATAE

SEQ ID NO: 5241 - protein, 225 aa, Homo Sapiens
MKLGCVLMAWALYLSLGVLWVAQMLLAAGCHAELFPAPILRAVPSAEPQAGSPMTLSCQTKLPLQRSAARLLFSFYKDGRIVQSRGLSSEFQIPTASEDHSGSYWCEAATEDNQVWKQSPQLEIRVQGASSSAAPPTLNPAPQKSAAPGTAPEEAPGPLPPPPTPSSEDPGFSSPLGMPDPHLYHQMGLLLKHMQDVRVLLGHLLMELRELSGHRKPGTTKATAE

SEQ ID NO: 5242 - protein, 264 aa, Homo Sapiens
MKLGCVLMAWALYLSLGVLWVAQMLLAASFETLQCEGPVCTEESSCHTEDDLTDAREAGFQVKAYTFSEPFHLIVSYDWLILQGPAKPVFEGDLLVLRCQAWQDWPLTQVTFYRDGSALGPPGPNREFSITVVQKADSGHYHCSGIFQSPGPGIPETASVVAITVQGASSSAAPPTLNPAPQKSAAPGTAPEEAPGPLPPPPTPSSEDPGFSSPLGMPDPHLYHQMGLLLKHMQDVRVLLGHLLMELRELSGHRKPGTTKATAE

SEQ ID NO: 5243 - protein, 270 aa, Homo Sapiens
MKLGCVLMAWALYLSLGVLWVAQMLLAASFETLQCEGPVCTEESSCHTEDDLTDAREAGFQVKAYTFSEPFHLIVSYELFPAPILRAVPSAEPQAGSPMTLSCQTKLPLQRSAARLLFSFYKDGRIVQSRGLSSEFQIPTASEDHSGSYWCEAATEDNQVWKQSPQLEIRVQGASSSAAPPTLNPAPQKSAAPGTAPEEAPGPLPPPPTPSSEDPGFSSPLGMPDPHLYHQMGLLLKHMQDVRVLLGHLLMELRELSGHRKPGTTKATAE

SEQ ID NO: 5244 - protein, 382 aa, Homo Sapiens
MLKKISVGVAGDLNTVTMKLGCVLMAWALYLSLGVLWVAQMLLAAGCHAAASFETLQCEGPVCTEESSCHTEDDLTDAREAGFQVKAYTFSEPFHLIVSYDWLILQGPAKPVFEGDLLVLRCQAWQDWPLTQVTFYRDGSALGPPGPNREFSITVVQKADSGHYHCSGIFQSPGPGIPETASVVAITVQELFPAPILRAVPSAEPQAGSPMTLSCQTKLPLQRSAARLLFSFYKDGRIVQSRGLSSEFQIPTASEDHSGSYWCEAATEDNQVWKQSPQLEIRVQGASSSAAPPTLNPAPQKSAAPGTAPEEAPGPLPPPPTPSSEDPGFSSPLGMPDPHLYHQMGLLLKHMQDVRVLLGHLLMELRELSGHRKPGTTKATAE

SEQ ID NO: 5245 - protein, 242 aa, Homo Sapiens
MLKKISVGVAGDLNTVTMKLGCVLMAWALYLSLGVLWVAQMLLAAGCHAELFPAPILRAVPSAEPQAGSPMTLSCQTKLPLQRSAARLLFSFYKDGRIVQSRGLSSEFQIPTASEDHSGSYWCEAATEDNQVWKQSPQLEIRVQGASSSAAPPTLNPAPQKSAAPGTAPEEAPGPLPPPPTPSSEDPGFSSPLGMPDPHLYHQMGLLLKHMQDVRVLLGHLLMELRELSGHRKPGTTKATAE

SEQ ID NO: 5246 - protein, 376 aa, Homo Sapiens
MLKKISVGVAGDLNTVTMKLGCVLMAWALYLSLGVLWVAQMLLAASFETLQCEGPVCTEESSCHTEDDLTDAREAGFQVKAYTFSEPFHLIVSYDWLILQGPAKPVFEGDLLVLRCQAWQDWPLTQVTFYRDGSALGPPGPNREFSITVVQKADSGHYHCSGIFQSPGPGIPETASVVAITVQELFPAPILRAVPSAEPQAGSPMTLSCQTKLPLQRSAARLLFSFYKDGRIVQSRGLSSEFQIPTASEDHSGSYWCEAATEDNQVWKQSPQLEIRVQGASSSAAPPTLNPAPQKSAAPGTAPEEAPGPLPPPPTPSSEDPGFSSPLGMPDPHLYHQMGLLLKHMQDVRVLLGHLLMELRELSGHRKPGTTKATAE

SEQ ID NO: 5247 - protein, 287 aa, Homo Sapiens
MLKKISVGVAGDLNTVTMKLGCVLMAWALYLSLGVLWVAQMLLAASFETLQCEGPVCTEESSCHTEDDLTDAREAGFQVKAYTFSEPFHLIVSYELFPAPILRAVPSAEPQAGSPMTLSCQTKLPLQRSAARLLFSFYKDGRIVQSRGLSSEFQIPTASEDHSGSYWCEAATEDNQVWKQSPQLEIRVQGASSSAAPPTLNPAPQKSAAPGTAPEEAPGPLPPPPTPSSEDPGFSSPLGMPDPHLYHQMGLLLKHMQDVRVLLGHLLMELRELSGHRKPGTTKATAE

SEQ ID NO: 5248 - protein, 192 aa, Homo Sapiens
MLKKISVGVAGDLNTVTMKLGCVLMAWALYLSLGVLWVAQMLLAASFETLQCEGPVCTEESSCHTEDDLTDAREAGFQVKAYTFSEPFHLIVSYGASSSAAPPTLNPAPQKSAAPGTAPEEAPGPLPPPPTPSSEDPGFSSPLGMPDPHLYHQMGLLLKHMQDVRVLLGHLLMELRELSGHRKPGTTKATAE

SEQ ID NO: 5249 - protein, 236 aa, Homo Sapiens
MLKKISVGVAGDLNTVTMKLGCVLMAWALYLSLGVLWVAQMLLELFPAPILRAVPSAEPQAGSPMTLSCQTKLPLQRSAARLLFSFYKDGRIVQSRGLSSEFQIPTASEDHSGSYWCEAATEDNQVWKQSPQLEIRVQGASSSAAPPTLNPAPQKSAAPGTAPEEAPGPLPPPPTPSSEDPGFSSPLGMPDPHLYHQMGLLLKHMQDVRVLLGHLLMELRELSGHRKPGTTKATAE

SEQ ID NO: 5250 - protein, 141 aa, Homo Sapiens
MLKKISVGVAGDLNTVTMKLGCVLMAWALYLSLGVLWVAQMLLGASSSAAPPTLNPAPQKSAAPGTAPEEAPGPLPPPPTPSSEDPGFSSPLGMPDPHLYHQMGLLLKHMQDVRVLLGHLLMELRELSGHRKPGTTKATAE

SEQ ID NO: 5251 - protein, 152 aa, Homo Sapiens
MLLAASFETLQCEGPVCTEESSCHTEDDLTDAREAGFQVKAYTFSEPFHLIVSYGASSSAAPPTLNPAPQKSAAPGTAPEEAPGPLPPPPTPSSEDPGFSSPLGMPDPHLYHQMGLLLKHMQDVRVLLGHLLMELRELSGHRKPGTTKATAE

SEQ ID NO: 5252 - protein, 311 aa, Homo Sapiens
MWPLTALLLLATLEKPILSLHPPWTTIFKGERVTLKCDGYHPLLLELQPISTLWYLGHLLLPSHKKSIEVQTPGVYRCQTRGAPVSDPIHLSVSNDWLILQVPYAPVFEGEPLVLRCRGWYDKVVYKLHYYHDGQAVRYFHSSANYTVLQARASDSGRYQCSGTMRIPVESAPMFSAKVAVTVQAARCAASTGAPSTQSRSPRSRSSNRTGARRLPPPAVSGNAVRGCSSRGRVLPWTRPPPPPQLHGPQPWLLVIGRFPSESPRCPDRSRWSPPSGTPPPPGCSSRRAAPRLRGHPPALRRRPWNNRLEP

SEQ ID NO: 5253 - protein, 268 aa, Homo Sapiens
MWPLTALLLLATLEKPILSLHPPWTTIFKGERVTLKCDGYHPLLLELQPISTLWYLGHLLLPSHKKSIEVQTPGVYRCQTRGAPVSDPIHLSVSNDWLILQVPYAPVFEGEPLVLRCRGWYDKVVYKLHYYHDGQAVRYFHSSANYTVLQARASDSGRYQCSGTMRIPVESAPMFSAKVAVTVQEARHAAAVRVLQVQPRGAPLRLGRRVHSPGARGRGARIVLVRGGYRHPQCPETQSVAAAPGAGFSPGPGLHHRPSSMGRSLGSW

SEQ ID NO: 5254 - protein, 318 aa, Homo Sapiens
MWPLTALLLLVPSSGQAATLEKPILSLHPPWTTIFKGERVTLKCDGYHPLLLELQPISTLWYLGHLLLPSHKKSIEVQTPGVYRCQTRGAPVSDPIHLSVSNDWLILQVPYAPVFEGEPLVLRCRGWYDKVVYKLHYYHDGQAVRYFHSSANYTVLQARASDSGRYQCSGTMRIPVESAPMFSAKVAVTVQAARCAASTGAPSTQSRSPRSRSSNRTGARRLPPPAVSGNAVRGCSSRGRVLPWTRPPPPPQLHGPQPWLLVIGRFPSESPRCPDRSRWSPPSGTPPPPGCSSRRAAPRLRGHPPALRRRPWNNRLEP

SEQ ID NO: 5255 - protein, 275 aa, Homo Sapiens
MWPLTALLLLVPSSGQAATLEKPILSLHPPWTTIFKGERVTLKCDGYHPLLLELQPISTLWYLGHLLLPSHKKSIEVQTPGVYRCQTRGAPVSDPIHLSVSNDWLILQVPYAPVFEGEPLVLRCRGWYDKVVYKLHYYHDGQAVRYFHSSANYTVLQARASDSGRYQCSGTMRIPVESAPMFSAKVAVTVQEARHAAAVRVLQVQPRGAPLRLGRRVHSPGARGRGARIVLVRGGYRHPQCPETQSVAAAPGAGFSPGPGLHHRPSSMGRSLGSW

SEQ ID NO: 5256 - protein, 426 aa, Homo Sapiens
MWPLTALLLLVPSSGQAATLEKPILSLHPPWTTIFKGERVTLKCDGYHPLLLELQPISTLWYLGHLLLPSHKKSIEVQTPGVYRCQTRGAPVSDPIHLSVSNDWLILQVPYAPVFEGEPLVLRCRGWYDKVVYKLHYYHDGQAVRYFHSSANYTVLQARASDSGRYQCSGTMRIPVESAPMFSAKVAVTVQELFRAPVLRVMGPREARGAALGGVVLRCDTRLHPQKRDTPLQFAFYKYSRAVRRFDWGAEYTVPEPEVEELESYWCEAATATRSVRKRSPWLQLPGPGSPLDPASTTAPAPWAAALAPGNRPLSFRKPPVSRSVPLVTSVRNTTSTGLQFPASGAPTAGPPACAPPTPLEQSAGALKPDVDLLLREMQLLKGLLSRVVLELKEPQALRELRGTPETPTSHFAVSPGTPETTPVES

SEQ ID NO: 5257 - protein, 85 aa, Homo Sapiens
MKKVLLLITAILAVAVGFPVSQDQEREKRSISDSDELASGFFVFPYPYPFRPLPPIPFPRFPWFRRNFPIPIPESAPTTPLPSEK

SEQ ID NO: 5258 - protein, 317 aa, Homo Sapiens
MGLLLPLALCILVLCCGAMSPPQLALNPSALLSRGCNDSDVLAVAGFALRDINKDRKDGYVLRLNRVNDAQEYRRAISKKKIYMTCPDCPSSIPTDSSNHQVLEAATESLAKYNNENTSKQYSLFKVTRASSQWVVGPSYFVEYLIKESPCTKSQASSCSLQSSDSVPVGLCKGSLTRTHWEKFVSVTCDFFESQAPATGSENSAVNQKPTNLPKVEESQQKNTPPTDSPSKAGPRGSVQYLPDLDDKNSQEKGPQEAFPVHLDLTTNPQGETLDISFLFLEPMEEKLVVLPFPKEKARTAECPGPAQNASPLVLPP

SEQ ID NO: 5259 - protein, 92 aa, Homo Sapiens
MGLLLPLALCILVLCCGAMSPPQLALNPSALLSRGCNDSDVLAVAGFALRDINKDRKDGYVLRLNRVNDAQEYRRARWPGISVLSYTGCARD

SEQ ID NO: 5260 - protein, 119 aa, Homo Sapiens
MGLLLPLALCILVLCCGAMSPPQLALNPSALLSRGCNDSDVLAVAGFALRDINKDRKDGYVLRLNRVNDAQEYRRGGLGSLFYLTLDVLETDCHVLRKKAWQDCGMRIFFESFQKKRFT

SEQ ID NO: 5261 - protein, 382 aa, Homo Sapiens
MGLLLPLALCILVLCCGAMSPPQLALNPSALLSRGCNDSDVLAVAGFALRDINKDRKDGYVLRLNRVNDAQEYRRGGLGSLFYLTLDVLETDCHVLRKKAWQDCGMRIFFESVYGQCKAIFYMNNPSRVLYLAAYNCTLRPVSKKKIYMTCPDCPSSIPTDSSNHQVLEAATESLAKYNNENTSKQYSLFKVTRASSQWVVGPSYFVEYLIKESPCTKSQASSCSLQSSDSVPVGLCKGSLTRTHWEKFVSVTCDFFESQAPATGSENSAVNQKPTNLPKVEESQQKNTPPTDSPSKAGPRGSVQYLPDLDDKNSQEKGPQEAFPVHLDLTTNPQGETLDISFLFLEPMEEKLVVLPFPKEKARTAECPGPAQNASPLVLPP

SEQ ID NO: 5262 - protein, 382 aa, Homo Sapiens; identical to SEQ ID NO: 5261

SEQ ID NO: 5263 - protein, 345 aa, Homo Sapiens
MGLLLPLALCILVLCCGAMSPPQLALNPSALLSRGCNDSDVLAVAGFALRDINKDRKDGYVLRLNRVNDAQEYRRVYGQCKAIFYMNNPSRVLYLAAYNCTLRPVSKKKIYMTCPDCPSSIPTDSSNHQVLEAATESLAKYNNENTSKQYSLFKVTRASSQWVVGPSYFVEYLIKESPCTKSQASSCSLQSSDSVPVGLCKGSLTRTHWEKFVSVTCDFFESQAPATGSENSAVNQKPTNLPKVEESQQKNTPPTDSPSKAGPRGSVQYLPDLDDKNSQEKGPQEAFPVHLDLTTNPQGETLDISFLFLEPMEEKLVVLPFPKEKARTAECPGPAQNASPLVLPP

SEQ ID NO: 5264 - protein, 104 aa, Homo Sapiens
MTCPDCPSSIPTDSSNHQVLEAATESLAKYNNENTSKQYSLFKVTRASSQWVVGPSYFVEYLIKESPCTKSQASSCSLQSSDSVPVGLCKGSLTRTHWEKFVSV

SEQ ID NO: 5265 - protein, 289 aa, Homo Sapiens [sequence omitted]

SEQ ID NO: 5266 - protein, 866 aa, Homo Sapiens
MFSMRIVCLVLSVVGTAWTADSGEGDFLAEGGGVRGPRVVERHQSACKDSDWPFCSDEDWNYKCPSGCRMKGLIDEVNQDFTNRINKLKNSLFEYQKNNKDSHSLTTNIMEILRGDFSSANNRDNTYNRVSEDLRSRIEVLKRKVIEKVQHIQLLQKNVRAQLVDMKRLEVDIDIKIRSCRGSCSRALAREVDLKDYEDQQKQLEQVIAKDLLPSRDRQHLPLIKMKPVPDLVPGNFKSQLQKVPPEWKALTDMPQMRMELERPGGNEITRGGSTSYGTGSETESPRNPSSAGSWNSGSSGPGSTGNRNPGSSGTGGTATWKPGSSGPGSTGSWNSGSSGTGSTGNQNPGSPRPGSTGTWNPGSSERGSAGHWTSESSVSGSTGQWHSESGSFRPDSPGSGNARPNNPDWGTFEEVSGNVSPGTRREYHTEKLVTSKGDKELRTGKEKVTSGSTTTTRRSCSKTVTKTVIGPDGHKEVTKEVVTSEDGSDCPEAMDLGTLSGIGTLDGFRHRHPDEAAFFDTASTGKTFPGFFSPMLGEFVSETESRGSESGIFTNTKESSSHHPGIAEFPSRGKSSSYSKQFTSSTSYNRGDSTFESKSYKMADEAGSEADHEGTHSTKRGHAKSRPVRDCDDVLQTHPSGTQSGIFNIKLPGSSKIFSVYCDQETSLGGWLLIQQRMDGSLNFNRTWQDYKRGFGSLNDEGEGEFWLGNDYLHLLTQRGSVLRVELEDWAGNEAYAEYHFRVGSEAEGYALQVSSYEGTAGDALIEGSVEEGAEYTSHNNMQFSTFDRDADQWEENCAEVYGGGWWYNNCQAANLNGIYYPGGSYDPRNNSPYEIENGVVWVSFRGADYSLRAVRMKIRPLVTQ

SEQ ID NO: 5267 - protein, 644 aa, Homo Sapiens
MFSMRIVCLVLSVVGTAWTADSGEGDFLAEGGGVRGPRVVERHQSACKDSDWPFCSDEDWNYKCPSGCRMKGLIDEVNQDFTNRINKLKNSLFEYQKNNKDSHSLTTNIMEILRGDFSSANNRDNTYNRVSEDLRSRIEVLKRKVIEKVQHIQLLQKNVRAQLVDMKRLEVDIDIKIRSCRGSCSRALAREVDLKDYEDQQKQLEQVIAKDLLPSRDRQHLPLIKMKPVPDLVPGNFKSQLQKVPPEWKALTDMPQMRMELERPGGNEITRGGSTSYGTGSETESPRNPSSAGSWNSGSSGPGSTGNRNPGSSGTGGTATWKPGSSGPGSTGSWNSGSSGTGSTGNQNPGSPRPGSTGTWNPGSSERGSAGHWTSESSVSGSTGQWHSESGSFRPDSPGSGNARPNNPDWGTFEEVSGNVSPGTRREYHTEKLVTSKGDKELRTGKEKVTSGSTTTTRRSCSKTVTKTVIGPDGHKEVTKEVVTSEDGSDCPEAMDLGTLSGIGTLDGFRHRHPDEAAFFDTASTGKTFPGFFSPMLGEFVSETESRGSESGIFTNTKESSSHHPGIAEFPSRGKSSSYSKQFTSSTSYNRGDSTFESKSYKMADEAGSEADHEGTHSTKRGHAKSRPVRGIHTSPLGKPSLSP

SEQ ID NO: 5268 - protein, 272 aa, Homo Sapiens
MEYCRTPCTVSCNIPVVSGKECEEIIRKGGETSEMYLIQPDSSVKPYRVYCDMNTENGGWTVIQNRQDGSVDFGRKWDPYKQGFGNVATNTDGKNYCGLPGEYWLGNDKISQLTRMGPTELLIEMEDWKGDKVKAHYGGFTVQNEANKYQISVNKYRGTAGNALMDGASQLMGENRTMTIHNGMFFSTYDRDNDGWLTSDPRKQCSKEDGGGWWYNRCHAANPNGRYYWGGQYTWDMAKHGTDDGVVWMNWKGSWYSMRKMSMKIRPFFPQQ

SEQ ID NO: 5269 - protein, 491 aa, Homo Sapiens
MKRMVSWSFHKLKTMKHLLLLLLCVFLVKSQGVNDNEEGFFSARGHRPLDKKREEAPSLRPAPPPISGGGYRARPAKAAATQKKVERKAPDAGGCLHADPDLGVLCPTGCQLQEALLQQERPIRNSVDELNNNVEAVSQTSSSSFQYMYLLKDLWQKRQKQVKDNENVVNEYSSELEKHQLYIDETVNSNIPTNLRVLRSILENLRSKIQKLESDVSAQMEYCRTPCTVSCNIPVVSGKECEEIIRKGGETSEMYLIQPDSSVKPYRVYCDMNTENGGWTVIQNRQDGSVDFGRKWDPYKQGFGNVATNTDGKNYCGLPGEYWLGNDKISQLTRMGPTELLIEMEDWKGDKVKAHYGGFTVQNEANKYQISVNKYRGTAGNALMDGASQLMGENRTMTIHNGMFFSTYDRDNDGWLTSDPRKQCSKEDGGGWWYNRCHAANPNGRYYWGGQYTWDMAKHGTDDGVVWMNWKGSWYSMRKMSMKIRPFFPQQ

SEQ ID NO: 5270 - protein, 45 aa, Homo Sapiens
MKRMVSWSFHKLKTMKHLLLLLLCVFLVKSQGVNDNEEMRKLGHR

SEQ ID NO: 5271 - protein, 66 aa, Homo Sapiens
MWKWILTHCASAFPHLPGCCCCCFLLLFLVSSVPVTCQALGQDMVSPEATNSSSSSFSSPSSAGRH

SEQ ID NO: 5272 - protein, 208 aa, Homo Sapiens
MWKWILTHCASAFPHLPGCCCCCFLLLFLVSSVPVTCQALGQDMVSPEATNSSSSSFSSPSSAGRHVRSYNHLQGDVRWRKLFSFTKYFLKIEKNGKVSGTKKENCPYSILEITSVEIGVVAVKAINSNYYLAMNKKGKLYGSKEFNNDCKLKERIEENGYNTYASFNWQHNGRQMYVALNGKGAPRRGQKTRRKNTSAHFLPMVVHS

SEQ ID NO: 5273 - protein, 216 aa, Homo Sapiens
MGAARLLPNLTLCLQLLILCCQTQGENHPSPNFNQYVRDQGAMTDQLSRRQIREYQLYSRTSGKHVQVTGRRISATAEDGNKFAKLIVETDTFGSRVRIKGAESEKYICMNKRGKLIGKPSGKSKDCVFTEIVLENNYTAFQNARHEGWFMAFTRQGRPRQASRSRQNQREAHFIKRLYQGQLPFPNHAEKQKQFEFVGSAPTRRTKRTRRPQPLT

SEQ ID NO: 5274 - protein, 205 aa, Homo Sapiens
MGAARLLPNLTLCLQLLILCCQTQYVRDQGAMTDQLSRRQIREYQLYSRTSGKHVQVTGRRISATAEDGNKFAKLIVETDTFGSRVRIKGAESEKYICMNKRGKLIGKPSGKSKDCVFTEIVLENNYTAFQNARHEGWFMAFTRQGRPRQASRSRQNQREAHFIKRLYQGQLPFPNHAEKQKQFEFVGSAPTRRTKRTRRPQPLT

SEQ ID NO: 5275 - protein, 207 aa, Homo Sapiens
MYSAPSACTCLCLHFLLLCFQVQVLVAEENVDFRIHVENQTRARDDVSRKQLRLYQLYSRTSGKHIQVLGRRISARGEDGDKYAQLLVETDTFGSQVRIKGKETEFYLCMNRKGKLVGKPDGTSKECVFIEKVLENNYTALMSAKYSGWYVGFTKKGRPRKGPKTRENQQDVHFMKRYPKGQPELQKPFKYTTVTKRSRRIRPTHPA

SEQ ID NO: 5276 - protein, 216 aa, Homo Sapiens
MRSGCVVVHVWILAGLWLAVAGRPLAFSDAGPHVHYGWGDPIRLRHLYTSGPHGLSSCFLRIRADGVVDCARGQSAHSLLEIKAVALRTVAIKGVHSVRYLCMGADGKMQGLLQYSEEDCAFEEEIRPDGYNVYRSEKHRLPVSLSSAKQRQLYKNRGFLPLSHFLPMLPMVPEEPEDLRGHLESDMFSSPLETDSMDPFGLVTGLEAVRSPSFEK

SEQ ID NO: 5277 - protein, 209 aa, Homo Sapiens
MDSDETGFEHSGLWVSVLAGLLLGACQAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPALPEPPGILAPQPPDVGSSDPLSMVGPSQGRSPSYAS

SEQ ID NO: 5278 - protein, 209 aa, Homo Sapiens; identical to SEQ ID NO: 5277

SEQ ID NO: 5279 - protein, 170 aa, Homo Sapiens
MRRRLWLGLAWLLLARAPDAAGTPSASRGPRSYPHLEGDVRWRRLFSSTHFFLRVDPGGRVQGTRWRHGQDSILEIRSVHVGVVVIKAVSSGFYVAMNRRGRLYGSRLYTVDCRFRERIEENGHNTYASQRWRRRGQPMFLALDRRGGPRPGGRTRRYHLSAHFLPVLVS

SEQ ID NO: 5280 - protein, 165 aa, Homo Sapiens
MRRRLWLGLAWLLLARAPDAAGTPSASRGPRSYPHLEGDVRWRRLFSSTHFFLRVDPGGRVQGTRWRHGQDSILEIRSVHVGVVVIKAVSSGFYVAMNRRGRLYGSVPGAHRRERPQHLRLTALAPPRPAHVPGAGQEGGAPARRPDAAVPPVRPLPARPGLLRP

SEQ ID NO: 5281 - protein, 251 aa, Homo Sapiens
MLGARLRLWVCALCSVCSMSVLRAYPNASPLLGSSWGGLIHLYTATARNSYHLQIHKNGHVDGAPHQTIYSALMIRSEDAGFVVITGVMSRRYLCMDFRGNIFGSHYFDPENCRFQHQTLENGYDVYHSPQYHFLVSLGRAKRAFLPGMNPPPYSQFLSRRNEIPLIHFNTPIPRRHTRSAEDDSERDPLNVLKPRARMTPAPASCSQELPSAEDNSPMASDPLGVVRGGRVNTHAGGTGPEGCRPFAKFI

SEQ ID NO: 5282 - protein, 239 aa, Homo Sapiens
MGLIWLLLLSLLEPGWPAAGPGARLRRDAGGRGGVYEHLGGAPRRRKLYCATKYHLQLHPSGRVNGSLENSAYSILEITAVEVGIVAIRGLFSGRYLAMNKRGRLYASEHYSAECEFVERIHELGYNTYASRLYRTVSSTPGARRQPSAERLWYVSVNGKGRPRRGFKTRRTQKSSLFLPRVLDHRDHEMVRQLQSGLPRPPGKGVQPRRRRQKQSPDNLEPSHVQASRLGSQLEASAH

SEQ ID NO: 5283 - protein, 206 aa, Homo Sapiens
MSGPGTAAVALLPAVLLALLAPWAGRGGAAAPTAPNGTLEAELERRWESLVALSLARLPVAAQPKEAAVQSGAGDYLLGIKRLRRLYCNVGIGFHLQALPDGRIGGAHADTRDSLLELSPVERGVVSIFGVASRFFVAMSSKGKLYGSPFFTDECTFKEILLPNNYNAYESYKYPGMFIALSKNGKTKKGNRVSPTMKVTHFLPRL

SEQ ID NO: 5284 - protein, 123 aa, Homo Sapiens
MSLSFLLLLFFSHLILSAWAHGEKRLAPKGQPGPAATDRNPRGSSSRQSSSSAMSSSSASSSPAASLGSQGSGLEQSSFQWSPSGRRTGSLYCRVGIGFHLQIYPDGKVNGSHEANMLSQVHR

SEQ ID NO: 5285 - protein, 268 aa, Homo Sapiens
MSLSFLLLLFFSHLILSAWAHGEKRLAPKGQPGPAATDRNPRGSSSRQSSSSAMSSSSASSSPAASLGSQGSGLEQSSFQWSPSGRRTGSLYCRVGIGFHLQIYPDGKVNGSHEANMLSVLEIFAVSQGIVGIRGVFSNKFLAMSKKGKLHASAKFTDDCKFRERFQENSYNTYASAIHRTEKTGREWYVALNKRGKAKRGCSPRVKPQHISTHFLPRFKQSEQPELSFTVTVPEKKKPPSPIKPKIPLSAPRKNTNSVKYRLKFRFG

SEQ ID NO: 5286 - protein, 119 aa, Homo Sapiens
NPRGSSSRQSSSSAMSSSSASSSPAASLGSQGSGLEQSSFQWSPSGRRTGSLYCRVGIGFHLQIYPDGKVNGSHEANMLSVLEIFAVSQGIVGIRGVFSNKFLAMSKKGKLHASNTLET

SEQ ID NO: 5287 - protein, 122 aa, Homo Sapiens
MEGGDIRVRRLFCRTQWYLRIDKRGKVKGTQEMKNNYNIMEIRTVAVGIVAIKGVESEFYLAMNKEGKLYAKKECNEDCNFKELILENHYNTYASAKWTHNGGEMFVALNQKGIPVRGKKTK

SEQ ID NO: 5288 - protein, 194 aa, Homo Sapiens
MHKWILTWILPTLLYRSCFHIICLVGTISLACNDMTPEQMATNVNCSSPERHTRSYDYMEGGDIRVRRLFCRTQWYLRIDKRGKVKGTQEMKNNYNIMEIRTVAVGIVAIKGVESEFYLAMNKEGKLYAKKECNEDCNFKELILENHYNTYASAKWTHNGGEMFVALNQKGIPVRGKKTKKEQKTAHFLPMAIT

SEQ ID NO: 5289 - protein, 194 aa, Homo Sapiens; identical to SEQ ID NO: 5288

SEQ ID NO: 5290 - protein, 194 aa, Homo Sapiens; identical to SEQ ID NO: 5288

SEQ ID NO: 5291 - protein, 97 aa, Homo Sapiens
MHKWILTWILPTLLYRSCFHIICLVGTISLACNDMTPEQMATNVNCSSPERHTRSYDYMEGGDIRVRRLFCRTQWYLRIDKRGKVKGTQEMKNNYSK

SEQ ID NO: 5292 - protein, 140 aa, Homo Sapiens
MAEDGDPFAKLIVETDTFGSRVRVRGAETGLYICMNKKGKLIAKSNGKGKDCVFTEIVLENNYTALQNAKYEGWYMAFTRKGRPRKGSKTRQHQREVHFMKRLPRGHHTTEQSLRFEFLNYPPFTRSLRGSQRTWAPEPR

SEQ ID NO: 5293 - protein, 233 aa, Homo Sapiens
MGSPRSALSCLLLHLLVLCLQAQEGPGRGPALGRELASLFRAGREPQGVSQQHVREQSLVTDQLSRRLIRTYQLYSRTSGKHVQVLANKRINAMAEDGDPFAKLIVETDTFGSRVRVRGAETGLYICMNKKGKLIAKSNGKGKDCVFTEIVLENNYTALQNAKYEGWYMAFTRKGRPRKGSKTRQHQREVHFMKRLPRGHHTTEQSLRFEFLNYPPFTRSLRGSQRTWAPEPR

SEQ ID NO: 5294 - protein, 244 aa, Homo Sapiens
MGSPRSALSCLLLHLLVLCLQAQEGPGRGPALGRELASLFRAGREPQGVSQQVTVQSSPNFTQHVREQSLVTDQLSRRLIRTYQLYSRTSGKHVQVLANKRINAMAEDGDPFAKLIVETDTFGSRVRVRGAETGLYICMNKKGKLIAKSNGKGKDCVFTEIVLENNYTALQNAKYEGWYMAFTRKGRPRKGSKTRQHQREVHFMKRLPRGHHTTEQSLRFEFLNYPPFTRSLRGSQRTWAPEPR

SEQ ID NO: 5295 - protein, 204 aa, Homo Sapiens
MGSPRSALSCLLLHLLVLCLQAQHVREQSLVTDQLSRRLIRTYQLYSRTSGKHVQVLANKRINAMAEDGDPFAKLIVETDTFGSRVRVRGAETGLYICMNKKGKLIAKSNGKGKDCVFTEIVLENNYTALQNAKYEGWYMAFTRKGRPRKGSKTRQHQREVHFMKRLPRGHHTTEQSLRFEFLNYPPFTRSLRGSQRTWAPEPR

SEQ ID NO: 5296 - protein, 37 aa, Homo Sapiens
MGSPRSALSCLLLHLLVLCLQAQVRRGARRRGPGAPV

SEQ ID NO: 5297 - protein, 215 aa, Homo Sapiens
MGSPRSALSCLLLHLLVLCLQAQVTVQSSPNFTQHVREQSLVTDQLSRRLIRTYQLYSRTSGKHVQVLANKRINAMAEDGDPFAKLIVETDTFGSRVRVRGAETGLYICMNKKGKLIAKSNGKGKDCVFTEIVLENNYTALQNAKYEGWYMAFTRKGRPRKGSKTRQHQREVHFMKRLPRGHHTTEQSLRFEFLNYPPFTRSLRGSQRTWAPEPR

SEQ ID NO: 5298 - protein, 234 aa, Homo Sapiens [sequence omitted]

SEQ ID NO: 5299 - protein, 223 aa, Homo Sapiens
MKFVPCLLLVTLSCLGTLGQAPRQKQGSTGEEFHFQTGGRDSCTMRPSSLGQGAGEVWLRVDCRNTDQTYWCEYRGQPSMCQAFAADPKPYWNQALQELRRLHHACQGAPVLRPSVCREAGPQAHMQQVTSSLKGSPEPNQQPEAGTPSLRPKATVKLTEATQLGKDSMEELGKAKPTTRPTAKPTQPGPRPGGNEEAKKKAWEHCWKPFQALCAFLISFFRG

SEQ ID NO: 5300 - protein, 258 aa, Homo Sapiens
MTPPKLRASLSPSLLLLLSGCLLAAARREKGAASNVAEPVPGPTGGSSGRFLSPEQHACSWQLLLPAPEAAAGSELALRCQSPDGARHQCAYRGHPERCAAYAARRAHFWKQVLGGLRKKRRPCHDPAPLQARLCAGKKGHGAELRLVPRASPPARPTVAGFAGESKPRARNRGRTRERASGPAAGTPPPQSAPPKENPSERKTNEGKRKAALVPNEERPMGTGPDPDGLDGNAELTETYCAEKWHSLCNFFVNFWNG

SEQ ID NO: 5301 - protein, 812 aa, Homo Sapiens
MAAVTRDFGEMLLHSGRVLPAEAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNRMPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVMTSPLYLEIIIYCTGAFLISCMVGSVIVYKMKSGTKKSDFHSQMAVHKLAKSIPLRRQVSADSSASMNSGVLLVRPSRLSSSGTPMLAGVSEYELPEDPRWELPRDRLVLGKPLGEGCFGQVVLAEAIGLDKDKPNRVTKVAVKMLKSDATEKDLSDLISEMEMMKMIGKHKNIINLLGACTQDGPLYVIVEYASKGNLREYLQARRPPGLEYCYNPSHNPEEQLSSKDLVSCAYQVARGMEYLASKKCIHRDLAARNVLVTEDNVMKIADFGLARDIHHIDYYKKTTNGRLPVKWMAPEALFDRIYTHQSDVWSFGVLLWEIFTLGGSPYPGVPVEELFKLLKEGHRMDKPSNCTNELYMMMRDCWHAVPSQRPTFKQLVEDLDRIVALTSNQEYLDLSMPLDQYSPSFPDTRSSTCSSGEDSVFSHEPLPEEPCLPRHPAQLANGGLKRR

SEQ ID NO: 5302 - protein, 853 aa, Homo Sapiens
MEARVSLKRRIELTVEYPWRCGALSPTSNCRTGMWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVMTSPLYLEIIIYCTGAFLISCMVGSVIVYKMKSGTKKSDFHSQMAVHKLAKSIPLRRQVTVSADSSASMNSGVLLVRPSRLSSSGTPMLAGVSEYELPEDPRWELPRDRLVLGKPLGEGCFGQVVLAEAIGLDKDKPNRVTKVAVKMLKSDATEKDLSDLISEMEMMKMIGKHKNIINLLGACTQDGPLYVIVEYASKGNLREYLQARRPPGLEYCYNPSHNPEEQLSSKDLVSCAYQVARGMEYLASKKCIHRDLAARNVLVTEDNVMKIADFGLARDIHHIDYYKKTTNGRLPVKWMAPEALFDRIYTHQSDVWSFGVLLWEIFTLGGSPYPGVPVEELFKLLKEGHRMDKPSNCTNELYMMMRDCWHAVPSQRPTFKQLVEDLDRIVALTSNQEYLDLSMPLDQYSPSFPDTRSSTCSSGEDSVFSHEPLPEEPCLPRHPAQLANGGLKRR

SEQ ID NO: 5303 - protein, 139 aa, Homo Sapiens
MEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSK

SEQ ID NO: 5304 - protein, 61 aa, Homo Sapiens
MWSWKCLLFWAVLVTATLCTARPSPTLPEQACPDLQEAKWCSASFHSITPLPFGLGTRLSD

SEQ ID NO: 5305 - protein, 107 aa, Homo Sapiens
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPS

SEQ ID NO: 5306 - protein, 150 aa, Homo Sapiens
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSACPDLQEAKWCSASFHSITPLPFGLGTRLSD

SEQ ID NO: 5307 - protein, 820 aa, Homo Sapiens
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVMTSPLYLEIIIYCTGAFLISCMVGSVIVYKMKSGTKKSDFHSQMAVHKLAKSIPLRRQVTVSADSSASMNSGVLLVRPSRLSSSGTPMLAGVSEYELPEDPRWELPRDRLVLGKPLGEGCFGQVVLAEAIGLDKDKPNRVTKVAVKMLKSDATEKDLSDLISEMEMMKMIGKHKNIINLLGACTQDGPLYVIVEYASKGNLREYLQARRPPGLEYCYNPSHNPEEQLSSKDLVSCAYQVARGMEYLASKKCIHRDLAARNVLVTEDNVMKIADFGLARDIHHIDYYKKTTNGRLPVKWMAPEALFDRIYTHQSDVWSFGVLLWEIFTLGGSPYPGVPVEELFKLLKEGHRMDKPSNCTNELYMMMRDCWHAVPSQRPTFKQLVEDLDRIVALTSNQEYLDLSMPLDQYSPSFPDTRSSTCSSGEDSVFSHEPLPEEPCLPRHPAQLANGGLKRR

SEQ ID NO: 5308 - protein, 820 aa, Homo Sapiens; identical to SEQ ID NO: 5307

SEQ ID NO: 5309 - protein, 820 aa, Homo Sapiens; identical to SEQ ID NO: 5307

SEQ ID NO: 5310 - protein, 822 aa, Homo Sapiens [sequence omitted]

SEQ ID NO: 5311 - protein, 298 aa, Homo Sapiens
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNRMPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGS

SEQ ID NO: 5312 - protein, 820 aa, Homo Sapiens
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNRMPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVMTSPLYLEIIIYCTGAFLISCMVGSVIVYKMKSGTKKSDFHSQMAVHKLAKSIPLRRQVSADSSASMNSGVLLVRPSRLSSSGTPMLAGVSEYELPEDPRWELPRDRLVLGKPLGEGCFGQVVLAEAIGLDKDKPNRVTKVAVKMLKSDATEKDLSDLISEMEMMKMIGKHKNIINLLGACTQDGPLYVIVEYASKGNLREYLQARRPPGLEYCYNPSHNPEEQLSSKDLVSCAYQVARGMEYLASKKCIHRDLAARNVLVTEDNVMKIADFGLARDIHHIDYYKKTTNGRLPVKWMAPEALFDRIYTHQSDVWSFGVLLWEIFTLGGSPYPGVPVEELFKLLKEGHRMDKPSNCTNELYMMMRDCWHAVPSQRPTFKQLVEDLDRIVALTSNQEYLDLSMPLDQYSPSFPDTRSSTCSSGEDSVFSHEPLPEEPCLPRHPAQLANGGLKRR

SEQ ID NO: 5313 - protein, 367 aa, Homo Sapiens
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSVPIDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKHSGINSSDAEVLTLFNVTEAQSGEYVCKVSNYIGEANQSAWLTVTRPVAKDCWS

SEQ ID NO: 5314 - protein, 55 aa, Homo Sapiens
MWSWKCLLFWAVLVTATLCTARPSPTLPEQDALPSSEDDDDDDDSSSEEKETDNT

SEQ ID NO: 5315 - protein, 85 aa, Homo Sapiens
MWSWKCLLFWAVLVTATLCTARPSPTLPEQDALPSSEDDDDDDDSSSEEKETDNTKPNPVAPYWTSPEKMEKKLHAVPAAKTVKF

SEQ ID NO: 5316 - protein, 145 aa, Homo Sapiens
MWSWKCLLFWAVLVTATLCTARPSPTLPEQDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEY

SEQ ID NO: 5317 - protein, 733 aa, Homo Sapiens
MWSWKCLLFWAVLVTATLCTARPSPTLPEQDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKHSGINSSDAEVLTLFNVTEAQSGEYVCKVSNYIGEANQSAWLTVTRPVAKALEERPAVMTSPLYLEIIIYCTGAFLISCMVGSVIVYKMKSGTKKSDFHSQMAVHKLAKSIPLRRQVTVSADSSASMNSGVLLVRPSRLSSSGTPMLAGVSEYELPEDPRWELPRDRLVLGKPLGEGCFGQVVLAEAIGLDKDKPNRVTKVAVKMLKSDATEKDLSDLISEMEMMKMIGKHKNIINLLGACTQDGPLYVIVEYASKGNLREYLQARRPPGLEYCYNPSHNPEEQLSSKDLVSCAYQVARGMEYLASKKCIHRDLAARNVLVTEDNVMKIADFGLARDIHHIDYYKKTTNGRLPVKWMAPEALFDRIYTHQSDVWSFGVLLWEIFTLGGSPYPGVPVEELFKLLKEGHRMDKPSNCTNELYMMMRDCWHAVPSQRPTFKQLVEDLDRIVALTSNQEYLDLSMPLDQYSPSFPDTRSSTCSSGEDSVFSHEPLPEEPCLPRHPAQLANGGLKRR

SEQ ID NO: 5318 - protein, 228 aa, Homo Sapiens
MWSWKCLLFWAVLVTATLCTARPSPTLPEQDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKPWKRGRQ

SEQ ID NO: 5319 - protein, 731 aa, Homo Sapiens
MWSWKCLLFWAVLVTATLCTARPSPTLPEQDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVMTSPLYLEIIIYCTGAFLISCMVGSVIVYKMKSGTKKSDFHSQMAVHKLAKSIPLRRQVTVSADSSASMNSGVLLVRPSRLSSSGTPMLAGVSEYELPEDPRWELPRDRLVLGKPLGEGCFGQVVLAEAIGLDKDKPNRVTKVAVKMLKSDATEKDLSDLISEMEMMKMIGKHKNIINLLGACTQDGPLYVIVEYASKGNLREYLQARRPPGLEYCYNPSHNPEEQLSSKDLVSCAYQVARGMEYLASKKCIHRDLAARNVLVTEDNVMKIADFGLARDIHHIDYYKKTTNGRLPVKWMAPEALFDRIYTHQSDVWSFGVLLWEIFTLGGSPYPGVPVEELFKLLKEGHRMDKPSNCTNELYMMMRDCWHAVPSQRPTFKQLVEDLDRIVALTSNQEYLDLSMPLDQYSPSFPDTRSSTCSSGEDSVFSHEPLPEEPCLPRHPAQLANGGLKRR

SEQ ID NO: 5320 - protein, 142 aa, Homo Sapiens
MWSWKCLLFWAVLVTATLCTARPSPTLPEQDALPSSEDDDDDDDSSSEEKETDNTKPNRMPVAPYWTSPEKMEKKLHAVPAAKTVKFKCPSSGTPNPTLRWLKNGKEFKPDHRIGGYKVRYATWSIIMDSVVPSDKGNYTCI

SEQ ID NO: 5321 - protein, 733 aa, Homo Sapiens
MWSWKCLLFWAVLVTATLCTARPSPTLPEQDALPSSEDDDDDDDSSSEEKETDNTKPNRMPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVMTSPLYLEIIIYCTGAFLISCMVGSVIVYKMKSGTKKSDFHSQMAVHKLAKSIPLRRQVTVSADSSASMNSGVLLVRPSRLSSSGTPMLAGVSEYELPEDPRWELPRDRLVLGKPLGEGCFGQVVLAEAIGLDKDKPNRVTKVAVKMLKSDATEKDLSDLISEMEMMKMIGKHKNIINLLGACTQDGPLYVIVEYASKGNLREYLQARRPPGLEYCYNPSHNPEEQLSSKDLVSCAYQVARGMEYLASKKCIHRDLAARNVLVTEDNVMKIADFGLARDIHHIDYYKKTTNGRLPVKWMAPEALFDRIYTHQSDVWSFGVLLWEIFTLGGSPYPGVPVEELFKLLKEGHRMDKPSNCTNELYMMMRDCWHAVPSQRPTFKQLVEDLDRIVALTSNQEYLDLSMPLDQYSPSFPDTRSSTCSSGEDSVFSHEPLPEEPCLPRHPAQLANGGLKRR

SEQ ID NO: 5322 - protein, 134 aa, Homo Sapiens
VSCAYQVARGMEYLASKKCIHRDLAARNVLVTEDNVMKIADFGLARDIHHIDYYKKTTNGRLPVKWMAPEALFDRIYTHQSDVWSFGVLLWEIFTLGGSPYPGVPVEELFKLLKEGHRMDKPSNCTNELPAAGT

SEQ ID NO: 5323 - protein, 371 aa, Homo Sapiens
FSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELNTWTSANLSNSIHLVTLTQEVLVLQEMILFFLQTPCLTNHAFLSIHT

SEQ ID NO: 5324 - protein, 593 aa, Homo Sapiens
MCLNKTKQLFGVAKRLPFWRKERSPHRPILQAGLPANASTVVGGDVEFVCKVYSDAQPHIQWIKHVEKNGSKYGPDGLPYLKVLKAAGVNTTDKEIEVLYIRNVTFEDAGEYTCLAGNSIGISFHSAWLTVLPAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 5325 - protein, 669 aa, Homo Sapiens
MVSWGRFICLVVVTMATLSLARPSFSLVEDTTLEPEDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKAAGVNTTDKEIEVLYIRNVTFEDAGEYTCLAGNSIGISFHSAWLTVLPAPGREKEITASPDYLEIAIYCIGVFLIACMVVTVILCRMKNTTKKPDFSSQPAVHKLTKRIPLRRQVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRI

SEQ ID NO: 5326 - protein, 707 aa, Homo Sapiens
MVSWGRFICLVVVTMATLSLARPSFSLVEDTTLEPEDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKAAGVNTTDKEIEVLYIRNVTFEDAGEYTCLAGNSIGISFHSAWLTVLPAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEEKKVSGAVDCHKPPCNPSHLPCVLAVDQ

SEQ ID NO: 5327 - protein, 732 aa, Homo Sapiens
MVSWGRFICLVVVTMATLSLARPSFSLVEDTTLEPEDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKAAGVNTTDKEIEVLYIRNVTFEDAGEYTCLAGNSIGISFHSAWLTVLPAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 5328 - protein, 680 aa, Homo Sapiens
MVSWGRFICLVVVTMATLSLARPSFSLVEDTTLEPEDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKHSGINSSNAEVLALFNVTEADAGEYICKVSNYIGQANQSAWLTVLPKQQAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEI

SEQ ID NO: 5329 - protein, 64 aa, Homo Sapiens
MVSWGRFICLVVVTMATLSLARPSFSLVEDTTLEPEDAISSGDDEDDTDGAEDFVSENSNNKSK

SEQ ID NO: 5330 - protein, 144 aa, Homo Sapiens
MVSWGRFICLVVVTMATLSLARPSFSLVEDTTLEPEEPPTKYQISQPEVYVAAPGESLEMPSHPEMMRMTPMVRKILSVRTVTTRVSNCPAPMVPERGAWREVLPVTCLLVDSSAPCCVPRPLPFPAVSTFLTFKPENKPVLLH

SEQ ID NO: 5331 - protein, 709 aa, Homo Sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 5332 - protein, 821 aa, Homo Sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKAAGVNTTDKEIEVLYIRNVTFEDAGEYTCLAGNSIGISFHSAWLTVLPAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 5333 - protein, 821 aa, Homo Sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKVFAAGVNTTDKEIEVLYIRNVTFEDAGEYTCLAGNSIGISFHSAWLTVLPAPGREKEITASPDYLEIAIYCIGVFLIACMVVTVILCRMKNTTKKPDFSSQPAVHKLTKRIPLRRQVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 5334 - protein, 819 aa, Homo Sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKAAGVNTTDKEIEVLYIRNVTFEDAGEYTCLAGNSIGISFHSAWLTVLPAPGREKEITASPDYLEIAIYCIGVFLIACMVVTVILCRMKNTTKKPDFSSQPAVHKLTKRIPLRRQVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 5335 - protein, 768 aa, Homo Sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKHSGINSSNAEVLALFNVTEADAGEYICKVSNYIGQANQSAWLTVLPKQQAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNE

SEQ ID NO: 5336 - protein, 769 aa, Homo Sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKHSGINSSNAEVLALFNVTEADAGEYICKVSNYIGQANQSAWLTVLPKQQAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEI

SEQ ID NO: 5337 - protein, 705 aa, Homo Sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 5338 - protein, 822 aa, Homo Sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKHSGINSSNAEVLALFNVTEADAGEYICKVSNYIGQANQSAWLTVLPKQQAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 5339 - protein, 254 aa, Homo Sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVGSQGL

SEQ ID NO: 5340 - protein, 704 aa, Homo Sapiens
MVSWGRFICLVVVTMATLSLARPSFSLVEDTTLEPEGAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKAAGVNTTDKEIEVLYIRNVTFEDAGEYTCLAGNSIGISFHSAWLTVLPAPGREKEITASPDYLEIAIYCIGVFLIACMVVTVILCRMKNTTKKPDFSSQPAVHKLTKRIPLRRQVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 5341 - protein, 707 aa, Homo Sapiens
MVSWGRFICLVVVTMATLSLARPSFSLVEDTTLEPEGAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKHSGINSSNAEVLALFNVTEADAGEYICKVSNYIGQANQSAWLTVLPKQQAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 5342 - protein, 251 aa, Homo Sapiens
MVSWGRFICLVVVTMATLSLARPSFSLVEDTTLEPEGAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKHSGINSSNAEVLALFNVTEADAGEYICKVSNYIGQANQSAWLTVLPKQQGRRC

SEQ ID NO: 5343 - protein, 86 aa, Homo Sapiens
  misc_feature (1)..(1): Xaa can be any naturally occurring amino acid
XPYPGIPVEELFKLLKEGHRMDKPANCTNELYMMMRDCWHAVPSQRPTFKQLVEDLDRILTLTTNEEYLDLSQPLEPYSPCYPDPR

SEQ ID NO: 5344 - protein, 136 aa, Homo Sapiens
  misc_feature (1)..(1): Xaa can be any naturally occurring amino acid
XSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKSK

SEQ ID NO: 5345 - protein, 364 aa, Homo Sapiens
MGAPACALALCVAVAIVAGASSESLGTEQRVVGRAAEVPGPEPGQQEQLVFGSGDAVELSCPPPGGGPMGPTVWVKDGTGLVPSERVLVGPQRLQVLNASHEDSGAYSCRQRLTQRVLCHFSVRVTDAPSSGDDEDGEDEAEDTGVDTGAPYWTRPERMDKKLLAVPAANTVRFRCPAAGNPTPSISWLKNGREFRGEHRIGGIKLRHQQWSLVMESVVPSDRGNYTCVVENKFGSIRQTYTLDVLERSPHRPILQAGLPANQTAVLGSDVEFHCKVYSDAQPHIQWLKHVEVNGSKVGPDGTPYVTVLKSWISESVEADVRLRLANVSERDGGEYLCRATNFIGVAEKAFWLSVHGPRADGGR

SEQ ID NO: 5346 - protein, 694 aa, Homo Sapiens
MGAPACALALCVAVAIVAGASSESLGTEQRVVGRAAEVPGPEPGQQEQLVFGSGDAVELSCPPPGGGPMGPTVWVKDGTGLVPSERVLVGPQRLQVLNASHEDSGAYSCRQRLTQRVLCHFSVRVTDAPSSGDDEDGEDEAEDTGVDTGAPYWTRPERMDKKLLAVPAANTVRFRCPAAGNPTPSISWLKNGREFRGEHRIGGIKLRHQQWSLVMESVVPSDRGNYTCVVENKFGSIRQTYTLDVLERSPHRPILQAGLPANQTAVLGSDVEFHCKVYSDAQPHIQWLKHVEVNGSKVGPDGTPYVTVLKVSLESNASMSSNTPLVRIARLSSGEGPTLANVSELELPADPKWELSRARLTLGKPLGEGCFGQVVMAEAIGIDKDRAAKPVTVAVKMLKDDATDKDLSDLVSEMEMMKMIGKHKNIINLLGACTQGGPLYVLVEYAAKGNLREFLRARRPPGLDYSFDTCKPPEEQLTFKDLVSCAYQVARGMEYLASQKCIHRDLAARNVLVTEDNVMKIADFGLARDVHNLDYYKKTTNGRLPVKWMAPEALFDRVYTHQSDVWSFGVLLWEIFTLGGSPYPGIPVEELFKLLKEGHRMDKPANCTHDLYMIMRECWHAAPSQRPTFKQLVEDLDRVLTVTSTDEYLDLSAPFEQYSPGGQDTPSSSSSGDDSVFAHDLLPPAPPSSGGSRT

SEQ ID NO: 5347 - protein, 808 aa, Homo Sapiens
MGAPACALALCVAVAIVAGASSESLGTEQRVVGRAAEVPGPEPGQQEQLVFGSGDAVELSCPPPGGGPMGPTVWVKDGTGLVPSERVLVGPQRLQVLNASHEDSGAYSCRQRLTQRVLCHFSVRVTDAPSSGDDEDGEDEAEDTGVDTGAPYWTRPERMDKKLLAVPAANTVRFRCPAAGNPTPSISWLKNGREFRGEHRIGGIKLRHQQWSLVMESVVPSDRGNYTCVVENKFGSIRQTYTLDVLERSPHRPILQAGLPANQTAVLGSDVEFHCKVYSDAQPHIQWLKHVEVNGSKVGPDGTPYVTVLKSWISESVEADVRLRLANVSERDGGEYLCRATNFIGVAEKAFWLSVHGPRAAEEELVEADEAGSVYAGILSYGVGFFLFILVVAAVTLCRLRSPPKKGLGSPTVHKISRFPLKRQVSLESNASMSSNTPLVRIARLSSGEGPTLANVSELELPADPKWELSRARLTLGKPLGEGCFGQVVMAEAIGIDKDRAAKPVTVAVKMLKDDATDKDLSDLVSEMEMMKMIGKHKNIINLLGACTQGGPLYVLVEYAAKGNLREFLRARRPPGLDYSFDTCKPPEEQLTFKDLVSCAYQVARGMEYLASQKCIHRDLAARNVLVTEDNVMKIADFGLARDVHNLDYYKKTTNGRLPVKWMAPEALFDRVYTHQSDVWSFGVLLWEIFTLGGSPYPGIPVEELFKLLKEGHRMDKPANCTHDLYMIMRECWHAAPSQRPTFKQLVEDLDRVLTVTSTDEYLDLSAPFEQYSPGGQDTPSSSSSGDDSVFAHDLLPPAPPSSGGSRT

SEQ ID NO: 5348 - protein, 806 aa, Homo Sapiens
MGAPACALALCVAVAIVAGASSESLGTEQRVVGRAAEVPGPEPGQQEQLVFGSGDAVELSCPPPGGGPMGPTVWVKDGTGLVPSERVLVGPQRLQVLNASHEDSGAYSCRQRLTQRVLCHFSVRVTDAPSSGDDEDGEDEAEDTGVDTGAPYWTRPERMDKKLLAVPAANTVRFRCPAAGNPTPSISWLKNGREFRGEHRIGGIKLRHQQWSLVMESVVPSDRGNYTCVVENKFGSIRQTYTLDVLERSPHRPILQAGLPANQTAVLGSDVEFHCKVYSDAQPHIQWLKHVEVNGSKVGPDGTPYVTVLKTAGANTTDKELEVLSLHNVTFEDAGEYTCLAGNSIGFSHHSAWLVVLPAEEELVEADEAGSVYAGILSYGVGFFLFILVVAAVTLCRLRSPPKKGLGSPTVHKISRFPLKRQVSLESNASMSSNTPLVRIARLSSGEGPTLANVSELELPADPKWELSRARLTLGKPLGEGCFGQVVMAEAIGIDKDRAAKPVTVAVKMLKDDATDKDLSDLVSEMEMMKMIGKHKNIINLLGACTQGGPLYVLVEYAAKGNLREFLRARRPPGLDYSFDTCKPPEEQLTFKDLVSCAYQVARGMEYLASQKCIHRDLAARNVLVTEDNVMKIADFGLARDVHNLDYYKKTTNGRLPVKWMAPEALFDRVYTHQSDVWSFGVLLWEIFTLGGSPYPGIPVEELFKLLKEGHRMDKPANCTHDLYMIMRECWHAAPSQRPTFKQLVEDLDRVLTVTSTDEYLDLSAPFEQYSPGGQDTPSSSSSGDDSVFAHDLLPPAPPSSGGSRT

SEQ ID NO: 5349 - protein, 694 aa, Homo Sapiens; identical to SEQ ID NO: 5346

SEQ ID NO: 5350 - protein, 792 aa, Homo Sapiens
MGAPACALALCVAVAIVAGASSESLGTEQRVVGRAAEVPGPEPGQQEQLVFGSGDAVELSCPPPGGGPMGPTVWVKDGTGLVPSERVLVGPQRLQVLNASHEDSGAYSCRQRLTQRVLCHFSVRVTDAPSSGDDEDGEDEAEDTGVDTGAPYWTRPERMDKKLLAVPAANTVRFRCPAAGNPTPSISWLKNGREFRGEHRIGGIKLRHQQWSLVMESVVPSDRGNYTCVVENKFGSIRQTYTLDVLERSPHRPILQAGLPANQTAVLGSDVEFHCKVYSDAQPHIQWLKHVEVNGSKVGPDGTPYVTVLKTAGANTTDKELEVLSLHNVTFEDAGEYTCLAGNSIGFSHHSAWLVVLPAEEELVEADEAGSVYAGILSYGVGFFLFILVVAAVTLCRLRSPPKKGLGSPTVHKISRFPLKRQQVSLESNASMSSNTPLVRIARLSSGEGPTLANVSELELPADPKWELSRARLTLGKPLGEGCFGQVVMAEAIGIDKDRAAKPVTVAVKMLKDDATDKDLSDLVSEMEMMKMIGKHKNIINLLGACTQGGPLYVLVEYAAKGNLREFLRARRPPGLDYSFDTCKPPEEQLTFKDLVSCAYQVARGMEYLASQKCIHRDLAARNVLVTEDNVMKIADFGLARDVHNLDYYKKTTNLVLWGPALGDLHAGGLPVPRHPCGGALQAAEGGPPHGQARQLHTRPVHDHAGVLACRALPEAHLQAAGGGPGPCPYRDVHRRVPGPVGAFRAVLPGWPGHPQLQLLRGRLRVCPRPAAPGPTQQWGLADVKGHWSPTM

SEQ ID NO: 5351 - protein, 364 aa, Homo Sapiens; identical to SEQ ID NO: 5345

SEQ ID NO: 5352 - protein, 112 aa, Homo Sapiens
NPTPSISWLKNGREFRGEHRIGGIKLRHQQWSLVMESVVPSDRGNYTCVVENKFGSIRQTYTLDVLERSPHRPILQAGLPANQTAVLGSDVEFHCKTAGANTTDKELEVLSL

SEQ ID NO: 5353 - protein, 72 aa, Homo Sapiens
MRLLLALLGVLLSVPGPPVLSLEASEEVELASIHLSLCLRERTGLAGRRALSWAAELVSPAWLPAWSSKSRS

SEQ ID NO: 5354 - protein, 87 aa, Homo Sapiens
MRLLLALLGVLLSVPGPPVLSLEASEEVELEPCLAPSLEQQEQELTVALGQPVRLCCGRAERGGHWYKEGSRLAPAGRVRGWRGRLE

SEQ ID NO: 5355 - protein, 108 aa, Homo Sapiens
MRLLLALLGVLLSVPGPPVLSLEASEEVELEPCLAPSLEQQEQELTVALGQPVRLCCGRAERGGHWYKEGSRLAPAGRVRGWRGRLEIASFLPEDAGRYLCLARGSMI

SEQ ID NO: 5356 - protein, 114 aa, Homo Sapiens
MRLLLALLGVLLSVPGPPVLSLEASEEVELEPCLAPSLEQQEQELTVALGQPVRLCCGRAERGGHWYKEGSRLAPAGRVRGWRGRLEIASFLPEDAGRYLCLARGSMIVLQNLT

SEQ ID NO: 5357 - protein, 201 aa, Homo Sapiens
MRLLLALLGVLLSVPGPPVLSLEASEEVELEPCLAPSLEQQEQELTVALGQPVRLCCGRAERGGHWYKEGSRLAPAGRVRGWRGRLEIASFLPEDAGRYLCLARGSMIVLQNLTLITGDSLTSSNDDEDPKSHRDPSNRHSYPQQAPYWTHPQRMEKKLHAVPAGNTVKFRCPAAGNPTPTIRWLKDGQAFHGENRIGGIR

SEQ ID NO: 5358 - protein, 802 aa, Homo Sapiens
MRLLLALLGVLLSVPGPPVLSLEASEEVELEPCLAPSLEQQEQELTVALGQPVRLCCGRAERGGHWYKEGSRLAPAGRVRGWRGRLEIASFLPEDAGRYLCLARGSMIVLQNLTLITGDSLTSSNDDEDPKSHRDPSNRHSYPQQAPYWTHPQRMEKKLHAVPAGNTVKFRCPAAGNPTPTIRWLKDGQAFHGENRIGGIRLRHQHWSLVMESVVPSDRGTYTCLVENAVGSIRYNYLLDVLERSPHRPILQAGLPANTTAVVGSDVELLCKVYSDAQPHIQWLKHIVINGSSFGADGFPYVQVLKTADINSSEVEVLYLRNVSAEDAGEYTCLAGNSIGLSYQSAWLTVLPEEDPTWTAAAPEARYTDIILYASGSLALAVLLLLAGLYRGQALHGRHPRPPATVQKLSRFPLARQFSLESGSSGKSSSSLVRGVRLSSSGPALLAGLVSLDLPLDPLWEFPRDRLVLGKPLGEGCFGQVVRAEAFGMDPARPDQASTVAVKMLKDNASDKDLADLVSEMEVMKLIGRHKNIINLLGVCTQEGPLYVIVECAAKGNLREFLRARRPPGPDLSPDGPRSSEGPLSFPVLVSCAYQVARGMQYLESRKCIHRDLAARNVLVTEDNVMKIADFGLARGVHHIDYYKKTSNGRLPVKWMAPEALFDRVYTHQSDVWSFGILLWEIFTLGGSPYPGIPVEELFSLLREGHRMDRPPHCPPELYGLMRECWHAAPSQRPTFKQLVEALDKVLLAVSEEYLDLRLTFGPYSPSGGDASSTCSSSDSVFSHDPLPLGSSSFPFGSGVQT

SEQ ID NO: 5359 - protein, 762 aa, Homo Sapiens
MRLLLALLGVLLSVPGPPVLSLEASEEVELEPCLAPSLEQQEQELTVALGQPVRLCCGRAERGGHWYKEGSRLAPAGRVRGWRGRLEIASFLPEDAGRYLCLARGSMIVLQNLTLITGDSLTSSNDDEDPKSHRDPSNRHSYPQQAPYWTHPQRMEKKLHAVPAGNTVKFRCPAAGNPTPTIRWLKDGQAFHGENRIGGIRLRHQHWSLVMESVVPSDRGTYTCLVENAVGSIRYNYLLDVLERSPHRPILQAGLPANTTAVVGSDVELLCKVYSDAQPHIQWLKHIVINGSSFGADGFPYVQVLKTADINSSEVEVLYLRNVSAEDAGEYTCLAGNSIGLSYQSAWLTVLPGTGRIPHLTCDSLTPAGRTKSPTLQFSLESGSSGKSSSSLVRGVRLSSSGPALLAGLVSLDLPLDPLWEFPRDRLVLGKPLGEGCFGQVVRAEAFGMDPARPDQASTVAVKMLKDNASDKDLADLVSEMEVMKLIGRHKNIINLLGVCTQEGPLYVIVECAAKGNLREFLRARRPPGPDLSPDGPRSSEGPLSFPVLVSCAYQVARGMQYLESRKCIHRDLAARNVLVTEDNVMKIADFGLARGVHHIDYYKKTSNGRLPVKWMAPEALFDRVYTHQSDVWSFGILLWEIFTLGGSPYPGIPVEELFSLLREGHRMDRPPHCPPELYGLMRECWHAAPSQRPTFKQLVEALDKVLLAVSEEYLDLRLTFGPYSPSGGDASSTCSSSDSVFSHDPLPLGSSSFPFGSGVQT

SEQ ID NO: 5360 - protein, 734 aa, Homo Sapiens
MRLLLALLGVLLSVPGPPVLSLEASEEVELEPCLAPSLEQQEQELTVALGQPVRLCCGRAERGGHWYKEGSRLAPAGRVRGWRGRLEIASFLPEDAGRYLCLARGSMIVLQNLTLITGDSLTSSNDDEDPKSHRDPSNRHSYPQQAPYWTHPQRMEKKLHAVPAGNTVKFRCPAAGNPTPTIRWLKDGQAFHGENRIGGIRLRHQHWSLVMESVVPSDRGTYTCLVENAVGSIRYNYLLDVLERSPHRPILQAGLPANTTAVVGSDVELLCKVYSDAQPHIQWLKHIVINGSSFGADGFPYVQVLKTADINSSEVEVLYLRNVSAEDAGEYTCLAGNSIGLSYQSAWLTVLPEEDPTWTAAAPEASSPWSQALPASQAHPWYEACVSPPAAPPCSPASLVLGKPLGEGCFGQVVRAEAFGMDPARPDQASTVAVKMLKDNASDKDLADLVSEMEVMKLIGRHKNIINLLGVCTQEGPLYVIVECAAKGNLREFLRARRPPGPDLSPDGPRSSEGPLSFPVLVSCAYQVARGMQYLESRKCIHRDLAARNVLVTEDNVMKIADFGLARGVHHIDYYKKTSNGRLPVKWMAPEALFDRVYTHQSDVWSFGILLWEIFTLGGSPYPGIPVEELFSLLREGHRMDRPPHCPPELYGLMRECWHAAPSQRPTFKQLVEALDKVLLAVSEEYLDLRLTFGPYSPSGGDASSTCSSSDSVFSHDPLPLGSSSFPFGSGVQT

SEQ ID NO: 5361 - protein, 802 aa, Homo Sapiens; identical to SEQ ID NO: 5358

SEQ ID NO: 5362 - protein, 280 aa, Homo Sapiens
  misc_feature (1)..(1): Xaa can be any naturally occurring amino acid
XRYTDIILYASGSLALAVLLLLAGLYRGQALHGRHPRPPATVQKLSRFPLARQSGSSGKSSSSLVRGVRLSSSGPALLAGLVSLDLPLDPLWEFPRDRLVLGKPLGEGCFGQVVRAEAFGMDPARPDQASTVAVKMLKDNASDKDLADLVSEMEVMKLIGRHKNIINLLGVCTQEGPLYVIVECAAKGNLREFLRARRPPGPDLSPDGPRSSEGPLSFPVLVSCAYQVARGMQYLESRKCIHRDLAARNVLVTEDNVMKIADFGLARGVHHIDYYKKTSN

SEQ ID NO: 5363 - protein, 80 aa, Homo Sapiens
MTPSPLLLLLLPPLLLGAFPPAAAARGPPKMADKVVPRQVARLGRTVRLQCPVEGDPPPLTMWTKDGRTIHSGWSRFRVL

SEQ ID NO: 5364 - protein, 152 aa, Homo Sapiens
MTPSPLLLLLLPPLLLGAFPPAAAARGPPKMADKVVPRQVARLGRTVRLQCPVEGDPPPLTMWTKDGRTIHSGWSRFRVLPQGLKVKQVEREDAGVYVCKATNGFGSLSVNYTLVVLDDISPGKESLGPDSSSGGQEDPASQQWARPRFTQP

SEQ ID NO: 5365 - protein, 504 aa, Homo Sapiens
MTPSPLLLLLLPPLLLGAFPPAAAARGPPKMADKVVPRQVARLGRTVRLQCPVEGDPPPLTMWTKDGRTIHSGWSRFRVLPQGLKVKQVEREDAGVYVCKATNGFGSLSVNYTLVVLDDISPGKESLGPDSSSGGQEDPASQQWARPRFTQPSKMRRRVIARPVGSSVRLKCVASGHPRPDITWMKDDQALTRPEAAEPRKKKWTLSLKNLRPEDSGKYTCRVSNRAGAINATYKVDVIQRTRSKPVLTGTHPVNTTVDFGGTTSFQCKVRSDVKPVIQWLKRVEYGAEGRHNSTIDVGGQKFVVLPTGDVWSRPDGSYLNKLLITRARQDDAGMYICLGANTMGYSFRSAFLTVLPDPKPPGPPVASSSSATSLPWPVVIGIPAGAVFILGTLLLWLCQAQKKPCTPAPAPPLPGHRPPGTARDRSGDKDLPSLAALSAGPGVGLCEEHGSPAAPQHLLGPGPVAGPKLYPKLYTDIHTHTHTHSHTHSHVEGKVHQHIHYQC

SEQ ID NO: 5366 - protein, 504 aa, Homo Sapiens; identical to SEQ ID NO: 5365

SEQ ID NO: 5367 - protein, 504 aa, Homo Sapiens; identical to SEQ ID NO: 5365

SEQ ID NO: 5368 - protein, 504 aa, Homo Sapiens; identical to SEQ ID NO: 5365

SEQ ID NO: 5369 - protein, 119 aa, Homo Sapiens
MIDAATLKSRKMLEEIMKYEASILTHDSSIRYLQEIYNSNNQKIVNLKEKVAQLEAQCQEPCKDTVQIHDITGKDCQDIANKGAKQSGLYFIKPLKANQQFLVYCEIDGSGNGWTVFQK

SEQ ID NO: 5370 - protein, 123 aa, Homo Sapiens
MIDAATLKSRKMLEEIMKYEASILTHDSSIRYLQEIYNSNNQKIVNLKEKVAQLEAQCQEPCKDTVQIHDITGKDCQDIANKGAKQSGLYFIKPLKANQQFLVYCEIDGSGNGWTVFQKRLDG

SEQ ID NO: 5371 - protein, 453 aa, Homo Sapiens
MSWSLHPRNLILYFYALLFLSSTCVAYVATRDNCCILDERFGSYCPTTCGIADFLSTYQTKVDKDLQSLEDILHQVENKTSEVKQLIKAIQLTYNPDESSKPNMIDAATLKSRKMLEEIMKYEASILTHDSSIRYLQEIYNSNNQKIVNLKEKVAQLEAQCQEPCKDTVQIHDITGKDCQDIANKGAKQSGLYFIKPLKANQQFLVYCEIDGSGNGWTVFQKRLDGSVDFKKNWIQYKEGFGHLSPTGTTEFWLGNEKIHLISTQSAIPYALRVELEDWNGRTSTADYAMFKVGPEADKYRLTYAYFAGGDAGDAFDGFDFGDDPSDKFFTSHNGMQFSTWDNDNDKFEGNCAEQDGSGWWMNKCHAGHLNGVYYQGGTYSKASTPNGYDNGIIWATWKTRWYSMKKTTMKIIPFNRLTIGEGQQHHLGGAKQVRPEHPAETEYDSLYPEDDL

SEQ ID NO: 5372 - protein, 437 aa, Homo Sapiens
MSWSLHPRNLILYFYALLFLSSTCVAYVATRDNCCILDERFGSYCPTTCGIADFLSTYQTKVDKDLQSLEDILHQVENKTSEVKQLIKAIQLTYNPDESSKPNMIDAATLKSRKMLEEIMKYEASILTHDSSIRYLQEIYNSNNQKIVNLKEKVAQLEAQCQEPCKDTVQIHDITGKDCQDIANKGAKQSGLYFIKPLKANQQFLVYCEIDGSGNGWTVFQKRLDGSVDFKKNWIQYKEGFGHLSPTGTTEFWLGNEKIHLISTQSAIPYALRVELEDWNGRTSTADYAMFKVGPEADKYRLTYAYFAGGDAGDAFDGFDFGDDPSDKFFTSHNGMQFSTWDNDNDKFEGNCAEQDGSGWWMNKCHAGHLNGVYYQGGTYSKASTPNGYDNGIIWATWKTRWYSMKKTTMKIIPFNRLTIGEGQQHHLGGAKQAGDV

SEQ ID NO: 5373 - protein, 461 aa, Homo Sapiens
MSWSLHPRNLILYFYALLFLSSTCVAYVATRDNCCILDERFGSYCPTTCGIADFLSTYQTKVDKDLQSLEDILHQVENKTSEVKQLIKAIQLTYNPDESSKPNMIDAATLKSRKMLEEIMKYEASILTHDSSIRYLQEIYNSNNQKIVNLKEKVAQLEAQCQEPCKDTVQIHDITGKVKVDSPSLDCQDIANKGAKQSGLYFIKPLKANQQFLVYCEIDGSGNGWTVFQKRLDGSVDFKKNWIQYKEGFGHLSPTGTTEFWLGNEKIHLISTQSAIPYALRVELEDWNGRTSTADYAMFKVGPEADKYRLTYAYFAGGDAGDAFDGFDFGDDPSDKFFTSHNGMQFSTWDNDNDKFEGNCAEQDGSGWWMNKCHAGHLNGVYYQGGTYSKASTPNGYDNGIIWATWKTRWYSMKKTTMKIIPFNRLTIGEGQQHHLGGAKQVRPEHPAETEYDSLYPEDDL

SEQ ID NO: 5374 - protein, 445 aa, Homo Sapiens
MSWSLHPRNLILYFYALLFLSSTCVAYVATRDNCCILDERFGSYCPTTCGIADFLSTYQTKVDKDLQSLEDILHQVENKTSEVKQLIKAIQLTYNPDESSKPNMIDAATLKSRKMLEEIMKYEASILTHDSSIRYLQEIYNSNNQKIVNLKEKVAQLEAQCQEPCKDTVQIHDITGKVKVDSPSLDCQDIANKGAKQSGLYFIKPLKANQQFLVYCEIDGSGNGWTVFQKRLDGSVDFKKNWIQYKEGFGHLSPTGTTEFWLGNEKIHLISTQSAIPYALRVELEDWNGRTSTADYAMFKVGPEADKYRLTYAYFAGGDAGDAFDGFDFGDDPSDKFFTSHNGMQFSTWDNDNDKFEGNCAEQDGSGWWMNKCHAGHLNGVYYQGGTYSKASTPNGYDNGIIWATWKTRWYSMKKTTMKIIPFNRLTIGEGQQHHLGGAKQAGDV

SEQ ID NO: 5375 - protein, 312 aa, Homo Sapiens
MAKVFSFILVTTALTMGREISALEDCAQEQMRLRAQVRLLETRVKQQQVKIKQLLQENEVQFLDKGDENTVIDLGSKRQYADCSEIFNDGYKLSGFYKIKPLQSPAEFSVYCDMSDGGGWTVIQRRSDGSENFNRGWKDYENGFGNFVQKHGEYWLGNKNLHFLTTQEDYTLKIDLADFEKNSRYAQYKNFKVGDEKNFYELNIGEYSGTAGDSLAGNFHPEVQWWASHQRMKFSTWDRDHDNYEGNCAEEDQSGWWFNRCHSANLNGVYYSGPYTAKTDNGIVWYTWHGWWYSLKSVVMKIRPNDFIPNVI

SEQ ID NO: 5376 - protein, 312 aa, Homo Sapiens; identical to SEQ ID NO: 5375

SEQ ID NO: 5377 - protein, 312 aa, Homo Sapiens; identical to SEQ ID NO: 5375

SEQ ID NO: 5378 - protein, 312 aa, Homo Sapiens; identical to SEQ ID NO: 5375

SEQ ID NO: 5379 - protein, 312 aa, Homo Sapiens; identical to SEQ ID NO: 5375

SEQ ID NO: 5380 - protein, 312 aa, Homo Sapiens; identical to SEQ ID NO: 5375

SEQ ID NO: 5381 - protein, 312 aa, Homo Sapiens; identical to SEQ ID NO: 5375

SEQ ID NO: 5382 - protein, 225 aa, Homo Sapiens
MKLANWYWLSSAVLATYGFLVVANNETEEIKDERAKDVCPVRLESRGKCEEAGECPYQVSLPPLTIQLPKQFSRIEEVFKEVQNLKEIVNSLKKSCQDCKLQADDNGDPGRNGLLLPSTGAPGEVGDNRVRELESEVNKLSSELKNAKEEINVLHGRLEKLNLVNMNNIENYVDSKVANLTFVVNSLDGKCSKCPSQEQIQSRPGMYNNVFLSYVHKCYTAREYL

SEQ ID NO: 5383 - protein, 439 aa, Homo Sapiens
MKLANWYWLSSAVLATYGFLVVANNETEEIKDERAKDVCPVRLESRGKCEEAGECPYQVSLPPLTIQLPKQFSRIEEVFKEVQNLKEIVNSLKKSCQDCKLQADDNGDPGRNGLLLPSTGAPGEVGDNRVRELESEVNKLSSELKNAKEEINVLHGRLEKLNLVNMNNIENYVDSKVANLTFVVNSLDGKCSKCPSQEQIQSRPVQHLIYKDCSDYYAIGKRSSETYRVTPDPKNSSFEVYCDMETMGGGWTVLQARLDGSTNFTRTWQDYKAGFGNLRREFWLGNDKIHLLTKSKEMILRIDLEDFNGVELYALYDQFYVANEFLKYRLHVGNYNGTAGDALRFNKHYNHDLKFFTTPDKDNDRYPSGNCGLYYSSGWWFDACLSANLNGKYYHQKYRGVRNGIFWGTWPGVSEAHPGGYKSSFKEAKMMIRPKHFKP

SEQ ID NO: 5384 - protein, 18 aa, Homo Sapiens
MAEKFDCHYCRDPLQGKK

SEQ ID NO: 5385 - protein, 66 aa, Homo Sapiens
MAEKFDCHYCRDPLQGKKYVQKDGHHCCLKCFDKFCANTCVECRKPIGADSKEVHYKNRFWHDTCF

SEQ ID NO: 5386 - protein, 78 aa, Homo Sapiens
MAEKFDCHYCRDPLQGKKYVQKDGHHCCLKCFDKFCANTCVECRKPIGADSKEVHYKNRFWHDTCFRCAKCLHPLANE

SEQ ID NO: 5387 - protein, 130 aa, Homo Sapiens
MAEKFDCHYCRDPLQGKKYVQKDGHHCCLKCFDKFCANTCVECRKPIGADSKEVHYKNRFWHDTCFRCAKCLHPLANETFVAKDNKILCNKCTTREDSPKCKGCFKAIVAGDQNVEYKGTVWHKDCFTCS

SEQ ID NO: 5388 - protein, 138 aa, Homo Sapiens
MAEKFDCHYCRDPLQGKKYVQKDGHHCCLKCFDKFCANTCVECRKPIGADSKEVHYKNRFWHDTCFRCAKCLHPLANETFVAKDNKILCNKCTTREDSPKCKGCFKAIVAGDQNVEYKGTVWHKDCFTCSNCKQVIGT

SEQ ID NO: 5389 - protein, 141 aa, Homo Sapiens
MAEKFDCHYCRDPLQGKKYVQKDGHHCCLKCFDKFCANTCVECRKPIGADSKEVHYKNRFWHDTCFRCAKCLHPLANETFVAKDNKILCNKCTTREDSPKCKGCFKAIVAGDQNVEYKGTVWHKDCFTCSNCKQVIGTGSF

SEQ ID NO: 5390 - protein, 147 aa, Homo Sapiens
MAEKFDCHYCRDPLQGKKYVQKDGHHCCLKCFDKFCANTCVECRKPIGADSKEVHYKNRFWHDTCFRCAKCLHPLANETFVAKDNKILCNKCTTREDSPKCKGCFKAIVAGDQNVEYKGTVWHKDCFTCSNCKQVIGTGSFFPKGED

SEQ ID NO: 5391 - protein, 152 aa, Homo Sapiens
MAEKFDCHYCRDPLQGKKYVQKDGHHCCLKCFDKFCANTCVECRKPIGADSKEVHYKNRFWHDTCFRCAKCLHPLANETFVAKDNKILCNKCTTREDSPKCKGCFKAIVAGDQNVEYKGTVWHKDCFTCSNCKQVIGTGSFFPKGEDFYCVT

SEQ ID NO: 5392 - protein, 155 aa, Homo Sapiens
MAEKFDCHYCRDPLQGKKYVQKDGHHCCLKCFDKFCANTCVECRKPIGADSKEVHYKNRFWHDTCFRCAKCLHPLANETFVAKDNKILCNKCTTREDSPKCKGCFKAIVAGDQNVEYKGTVWHKDCFTCSNCKQVIGTGSFFPKGEDFYCVTCHE

SEQ ID NO: 5393 - protein, 175 aa, Homo Sapiens
MAEKFDCHYCRDPLQGKKYVQKDGHHCCLKCFDKFCANTCVECRKPIGADSKEVHYKNRFWHDTCFRCAKCLHPLANETFVAKDNKILCNKCTTREDSPKCKGCFKAIVAGDQNVEYKGTVWHKDCFTCSNCKQVIGTGSFFPKGEDFYCVTCHETKFAKHCVKCNKAITSGGIT

SEQ ID NO: 5394 - protein, 204 aa, Homo Sapiens
MAEKFDCHYCRDPLQGKKYVQKDGHHCCLKCFDKFCANTCVECRKPIGADSKEVHYKNRFWHDTCFRCAKCLHPLANETFVAKDNKILCNKCTTREDSPKCKGCFKAIVAGDQNVEYKGTVWHKDCFTCSNCKQVIGTGSFFPKGEDFYCVTCHETKFAKHCVKCNKAITSGGITYQDQPWHADCFVCVTCSKKLAGQRFTAVE

SEQ ID NO: 5395 - protein, 205 aa, Homo Sapiens
MAEKFDCHYCRDPLQGKKYVQKDGHHCCLKCFDKFCANTCVECRKPIGADSKEVHYKNRFWHDTCFRCAKCLHPLANETFVAKDNKILCNKCTTREDSPKCKGCFKAIVAGDQNVEYKGTVWHKDCFTCSNCKQVIGTGSFFPKGEDFYCVTCHETKFAKHCVKCNKAITSGGITYQDQPWHADCFVCVTCSKKLAGQRFTAVED

SEQ ID NO: 5396 - protein, 207 aa, Homo Sapiens
MAEKFDCHYCRDPLQGKKYVQKDGHHCCLKCFDKFCANTCVECRKPIGADSKEVHYKNRFWHDTCFRCAKCLHPLANETFVAKDNKILCNKCTTREDSPKCKGCFKAIVAGDQNVEYKGTVWHKDCFTCSNCKQVIGTGSFFPKGEDFYCVTCHETKFAKHCVKCNKAITSGGITYQDQPWHADCFVCVTCSKKLAGQRFTAVEDQY

SEQ ID NO: 5397 - protein, 207 aa, Homo Sapiens; identical to SEQ ID NO: 5396

SEQ ID NO: 5398 - protein, 280 aa, Homo Sapiens
MAEKFDCHYCRDPLQGKKYVQKDGHHCCLKCFDKFCANTCVECRKPIGADSKEVHYKNRFWHDTCFRCAKCLHPLANETFVAKDNKILCNKCTTREDSPKCKGCFKAIVAGDQNVEYKGTVWHKDCFTCSNCKQVIGTGSFFPKGEDFYCVTCHETKFAKHCVKCNKAITSGGITYQDQPWHADCFVCVTCSKKLAGQRFTAVEDQYYCVDCYKNFVAKKCAGCKNPITGFGKGSSVVAYEGQSWHDYCFHCKKCSVNLANKRFVFHQEQVYCPDCAKKL

SEQ ID NO: 5399 - protein, 280 aa, Homo Sapiens; identical to SEQ ID NO: 5398

SEQ ID NO: 5400 - protein, 257 aa, Homo Sapiens
MAEKFDCHYCRDPLQGKKYVQKDGHHCCLKCFDKFCANTCVECRKPIGADSKEVHYKNRFWHDTCFRCAKCLHPLANETFVAKDNKILCNKCTTREDSPKCKGCFKAIVAGDQNVEYKGTVWHKDCFTCSNCKQVIGTGSFFPKGEDFYCVTCHETKFAKHCVKCNKAITSGGITYQDQPWHADCFVCVTCSKKLAGQRFTAVEDQYYCVDCYKNFVAKKCAGCKNPITGFGKGSSVVAYEGQSWHDYCFHCKKCSV

SEQ ID NO: 5401 - protein, 280 aa, Homo Sapiens; identical to SEQ ID NO: 5398

SEQ ID NO: 5402 - protein, 280 aa, Homo Sapiens; identical to SEQ ID NO: 5398

SEQ ID NO: 5403 - protein, 280 aa, Homo Sapiens; identical to SEQ ID NO: 5398

SEQ ID NO: 5404 - protein, 280 aa, Homo Sapiens; identical to SEQ ID NO: 5398

SEQ ID NO: 5405 - protein, 280 aa, Homo Sapiens; identical to SEQ ID NO: 5398

SEQ ID NO: 5406 - protein, 323 aa, Homo Sapiens
MAEKFDCHYCRDPLQGKKYVQKDGHHCCLKCFDKFCANTCVECRKPIGADSKEVHYKNRFWHDTCFRCAKCLHPLANETFVAKDNKILCNKCTTREDSPKCKGCFKAIVAGDQNVEYKGTVWHKDCFTCSNCKQVIGTGSFFPKGEDFYCVTCHETKFAKHCVKCNKAITSGGITYQDQPWHADCFVCVTCSKKLAGQRFTAVEDQYYCVDCYKNFVAKKCAGCKNPITGKRTVSRVSHPVSKARKPPVCHGKRLPLTLFPSANLRGRHPGGERTCPSWVVVLYRKNRSLAAPRGPGLVKAPVWWPMKDNPGTTTASTAKNAP

SEQ ID NO: 5407 - protein, 323 aa, Homo Sapiens; identical to SEQ ID NO: 5406

SEQ ID NO: 5408 - protein, 194 aa, Homo Sapiens
MAEKFDCHYCRDPLQGKKYVQKDGHHCCLKCFDKFCANTCVECRKPIGADSKEVHYKNRFWHDTCFRCAKCLHPLANETFVAKDNKILCNKCTTREDSPKCKGCFKAIVAGDQNVEYKGTVWHKDCFTCSNCKQVIGTGSFFPKGEDFYCVTCHETKFAKHCVKCNKGLVKAPVWWPMKDNPGTTTASTAKNAP

SEQ ID NO: 5409 - protein, 296 aa, Homo Sapiens
MASHRHSGPSSYKVGTMAEKFDCHYCRDPLQGKKYVQKDGHHCCLKCFDKFCANTCVECRKPIGADSKEVHYKNRFWHDTCFRCAKCLHPLANETFVAKDNKILCNKCTTREDSPKCKGCFKAIVAGDQNVEYKGTVWHKDCFTCSNCKQVIGTGSFFPKGEDFYCVTCHETKFAKHCVKCNKAITSGGITYQDQPWHADCFVCVTCSKKLAGQRFTAVEDQYYCVDCYKNFVAKKCAGCKNPITGFGKGSSVVAYEGQSWHDYCFHCKKCSVNLANKRFVFHQEQVYCPDCAKKL

SEQ ID NO: 5410 - protein, 210 aa, Homo Sapiens
MASHRHSGPSSYKVGTMAEKFDCHYCRDPLQGKKYVQKDGHHCCLKCFDKFCANTCVECRKPIGADSKEVHYKNRFWHDTCFRCAKCLHPLANETFVAKDNKILCNKCTTREDSPKCKGCFKAIVAGDQNVEYKGTVWHKDCFTCSNCKQVIGTGSFFPKGEDFYCVTCHETKFAKHCVKCNKGLVKAPVWWPMKDNPGTTTASTAKNAP

SEQ ID NO: 5411 - protein, 309 aa, Homo Sapiens
MTFYVASLALELIWMLSSPAGPSSYKVGTMAEKFDCHYCRDPLQGKKYVQKDGHHCCLKCFDKFCANTCVECRKPIGADSKEVHYKNRFWHDTCFRCAKCLHPLANETFVAKDNKILCNKCTTREDSPKCKGCFKAIVAGDQNVEYKGTVWHKDCFTCSNCKQVIGTGSFFPKGEDFYCVTCHETKFAKHCVKCNKAITSGGITYQDQPWHADCFVCVTCSKKLAGQRFTAVEDQYYCVDCYKNFVAKKCAGCKNPITGFGKGSSVVAYEGQSWHDYCFHCKKCSVNLANKRFVFHQEQVYCPDCAKKL

SEQ ID NO: 5412 - protein, 635 aa, Homo Sapiens
MAMRPRSHPPVGAGTGGGPACVPVAEASTGAWTAEGAAGTRCRASRAPCRPPPVPAPSQLPASSPTKCEICVKNTAILAITLITPQDPHLDPVPRGQPTFTKKKKTIRLFWNEVRPFDWPCKNNRRCREFLWSKLEPIKVDTSRLEHLFESKSKELSVSKKTAADGKRQEIIVLDSKRSNAINIGLTVLPPPRTIKIAILNFDEYALNKEGIEKILTMIPTDEEKQKIQEAQLANPEIPLGSAEQFLLTLSSISELSARLHLWAFKMDYETTEKEVAEPLLDLKEGIDQLENNKTLGFILSTLLAIGNFLNGTNAKAFELSYLEKVPEVKDTVHKQSLLHHVCTMVVENFPDSSDLYSEIGAITRSAKVDFDQLQDNLCQMERRCKASWDHLKAIAKHEMKPVLKQRMSEFLKDCAERIIILKIVHRRIINRFHSFLLFMGHPPYAIREVNINKFCRIISEFALEYRTTRERVLQQKQKRANHRERNKTRGKMITDSGKFSGSSPAPPSQPQGLSYAEDAAEHENMKAVLKTSSPSVEDATPALGVRTRSRASRGSTSSWTMGTDDSPNVTDDAADEIMDRIVKSATQVPSQRVVPRERKRSRANRKSLRRTLKSGLTPEEARALGLVGTSELQL

SEQ ID NO: 5413 - protein, 1439 aa, Homo Sapiens
MATLACRVQFLDDTDPFNSTNFPEPSRPPLFTFREDLALGTQLAGVHRLLQAPHKLDDCTLQLSHNGAYLDLEATLAEQRDELEGFQDDAGRGKKHSIILRTQLSVRVHACIEKLYNSSGRDLRRALFSLKQIFQDDKDLVHEFVVAEGLTCLIKVGAEADQNYQNYILRALGQIMLYVDGMNGVINRNETIQWLYTLIGSKFRLVVKTALKLLLVFVEYSESNAPLLIQAVTAVDTKRGVKPWSNIMEILEEKDGVDTELLVYAMTLVNKTLSGLPDQDTFYDVVDCLEELGIAAVSQRHLNKKGTDLDLVEQLNIYEVALRHEDGDETTEPPPSGCRDRRRASVCSSGGGEHRGLDRRRSRRHSVQSIKSTLSAPTSPCSQSAPSFKPNQVRDLREKYSNFGNNSYHSSRPSSGSSVPTTPTSSVSPPQEARLERSSPSGLLTSSFRQHQESLAAERERRRQEREERLQRIEREERNKFSRDYLDKREEQRQAREERYKYLEQLAAEEHEKELRSRSVSRGRADLSLDLTSPAAPACLAPLSHSPSSSDSQEALTVSASSPGTPHHPQASAGDPEPESEAEPEAEAGAGQVADEAGQDIASAHEGAETEVEQALEQEPEERASLSEKERQNEGVNERDNCSASSVSSSSSTLEREEKEDKLSRDRTTGLWPAGVQDAGVNGQCGDILTNKRFMLDMLYAHNRKSPDDEEKGDGEAGRTQQEAEAVASLATRISTLQANSQTQDESVRRVDVGCLDNRGSVKAFAEKFNSGDLGRGSISPDAEPNDKVPETAPVQPKTESDYIWDQLMANPRELRIQDMDFTDLGEEDDIDVLDVDLGHREAPGPPPPPPPTFLGLPPPPPPPLLDSIPPPPVPGNLLVPPPPVFNAPQGLGWSQVPRGQPTFTKKKKTIRLFWNEVRPFDWPCKNNRRCREFLWSKLEPIKVDTSRLEHLFESKSKELSVSKKTAADGKRQEIIVLDSKRSNAINIGLTVLPPPRTIKIAILNFDEYALNKEGIEKILTMIPTDEEKQKIQEAQLANPEIPLGSAEQFLLTLSSISELSARLHLWAFKMDYETTEKEVAEPLLDLKEGIDQLENNKTLGFILSTLLAIGNFLNGTNAKAFELSYLEKVPEVKDTVHKQSLLHHVCTMVVENFPDSSDLYSEIGAITRSAKVDFDQLQDNLCQMERRCKASWDHLKAIAKHEMKPVLKQRMSEFLKDCAERIIILKIVHRRIINRFHSFLLFMGHPPYAIREVNINKFCRIISEFALEYRTTRERVLQQKQKRANHRERNKTRGKMITDSGKFSGSSPAPPSQPQGLSYAEDAAEHENMKAVLKTSSPSVEDATPALGVRTRSRASRGSTSSWTMGTDDSPNVTDDAADEIMDRIVKSATQVPSQRVVPRERKRSRANRKSLRRTLKSGLTPEEARALGLVGTSELQL

SEQ ID NO: 5414 - protein, 1422 aa, Homo Sapiens
MATLACRVQFLDDTDPFNSTNFPEPSRPPLFTFREDLALGTQLAGVHRLLQAPHKLDDCTLQLSHNGAYLDLEATLAEQRDELEGFQDDAGRGKKHSIILRTQLSVRVHACIEKLYNSSGRDLRRALFSLKQIFQDDKDLVHEFVVAEGLTCLIKVGAEADQNYQNYILRALGQIMLYVDGMNGVINRNETIQWLYTLIGSKFRLVVKTALKLLLVFVEYSESNAPLLIQAVTAVDTKRGVKPWSNIMEILEEKDGVDTELLVYAMTLVNKTLSGLPDQDTFYDVVDCLEELGIAAVSQRHLNKKGTDLDLVEQLNIYEVALRHEDGDETTEPPPSGCRDRRRASVCSSGGGEHRGLDRRRSRRHSVQSIKSTLSAPTSPCSQSAPSFKPNQVRDLREKYSNFGNNSYHSSRPSSGSSVPTTPTSSVSPPQEARLERSSPSGLLTSSFRQHQESLAAERERRRQEREERLQRIEREERNKFRYKYLEQLAAEEHEKELRSRSVSRGRADLSLDLTSPAAPACLAPLSHSPSSSDSQEALTVSASSPGTPHHPQASAGDPEPESEAEPEAEAGAGQVADEAGQDIASAHEGAETEVEQALEQEPEERASLSEKERQNEGVNERDNCSASSVSSSSSTLEREEKEDKLSRDRTTGLWPAGVQDAGVNGQCGDILTNKRFMLDMLYAHNRKSPDDEEKGDGEAGRTQQEAEAVASLATRISTLQANSQTQDESVRRVDVGCLDNRGSVKAFAEKFNSGDLGRGSISPDAEPNDKVPETAPVQPKTESDYIWDQLMANPRELRIQDMDFTDLGEEDDIDVLDVDLGHREAPGPPPPPPPTFLGLPPPPPPPLLDSIPPPPVPGNLLVPPPPVFNAPQGLGWSQVPRGQPTFTKKKKTIRLFWNEVRPFDWPCKNNRRCREFLWSKLEPIKVDTSRLEHLFESKSKELSVSKKTAADGKRQEIIVLDSKRSNAINIGLTVLPPPRTIKIAILNFDEYALNKEGIEKILTMIPTDEEKQKIQEAQLANPEIPLGSAEQFLLTLSSISELSARLHLWAFKMDYETTEKEVAEPLLDLKEGIDQLENNKTLGFILSTLLAIGNFLNGTNAKAFELSYLEKVPEVKDTVHKQSLLHHVCTMVVENFPDSSDLYSEIGAITRSAKVDFDQLQDNLCQMERRCKASWDHLKAIAKHEMKPVLKQRMSEFLKDCAERIIILKIVHRRIINRFHSFLLFMGHPPYAIREVNINKFCRIISEFALEYRTTRERVLQQKQKRANHRERNKTRGKMITDSGKFSGSSPAPPSQPQGLSYAEDAAEHENMKAVLKTSSPSVEDATPALGVRTRSRASRGSTSSWTMGTDDSPNVTDDAADEIMDRIVKSATQVPSQRVVPRERKRSRANRKSLRRTLKSGLTPEEARALGLVGTSELQL

SEQ ID NO: 5415 - protein, 1622 aa, Homo Sapiens
MATLACRVQFLDDTDPFNSTNFPEPSRPPLFTFREDLALGTQLAGVHRLLQAPHKLDDCTLQLSHNGAYLDLEATLAEQRDELEGFQDDAGRGKKHSIILRTQLSVRVHACIEKLYNSSGRDLRRALFSLKQIFQDDKDLVHEFVVAEGLTCLIKVGAEADQNYQNYILRALGQIMLYVDGMNGVINRNETIQWLYTLIGSKFRLVVKTALKLLLVFVEYSESNAPLLIQAVTAVDTKRGVKPWSNIMEILEEKDGVDTELLVYAMTLVNKTLSGLPDQDTFYDVVDCLEELGIAAVSQRHLNKKGTDLDLVEQLNIYEVALRHEDGDETTEPPPSGCRDRRRASVCSSGGGEHRGLDRRRSRRHSVQSIKSTLSAPTSPCSQSAPSFKPNQVRDLREKEEEEEEEQPITEPSSEEEREDDASCQGKDSKVGAASGQSPTGRDAAPKSSALPAVSNASSQGKPLLVGTAGGTTWHSGSSGSEATPSALLSPPASAARPSSATPGSLKVSPTIDKLPYVPHSPFHLFSYDFEDSSLSTKEKEAESQKENSSSDSFSLSTYSASEPYHFRSFSSNRYSNFGNNSYHSSRPSSGSSVPTTPTSSVSPPQEARLERSSPSGLLTSSFRQHQESLAAERERRRQEREERLQRIEREERNKFSRDYLDKREEQRQAREERYKYLEQLAAEEHEKELRSRSVSRGRADLSLDLTSPAAPACLAPLSHSPSSSDSQEALTVSASSPGTPHHPQASAGDPEPESEAEPEAEAGAGQVADEAGQDIASAHEGAETEVEQALEQEPEERASLSEKERQNEGVNERDNCSASSVSSSSSTLEREEKEDKLSRDRTTGLWPAGVQDAGVNGQCGDILTNKRFMLDMLYAHNRKSPDDEEKGDGEAGRTQQEAEAVASLATRISTLQANSQTQDESVRRVDVGCLDNRGSVKAFAEKFNSGDLGRGSISPDAEPNDKVPETAPVQPKTESDYIWDQLMANPRELRIQDMDFTDLGEEDDIDVLDVDLGHREAPGPPPPPPPTFLGLPPPPPPPLLDSIPPPPVPGNLLVPPPPVFNAPQGLGWSQVPRGQPTFTKKKKTIRLFWNEVRPFDWPCKNNRRCREFLWSKLEPIKVDTSRLEHLFESKSKELSVSKKTAADGKRQEIIVLDSKRSNAINIGLTVLPPPRTIKIAILNFDEYALNKEGIEKILTMIPTDEEKQKIQEAQLANPEIPLGSAEQFLLTLSSISELSARLHLWAFKMDYETTEKEVAEPLLDLKEGIDQLENNKTLGFILSTLLAIGNFLNGTNAKAFELSYLEKVPEVKDTVHKQSLLHHVCTMVVENFPDSSDLYSEIGAITRSAKVDFDQLQDNLCQMERRCKASWDHLKAIAKHEMKPVLKQRMSEFLKDCAERIIILKIVHRRIINRFHSFLLFMGHPPYAIREVNINKFCRIISEFALEYRTTRERVLQQKQKRANHRERNKTRGKMITDTDEEEEVESGKFSGSSPAPPSQPQGLSYAEDAAEHENMKAVLKTSSPSVEDATPALGVRTRSRASRGSTSSWTMGTDDSPNVTDDAADEIMDRIVKSATQVPSQRVVPRERKRSRANRKSLRRTLKSGLTPEEARALGLVGTSELQL

SEQ ID NO: 5416 - protein, 528 aa, Homo Sapiens
RLFWNEVRPFDWPCKNNRRCREFLWSKLEPIKVDTSRLEHLFESKSKELSVSKKTAADGKRQEIIVLDSKRSNAINIGLTVLPPPRTIKIAILNFDEYALNKEGIEKILTMIPTDEEKQKIQEAQLANPEIPLGSAEQFLLTLSSISELSARLHLWAFKMDYETTEKEVAEPLLDLKEGIDQLENNKTLGFILSTLLAIGNFLNGTNAKAFELSYLEKVPEVKDTVHKQSLLHHVCTMVVENFPDSSDLYSEIGAITRSAKVDFDQLQDNLCQMERRCKASWDHLKAIAKHEMKPVLKQRMSEFLKDCAERIIILKIVHRRIINRFHSFLLFMGHPPYAIREVNINKFCRIISEFALEYRTTRERVLQQKQKRANHRERNKTRGKMITDSGKFSGSSPAPPSQPQGLSYAEDAAEHENMKAVLKTSSPSVEDATPALGVRTRSRASRGSTSSWTMGTDDSPNVTDDAADEIMDRIVKSATQVPSQRVVPRERKRSRANRKSLRRTLKSGLTPEEARALGLVGTSELQL

SEQ ID NO: 5417 - protein, 375 aa, Homo Sapiens
  misc_feature (1)..(1): Xaa can be any naturally occurring amino acid
XAINIGLTVLPPPRTIKIAILNFDEYALNKEGIEKILTMIPTDEEKQKIQEAQLANPEIPLGSAEQFLLTLSSISELSARLHLWAFKMDYETTEKEVAEPLLDLKEGIDQLENNKTLGFILSTLLAIGNFLNGTNAKAFELSYLEKVPEVKDTVHKQSLLHHVCTMVVENFPDSSDLYSEIGAITRSAKVDFDQLQDNLCQMERRCKASWDHLKAIAKHEMKPVLKQRMSEFLKDCAERIIILKIVHRRIINRFHSFLLFMGHPPYAIREVNINKFCRIISEFALEYRTTRERVLQQKQKRANHRERNKTRGKMITDDPLVPGLWELMTRPMSQMMQLMRSWTASSSQPPKCPVSEWCRGRGNDPGPTGNLCEEP

SEQ ID NO: 5418 - protein, 1200 aa, Homo Sapiens
  misc_feature (1)..(1): Xaa can be any naturally occurring amino acid
XFRLVVKTALKLLLVFVEYSESNAPLLIQAVTAVDTKRGVKPWSNIMEILEEKDGVDTELLVYAMTLVNKTLSGLPDQDTFYDVVDCLEELGIAAVSQRHLNKKGTDLDLVEQLNIYEVALRHEDGDETTEPPPSGCRDRRRASVCSSGGGEHRGLDRRRSRRHSVQSIKSTLSAPTSPCSQSAPSFKPNQVRDLREKSSPSGLLTSSFRQHQESLAAERERRRQEREERLQRIEREERNKFSRDYLDKREEQRQAREERYKYLEQLAAEEHEKELRSRSVSRGRADLSLDLTSPAAPACLAPLSHSPSSSDSQEALTVSASSPGTPHHPQASAGDPEPESEAEPEAEAGAGQVADEAGQDIASAHEGAETEVEQALEQEPEERASLSEKERQNEGVNERDNCSASSVSSSSSTLEREEKEDKLSRDRTTGLWPAGVQDAGVNGQCGDILTNKRFMLDMLYAHNRKSPDDEEKGDGEAGRTQQEAEAVASLATRISTLQANSQTQDESVRRVDVGCLDNRGSVKAFAEKFNSGDLGRGSISPDAEPNDKVPETAPVQPKTESDYIWDQLMANPRELRIQDMDFTDLGEEDDIDVLDVDLGHREAPGPPPPPPPTFLGLPPPPPPPLLDSIPPPPVPGNLLVPPPPVFNAPQGLGWSQVPRGQPTFTKKKKTIRLFWNEVRPFDWPCKNNRRCREFLWSKLEPIKVDTSRLEHLFESKSKELSVSKKTAADGKRQEIIVLDSKRSNAINIGLTVLPPPRTIKIAILNFDEYALNKEGIEKILTMIPTDEEKQKIQEAQLANPEIPLGSAEQFLLTLSSISELSARLHLWAFKMDYETTEKEVAEPLLDLKEGIDQLENNKTLGFILSTLLAIGNFLNGTNAKAFELSYLEKVPEVKDTVHKQSLLHHVCTMVVENFPDSSDLYSEIGAITRSAKVDFDQLQDNLCQMERRCKASWDHLKAIAKHEMKPVLKQRMSEFLKDCAERIIILKIVHRRIINRFHSFLLFMGHPPYAIREVNINKFCRIISEFALEYRTTRERVLQQKQKRANHRERNKTRGKMITDSGKFSGSSPAPPSQPQGLSYAEDAAEHENMKAVLKTSSPSVEDATPALGVRTRSRASRGSTSSWTMGTDDSPNVTDDAADEIMDRIVKSATQVPSQRVVPRERKRSRANRKSLRRTLKSGLTPEEARALGLVGTSELQL

SEQ ID NO: 5419 - protein, 211 aa, Homo Sapiens
MVFLKFFCMSFFCHLCQGYFDGPLYPEMSNGTLHHYFVPDGDYEENDDPEKCQLLFRVSDHRRCSQGEGSQVGSLLSLTLREEFTVLGRQVEDAGRVLEGISKSISYDLDGEESYGKYLRRESHQIGDAYSNSDKSLTELESKFKQGQEQDSRQESRLNEDFLGMLVHTRSLLKETLDISVGLRDKYELLALTIRSHGTRLGRLKNDYLKV

SEQ ID NO: 5420 - protein, 458 aa, Homo Sapiens
MMLIPMASVMAVTEPKWVSVWSRFLWVTLLSMVLGSLLALLLPLGAVEEQCLAVLKGLYLLRSKPDRAQHAATKCTSPSTELSITSRGATLLVAKTKASPAGKLEARAALNQALEMKRQGKREKAQKLFMHALKMDPDFVDALTEFGIFSEEDKDIIQADYLYTRALTISPYHEKALVNRDRTLPLVEEIDQRYFSIIDSKVKKVMSIPKGNSALRRVMEETYYHHIYHTVAIEGNTLTLSEIRHILETRYAVPGKSLEEQNEVIGMHAAMKYINTTLVSRIGSVTISDVLEIHRRVLGYVDPVEAGRFRTTQVLVGHHIPPHPQDVEKQMQEFVQWLNSEEAMNLHPVEFAALAHYKLVYIHPFIDGNGRTSRLLMNLILMQAGYPPITIRKEQRSDYYHVLEAANEGDVRPFIRFIAKCTETTLDTLLFATTEYSVALPEAQPNHSGFKETLPVKP

SEQ ID NO: 5421 - protein, 180 aa, Homo Sapiens
MMLIPMASVMAVTEPKWVSVWSRFLWVTLLSMVLGSLLALLLPLGAVEEQCLAVLKGLYLLRSKPDRAQHAATKCTSPSTELSITSRGATLLVAKTKASPESRRLGSQGGASQNTREWLWGHTDSDCIPPHGWGNRVVPGMLSTHDAAATSSSRPGTQAGHHGFLRRPAQGTAPRMSSAP

SEQ ID NO: 5422 - protein, 139 aa, Homo Sapiens
MMLIPMASVMAVTEPKWVSVWSRFLWVTLLSMVLGSLLALLLPLGAVEEQCLAVLKGLYLLRSKPDRAQHAATKCTSPSTELSITSRGATLLVAKTKASPGKTDWPSSSMLVNWIDRHRMCHVLYVGHRGIVNKSALSS

SEQ ID NO: 5423 - protein, 56 aa, Homo Sapiens
  misc_feature (1)..(1): Xaa can be any naturally occurring amino acid
XCLAVLKGLYLLRSKPDRAQHAATKCTSPSTELSITSRGATLLVAKTKASPGKCCT

SEQ ID NO: 5424 - protein, 437 aa, Homo Sapiens
MGRRMRGAAATAGLWLLALGSLLALWGGLLPPRTELPASRPPEDRLPRRPARSGGPAPAPRFPLPPPLAWDARGGSLKTFRALLTLAAGADGPPRQSRSEPRWHVSARQPRPEESAAVHGGVFWSRGLEEQVPPGFSEAQAAAWLEAARGARMVALERGGCGRSSNRLARFADGTRACVRYGINPEQIQGEALSYYLARLLGLQRHVPPLALARVEARGAQWAQVQEELRAAHWTEGSVVSLTRWLPNLTDVVVPAPWRSEDGRLRPLRDAGGELANLSQAELVDLVQWTDLILFDYLTANFDRLVSNLFSLQWDPRVMQRATSNLHRGPGGALVFLDNEAGLVHGYRVAGMWDKYNEPLLQSVCVFRERTARRVLELHRGQDAAARLLRLYRRHEPRFPELAALADPHAQLLQRRLDFLAKHILHCKAKYGRRSGT

SEQ ID NO: 5425 - protein, 147 aa, Homo Sapiens
MFPAGPPSHSLLRLPLLQLLLLVVQAVGRGLGRASPAGGPLEDVVIERYHIPRACPREVQMGDFVRYHYNGTFEDGKKFDSSGAHSTGCHPLLRCGSAGCVEQGRHRAGEHIAAPAPLPPHGPGRRLCPLPLQWHPAGRHLLRHQLQ

SEQ ID NO: 5426 - protein, 171 aa, Homo Sapiens
MFPAGPPSHSLLRLPLLQLLLLVVQAVGRGLGRASPAGGPLEDVVIERYHIPRACPREVQMGDFVRYHYNGTFEDGKKFDSSYDRNTLVAIVVGVGRLITGMDRGLMGMCVNERRRLIVPPHLGYGSIGLAGLIPPDATLYFDVVLLDVWNKEDTVQVSTLLRPPHCPRMV

SEQ ID NO: 5427 - protein, 582 aa, Homo Sapiens
MFPAGPPSHSLLRLPLLQLLLLVVQAVGRGLGRASPAGGPLEDVVIERYHIPRACPREVQMGDFVRYHYNGTFEDGKKFDSSYDRNTLVAIVVGVGRLITGMDRGLMGMCVNERRRLIVPPHLGYGSIGLAGLIPPDATLYFDVVLLDVWNKEDTVQVSTLLRPPHCPRMVQDGDFVRYHYNGTLLDGTSFDTSYSKGGTYDTYVGSGWLIKGMDQGLLGMCPGERRKIIIPPFLAYGEKGYGTVIPPQASLVFHVLLIDVHNPKDAVQLETLELPPGCVRRAGAGDFMRYHYNGSLMDGTLFDSSYSRNHTYNTYIGQGYIIPGMDQGLQGACMGERRRITIPPHLAYGENGTGDKIPGSAVLIFNVHVIDFHNPADVVEIRTLSRPSETCNETTKLGDFVRYHYNCSLLDGTQLFTSHDYGAPQEATLGANKVIEGLDTGLQGMCVGERRQLIVPPHLAHGESGARGVPGSAVLLFEVELVSREDGLPTGYLFVWHKDPPANLFEDMDLNKDGEVPPEEFSTFIKAQVSEGKGRLMPGQDPEKTIGDMFQNQDRNQDGKITVDELKLKSDEDEERVHEEL

SEQ ID NO: 5428 - protein, 81 aa, Homo Sapiens
MGDFVRYHYNGTFEDGKKFDSSYDRNTLVAIVVGVGRLITGMDRGLMGMCVNERRRLIVPPHLGYGSIGLAGLIPPDATLY

SEQ ID NO: 5429 - protein, 172 aa, Homo Sapiens
MGDFVRYHYNGTFEDGKKFDSSYDRNTLVAIVVGVGRLITGMDRGLMGMCVNERRRLIVPPHLGYGSIGLAGLIPPDATLYFDVVLLDVWNKEDTVQVSTLLRPPHCPRMVQDGDFVRYHYNGTLLDGTSFDTSYSKGGTYDTYVGSGWLIKGMDQGLLGMCPGERRKIIIP

SEQ ID NO: 5430 - protein, 386 aa, Homo Sapiens
  misc_feature (1)..(1): Xaa can be any naturally occurring amino acid
XIDVHNPKDAVQLETLELPPGCVRRAGAGDFMRYHYNGSLMDGTLFDSSYSRNHTYNTYIGQGYIIPGMDQGLQGACMGERRRITIPPHLAYGENGTDSIGFLQGSAPLRPFRSGEGQPSLGREGGYGKTEPAYPQDPAVLGASVSSPVKWASHADPQGDKIPGSAVLIFNVHVIDFHNPADVVEIRTLSRPSETCNETTKLGDFVRYHYNCSLLDGTQLFTSHDYGAPQEATLGANKVIEGLDTGLQGMCVGERRQLIVPPHLAHGESGARGVPGSAVLLFEVELVSREDGLPTGYLFVWHKDPPANLFEDMDLNKDGEVPPEEFSTFIKAQVSEGKGRLMPGQDPEKTIGDMFQNQDRNQDGKITVDELKLKSDEDEERVHEEL

SEQ ID NO: 5431 - protein, 99 aa, Homo Sapiens
MCVGEKRRAIIPSHLAYGKRGFPPSVPADAVVQYDVELIALIRANYWLKLVKGILPLVGMAMVPALLGLIGYHLYRKANRPKVSKKKLKEEKRNKSKKK

SEQ ID NO: 5432 - protein, 92 aa, Homo Sapiens
MTLRPSLLPLHLLLLLLLSAAVCRAEAGLETESPVRTLQVETLGRERDLWKSIRDPCSPIVGGAPRTMCRARCFWRHASHTLHGKLGRWTYY

SEQ ID NO: 5433 - protein, 72 aa, Homo Sapiens
MTLRPSLLPLHLLLLLLLSAAVCRAEAGLETESPVRTLQVETLSDRRWSPQNHVPSPLLLETRFTYTTREAW

SEQ ID NO: 5434 - protein, 201 aa, Homo Sapiens
MTLRPSLLPLHLLLLLLLSAAVCRAEAGLETESPVRTLQVETLVEPPEPCAEPAAFGDTLHIHYTGSLVDGRIIDTSLTRDPLVIELGQKQVIPGLEQSLLDMCVGEKRRAIIPSHLAYGKRGFPPSVPADAVVQYDVELIALIRANYWLKLVKGILPLVGMAMVPALLGLIGYHLYRKANRPKVSKKKLKEEKRNKSKKK

SEQ ID NO: 5435 - protein, 182 aa, Homo Sapiens
MTLRPSLLPLHLLLLLLLSAAVCRAEAGLETESPVRTLQVETLVEPPEPCAEPAAFGDTLHIHYTGSLVDGRIIDTSLTRDPLVIELGQKQVIPGLEQSLLDMCVGEKRRAIIPSHLAYGKRGFPPSVPDGVSLLLPRLECNSAIFTHHNLRHPGSSNSPVSASRVAGITGMRHHDRLILYF

SEQ ID NO: 5436 - protein, 146 aa, Homo Sapiens
MTLRPSLLPLHLLLLLLLSAAVCRAEAGLETESPVRTLQVETLVEPPEPCAEPAAFGDTLHIHYTGSLVDGRIIDTSLTRDPLVIELGQKQVIPGLEQSLLDMCVGEKRRAIIPSHLAYGKRGFPPSVPGTKDNLMRPPGMTSSSQ

SEQ ID NO: 5437 - protein, 63 aa, Homo Sapiens
SLTRDPLVIELGQKQVIPGLEQSLLDMCVGWKNSCFGCEDSGGFAEGASAGLRLLAYLSCLWL

SEQ ID NO: 5438 - protein, 66 aa, Homo Sapiens
MRLFLWNAVLTLFVTSLIGALIPEPEVKIEVLQKPFICHRKTKGGDLMLVHYEGYLEKDGSLFHST

SEQ ID NO: 5439 - protein, 211 aa, Homo Sapiens
MRLFLWNAVLTLFVTSLIGALIPEPEVKIEVLQKPFICHRKTKGGDLMLVHYEGYLEKDGSLFHSTHKHNNGQPIWFTLGILEALKGWDQGLKGMCVGEKRKLIIPPALGYGKEGKGKIPPESTLIFNIDLLEIRNGPRSHESFQEMDLNDDWKLSKDEVKAYLKKEFEKHGAVVNESHHDALVEDIFDKEDEDKDGFISAREFTYKHDEL

SEQ ID NO: 5440 - protein, 89 aa, Homo Sapiens
  misc_feature (1)..(1): Xaa can be any naturally occurring amino acid
XVLQKPFICHRKTKGGDLMLVHYEGYLEKDGSLFHSTHKHNNGQPIWFTLGILEALKGWDQGLKGMCVGEKRKLIIPPALGYGKEGKVF

SEQ ID NO: 5441 - protein, 102 aa, Homo Sapiens
MRLSWFRVLTVLSICLSAVATATGAEGKRKLQIGVKKRVDHCPIKSRKGDVLHMHYTGKLEDGTEFDSSLPQNQPFVFSLGTGQVIKGWDQGLLGMCEGEKR

SEQ ID NO: 5442 - protein, 142 aa, Homo Sapiens
MRLSWFRVLTVLSICLSAVATATGAEGKRKLQIGVKKRVDHCPIKSRKGDVLHMHYTGKLEDGTEFDSSLPQNQPFVFSLGTGQVIKGWDQGLLGMCEGEKRKLVIPSELGYGERGAPPKIPGGATLVFEVELLKIERRTEL

SEQ ID NO: 5443 - protein, 142 aa, Homo Sapiens; identical to SEQ ID NO: 5442

SEQ ID NO: 5444 - protein, 142 aa, Homo Sapiens; identical to SEQ ID NO: 5442

SEQ ID NO: 5445 - protein, 74 aa, Homo Sapiens
MPKTMHFLFRFIVFFYLWGLFTAQRQKKEESTEEVKIEVLHRPENCSKTSKKGDLLNAHYDGYLAKDGSKFYCR

SEQ ID NO: 5446 - protein, 86 aa, Homo Sapiens
MPKTMHFLFRFIVFFYLWGLFTAQRQKKEESTEEVKIEVLHRPENCSKTSKKGDLLNAHYDGYLAKDGSKFYCSRRQDSTGCYIDF

SEQ ID NO: 5447 - protein, 222 aa, Homo Sapiens
MPKTMHFLFRFIVFFYLWGLFTAQRQKKEESTEEVKIEVLHRPENCSKTSKKGDLLNAHYDGYLAKDGSKFYCSRTQNEGHPKWFVLGVGQVIKGLDIAMTDMCPGEKRKVVIPPSFAYGKEGYAEGKIPPDATLIFEIELYAVTKGPRSIETFKQIDMDNDRQLSKAEINLYLQREFEKDEKPRDKSYQDAVLEDIFKKNDHDGDGFISPKEYNVYQHDEL

SEQ ID NO: 5448 - protein, 221 aa, Homo Sapiens
MPKTMHFLFRFIVFFYLWGLFTAQRQKKEESTEEVKIEVLHRPENCSKTSKKGDLLNAHYDGYLAKDGSKFYCSRTQNEGHPKWFVLGVGQVIKGLDIAMTDMCPGEKRKVVIPPSFAYGKEGYEGKIPPDATLIFEIELYAVTKGPRSIETFKQIDMDNDRQLSKAEINLYLQREFEKDEKPRDKSYQDAVLEDIFKKNDHDGDGFISPKEYNVYQHDEL

SEQ ID NO: 5449 - protein, 127 aa, Homo Sapiens
MPKTMHFLFRFIVFFYLWGLFTAQRQKKEESTEEVKIEVLHRPENCSKTSKKGDLLNAHYDGYLAKDGSKFYCSRTQNEGHPKWFVLGVGQVIKGLDIAMTDMCPGEKRKVVIPPSFAYGKEGYGST

SEQ ID NO: 5450 - protein, 67 aa, Homo Sapiens
  misc_feature (1)..(1): Xaa can be any naturally occurring amino acid
XGYLAKDGSKFYCSRTQNEGHPKWFVLGVGQVIKGLDIAMTDMCPGEKRKVVIPPSFAYGKEGYGST

SEQ ID NO: 5451 - protein, 623 aa, Homo Sapiens
MAFRGWRPPPPPLLLLLLWVTGQAAPVAGLGSDAELQIERRFVPDECPRTVRSGDFVRYHYVGTFPDGQKFDSRYWDTAEDKADKSPCPQVRVGVNTSPSCRLKQKGVGIYWKDLQFLVRVQNHGLSYDRDSTFNVFVGKGQLITGMDQALVGMCVNERRFVKIPPKLAYGNEGVSGVIPPNSVLHFDVLLMDIWNSEDQVQIHTYFKPPSCPRTIQVSDFVRYHYNGTFLDGTLFDSSHNRMKTYDTYVGIGWLIPGMDKGLLGMCVGEKRIITIPPFLAYGEDGDGKDIPGQASLVFDVALLDLHNPKDSISIENKVVPENCERISQSGDFLRYHYNGTLLDGTLFDSSYSRNRTFDTYIGQGYVIPGMDEGLLGVCIGEKRRIVVPPHLGYGEEGRGNIPGSAVLVFDIHVIDFHNPSDSISITSHYKPPDCSVLSKKGDYLKYHYNASLLDGTLLDSTWNLGKTYNIVLGSGQVVLGMDMGLREMCVGEKRTVIIPPHLGYGEAGVDGEVPGSAVLVFDIELLELVAGLPEGYMFIWNGEVSPNLFEEIDKDGNGEVLLEEFSEYIHAQVASGKGKLAPGFDAELIVKNMFTNQDRNGDGKVTAEEFKLKDQEAKHDEL

SEQ ID NO: 5452 - protein, 570 aa, Homo Sapiens
MAFRGWRPPPPPLLLLLLWVTGQAAPVAGLGSDAELQIERRFVPDECPRTVRSGDFVRYHYVGTFPDGQKFDSSYDRDSTFNVFVGKGQLITGMDQALVGMCVNERRFVKIPPKLAYGNEGVSGVIPPNSVLHFDVLLMDIWNSEDQVQIHTYFKPPSCPRTIQVSDFVRYHYNGTFLDGTLFDSSHNRMKTYDTYVGIGWLIPGMDKGLLGMCVGEKRIITIPPFLAYGEDGDGKDIPGQASLVFDVALLDLHNPKDSISIENKVVPENCERISQSGDFLRYHYNGTLLDGTLFDSSYSRNRTFDTYIGQGYVIPGMDEGLLGVCIGEKRRIVVPPHLGYGEEGRGNIPGSAVLVFDIHVIDFHNPSDSISITSHYKPPDCSVLSKKGDYLKYHYNASLLDGTLLDSTWNLGKTYNIVLGSGQVVLGMDMGLREMCVGEKRTVIIPPHLGYGEAGVDGEVPGSAVLVFDIELLELVAGLPEGYMFIWNGEVSPNLFEEIDKDGNGEVLLEEFSEYIHAQVASGKGKLAPGFDAELIVKNMFTNQDRNGDGKVTAEEFKLKDQEAKHDEL

SEQ ID NO: 5453 - protein, 338 aa, Homo Sapiens
MAGKDIPGQASLVFDVALLDLHNPKDSISIENKVVPENCERISQSGDFLRYHYNGTLLDGTLFDSSYSRNRTFDTYIGQGYVIPGMDEGLLGVCIGEKRRIVVPPHLGYGEEGRGNIPGSAVLVFDIHVIDFHNPSDSISITSHYKPPDCSVLSKKGDYLKYHYNASLLDGTLLDSTWNLGKTYNIVLGSGQVVLGMDMGLREMCVGEKRTVIIPPHLGYGEAGVDGEVPGSAVLVFDIELLELVAGLPEGYMFIWNGEVSPNLFEEIDKDGNGEVLLEEFSEYIHAQVASGKGKLAPGFDAELIVKNMFTNQDRNGDGKVTAEEFKLKDQEAKHDEL

SEQ ID NO: 5454 - protein, 226 aa, Homo Sapiens [sequence omitted]

SEQ ID NO: 5455 - protein, 85 aa, Homo Sapiens
MLKRFTWTDSKPKASLKIDLRVTSKSKESGLSDVSRPSFCHSSCGHVSEGKRRFTYDHAELERKIACCSPPPDYNSVVLYSTPPI

SEQ ID NO: 5456 - protein, 85 aa, Homo Sapiens; identical to SEQ ID NO: 5455

SEQ ID NO: 5457 - protein, 361 aa, Homo Sapiens
MNSDLLVDSDGFYKEPITMEDLISYSFQVARGMEFLSSRKCIHRDLAARNILLSENNVVKICDFGLARDIYKNPDYVRKGDTRLPLKWMAPESIFDKIYSTKSDVWSYGVLLWEIFSLGGSPYPGVQMDEDFCSRLREGMRMRAPEYSTPEIYQIMLDCWHRDPKERPRFAELVEKLGDLLQANVQQDGKDYIPINAILTGNSGFTYSTPAFSEDFFKESISAPKFNSGSSDDVRYVNAFKFMSLERIKTFEELLPNATSMFDDYQGDSSTLLASPMLKRFTWTDSKPKASLKIDLRVTSKSKESGLSDVSRPSFCHSSCGHVSEGKRRFTYDHAELERKIACCSPPPDYNSVVLYSTPPI

SEQ ID NO: 5458 - protein, 433 aa, Homo Sapiens
MVIVEYCKYGNLSNYLKSKRDLFFLNKDAALHMEPKKEKMEPGLEQGKKPRLDSVTSSESFASSGFQEDKSLSDVEEEEDSDGFYKEPITMEDLISYSFQVARGMEFLSSRKCIHRDLAARNILLSENNVVKICDFGLARDIYKNPDYVRKGDTRLPLKWMAPESIFDKIYSTKSDVWSYGVLLWEIFSLGGSPYPGVQMDEDFCSRLREGMRMRAPEYSTPEIYQIMLDCWHRDPKERPRFAELVEKLGDLLQANVQQDGKDYIPINAILTGNSGFTYSTPAFSEDFFKESISAPKFNSGSSDDVRYVNAFKFMSLERIKTFEELLPNATSMFDDYQGDSSTLLASPMLKRFTWTDSKPKASLKIDLRVTSKSKESGLSDVSRPSFCHSSCGHVSEGKRRFTYDHAELERKIACCSPPPDYNSVVLYSTPPI

SEQ ID NO: 5459 - protein, 1338 aa, Homo Sapiens
MVSYWDTGVLLCALLSCLLLTGSSSGSKLKDPELSLKGTQHIMQAGQTLHLQCRGEAAHKWSLPEMVSKESERLSITKSACGRNGKQFCSTLTLNTAQANHTGFYSCKYLAVPTSKKKETESAIYIFISDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVQISTPRPVKLLRGHTLVLNCTATTPLNTRVQMTWSYPDEKNKRASVRRRIDQSNSHANIFYSVLTIDKMQNKDKGLYTCRVRSGPSFKSVNTSVHIYDKAFITVKHRKQQVLETVAGKRSYRLSMKVKAFPSPEVVWLKDGLPATEKSARYLTRGYSLIIKDVTEEDAGNYTILLSIKQSNVFKNLTATLIVNVKPQIYEKAVSSFPDPALYPLGSRQILTCTAYGIPQPTIKWFWHPCNHNHSEARCDFCSNNEESFILDADSNMGNRIESITQRMAIIEGKNKMASTLVVADSRISGIYICIASNKVGTVGRNISFYITDVPNGFHVNLEKMPTEGEDLKLSCTVNKFLYRDVTWILLRTVNNRTMHYSISKQKMAITKEHSITLNLTIMNVSLQDSGTYACRARNVYTGEEILQKKEITIRDQEAPYLLRNLSDHTVAISSSTTLDCHANGVPEPQITWFKNNHKIQQEPGIILGPGSSTLFIERVTEEDEGVYHCKATNQKGSVESSAYLTVQGTSDKSNLELITLTCTCVAATLFWLLLTLFIRKMKRSSSEIKTDYLSIIMDPDEVPLDEQCERLPYDASKWEFARERLKLGKSLGRGAFGKVVQASAFGIKKSPTCRTVAVKMLKEGATASEYKALMTELKILTHIGHHLNVVNLLGACTKQGGPLMVIVEYCKYGNLSNYLKSKRDLFFLNKDAALHMEPKKEKMEPGLEQGKKPRLDSVTSSESFASSGFQEDKSLSDVEEEEDSDGFYKEPITMEDLISYSFQVARGMEFLSSRKCIHRDLAARNILLSENNVVKICDFGLARDIYKNPDYVRKGDTRLPLKWMAPESIFDKIYSTKSDVWSYGVLLWEIFSLGGSPYPGVQMDEDFCSRLREGMRMRAPEYSTPEIYQIMLDCWHRDPKERPRFAELVEKLGDLLQANVQQDGKDYIPINAILTGNSGFTYSTPAFSEDFFKESISAPKFNSGSSDDVRYVNAFKFMSLERIKTFEELLPNATSMFDDYQGDSSTLLASPMLKRFTWTDSKPKASLKIDLRVTSKSKESGLSDVSRPSFCHSSCGHVSEGKRRFTYDHAELERKIACCSPPPDYNSVVLYSTPPI

SEQ ID NO: 5460 - protein, 541 aa, Homo Sapiens
MVSYWDTGVLLCALLSCLLLTGSSSGSKLKDPELSLKGTQHIMQAGQTLHLQCRGEAAHKWSLPEMVSKESERLSITKSACGRNGKQFCSTLTLNTAQANHTGFYSCKYLAVPTSKKKETESAIYIFISDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVQISTPRPVKLLRGHTLVLNCTATTPLNTRVQMTWSYPDEKNKRASVRRRIDQSNSHANIFYSVLTIDKMQNKDKGLYTCRVRSGPSFKSVNTSVHIYDKAFITVKHRKQQVLETVAGKRSYRLSMKVKAFPSPEVVWLKDGLPATEKSARYLTRGYSLIIKDVTEEDAGNYTILLSIKQSNVFKNLTATLIVNVKPQIYEKAVSSFPDPALYPLGSRQILTCTAYGIPQPTIKWFWHPCNHNHSEARCDFCSNNEESFILDADSNMGNRIESITQRMAIIEGKNKLPPANSSFMLPPTSFSSNYFHFLP

SEQ ID NO: 5461 - protein, 733 aa, Homo Sapiens
MVSYWDTGVLLCALLSCLLLTGSSSGSKLKDPELSLKGTQHIMQAGQTLHLQCRGEAAHKWSLPEMVSKESERLSITKSACGRNGKQFCSTLTLNTAQANHTGFYSCKYLAVPTSKKKETESAIYIFISDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVQISTPRPVKLLRGHTLVLNCTATTPLNTRVQMTWSYPDEKNKRASVRRRIDQSNSHANIFYSVLTIDKMQNKDKGLYTCRVRSGPSFKSVNTSVHIYDKAFITVKHRKQQVLETVAGKRSYRLSMKVKAFPSPEVVWLKDGLPATEKSARYLTRGYSLIIKDVTEEDAGNYTILLSIKQSNVFKNLTATLIVNVKPQIYEKAVSSFPDPALYPLGSRQILTCTAYGIPQPTIKWFWHPCNHNHSEARCDFCSNNEESFILDADSNMGNRIESITQRMAIIEGKNKMASTLVVADSRISGIYICIASNKVGTVGRNISFYITDVPNGFHVNLEKMPTEGEDLKLSCTVNKFLYRDVTWILLRTVNNRTMHYSISKQKMAITKEHSITLNLTIMNVSLQDSGTYACRARNVYTGEEILQKKEITIRDQEAPYLLRNLSDHTVAISSSTTLDCHANGVPEPQITWFKNNHKIQQEPELYTSTSPSSSSSSPLSSSSSSSSSSSS

SEQ ID NO: 5462 - protein, 687 aa, Homo Sapiens
MVSYWDTGVLLCALLSCLLLTGSSSGSKLKDPELSLKGTQHIMQAGQTLHLQCRGEAAHKWSLPEMVSKESERLSITKSACGRNGKQFCSTLTLNTAQANHTGFYSCKYLAVPTSKKKETESAIYIFISDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVQISTPRPVKLLRGHTLVLNCTATTPLNTRVQMTWSYPDEKNKRASVRRRIDQSNSHANIFYSVLTIDKMQNKDKGLYTCRVRSGPSFKSVNTSVHIYDKAFITVKHRKQQVLETVAGKRSYRLSMKVKAFPSPEVVWLKDGLPATEKSARYLTRGYSLIIKDVTEEDAGNYTILLSIKQSNVFKNLTATLIVNVKPQIYEKAVSSFPDPALYPLGSRQILTCTAYGIPQPTIKWFWHPCNHNHSEARCDFCSNNEESFILDADSNMGNRIESITQRMAIIEGKNKMASTLVVADSRISGIYICIASNKVGTVGRNISFYITDVPNGFHVNLEKMPTEGEDLKLSCTVNKFLYRDVTWILLRTVNNRTMHYSISKQKMAITKEHSITLNLTIMNVSLQDSGTYACRARNVYTGEEILQKKEITIRGEHCNKKAVFSRISKFKSTRNDCTTQSNVKH

SEQ ID NO: 5463 - protein, 665 aa, Homo Sapiens
MVSYWDTGVLLCALLSCLLLTGSSSGSKLKDPELSLKGTQHIMQAGQTLHLQCRGEAAHKWSLPEMVSKESERLSITKSACGRNGKQFCSTLTLNTAQANHTGFYSCKYLAVPTSKKKETESAIYIFISDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVQISTPRPVKLLRGHTLVLNCTATTPLNTRVQMTWSYPDEKNKRASVRRRIDQSNSHANIFYSVLTIDKMQNKDKGLYTCRVRSGPSFKSVNTSVHIYDKAFITVKHRKQQVLETVAGKRSYRLSMKVKAFPSPEVVWLKDGLPATEKSARYLTRGYSLIIKDVTEEDAGNYTILLSIKQSNVFKNLTATLIVNVKPQIYEKAVSSFPDPALYPLGSRQILTCTAYGIPQPTIKWFWHPCNHNHSEARCDFCSNNEESFILDADSNMGNRIESITQRMAIIEGKNKMASTLVVADSRISGIYICIASNKVGTVGRNISFYITDVPNGFHVNLEKMPTEGEDLKLSCTVNKFLYRDVTWILLRTVNNRTMHYSISKQKMAITKEHSITLNLTIMNVSLQDSGTYACRARNVYTGEEILQKKEITIRGSEEMLLPK

SEQ ID NO: 5464 - protein, 1363 aa, Homo Sapiens
MQRGAALCLRLWLCLGLLDGLVSGYSMTPPTLNITEESHVIDTGDSLSISCRGQHPLEWAWPGAQEAPATGDKDSEDTGVVRDCEGTDARPYCKVLLLHEVHANDTGSYVCYYKYIKARIEGTTAASSYVFVRDFEQPFINKPDTLLVNRKDAMWVPCLVSIPGLNVTLRSQSSVLWPDGQEVVWDDRRGMLVSTPLLHDALYLQCETTWGDQDFLSNPFLVHITGNELYDIQLLPRKSLELLVGEKLVLNCTVWAEFNSGVTFDWDYPGKQAERGKWVPERRSQQTHTELSSILTIHNVSQHDLGSYVCKANNGIQRFRESTEVIVHENPFISVEWLKGPILEATAGDELVKLPVKLAAYPPPEFQWYKDGKALSGRHSPHALVLKEVTEASTGTYTLALWNSAAGLRRNISLELVVNVPPQIHEKEASSPSIYSRHSRQALTCTAYGVPLPLSIQWHWRPWTPCKMFAQRSLRRRQQQDLMPQCRDWRAVTTQDAVNPIESLDTWTEFVEGKNKTVSKLVIQNANVSAMYKCVVSNKVGQDERLIYFYVTTIPDGFTIESKPSEELLEGQPVLLSCQADSYKYEHLRWYRLNLSTLHDAHGNPLLLDCKNVHLFATPLAASLEEVAPGARHATLSLSIPRVAPEHEGHYVCEVQDRRSHDKHCHKKYLSVQALEAPRLTQNLTDLLVNVSDSLEMQCLVAGAHAPSIVWYKDERLLEEKSGVDLADSNQKLSIQRVREEDAGRYLCSVCNAKGCVNSSASVAVEGSEDKGSMEIVILVGTGVIAVFFWVLLLLIFCNMRRPAHADIKTGYLSIIMDPGEVPLEEQCEYLSYDASQWEFPRERLHLGRVLGYGAFGKVVEASAFGIHKGSSCDTVAVKMLKEGATASEHRALMSELKILIHIGNHLNVVNLLGACTKPQGPLMVIVEFCKYGNLSNFLRAKRDAFSPCAEKSPEQRGRFRAMVELARLDRRRPGSSDRVLFARFSKTEGGARRASPDQEAEDLWLSPLTMEDLVCYSFQVARGMEFLASRKCIHRDLAARNILLSESDVVKICDFGLARDIYKDPDYVRKGSARLPLKWMAPESIFDKVYTTQSDVWSFGVLLWEIFSLGASPYPGVQINEEFCQRLRDGTRMRAPELATPAIRRIMLNCWSGDPKARPAFSELVEILGDLLQGRGLQEEEEVCMAPRSSQSSEEGSFSQVSTMALHIAQADAEDSPPSLQRHSLAARYYNWVSFPGCLARGAETRGSSRMKTFEEFPMTPTTYKGSVDNQTDSGMVLASEEFEQIESRHRQESGFSCKGPGQNVAVTRAHPDSQGRRRRPERGARGGQVFYNSEYGELSEPSEEDHCSPSARVTFFTDNSY

SEQ ID NO: 5465 - protein, 1298 aa, Homo Sapiens
MQRGAALCLRLWLCLGLLDGLVSGYSMTPPTLNITEESHVIDTGDSLSISCRGQHPLEWAWPGAQEAPATGDKDSEDTGVVRDCEGTDARPYCKVLLLHEVHANDTGSYVCYYKYIKARIEGTTAASSYVFVRDFEQPFINKPDTLLVNRKDAMWVPCLVSIPGLNVTLRSQSSVLWPDGQEVVWDDRRGMLVSTPLLHDALYLQCETTWGDQDFLSNPFLVHITGNELYDIQLLPRKSLELLVGEKLVLNCTVWAEFNSGVTFDWDYPGKQAERGKWVPERRSQQTHTELSSILTIHNVSQHDLGSYVCKANNGIQRFRESTEVIVHENPFISVEWLKGPILEATAGDELVKLPVKLAAYPPPEFQWYKDGKALSGRHSPHALVLKEVTEASTGTYTLALWNSAAGLRRNISLELVVNVPPQIHEKEASSPSIYSRHSRQALTCTAYGVPLPLSIQWHWRPWTPCKMFAQRSLRRRQQQDLMPQCRDWRAVTTQDAVNPIESLDTWTEFVEGKNKTVSKLVIQNANVSAMYKCVVSNKVGQDERLIYFYVTTIPDGFTIESKPSEELLEGQPVLLSCQADSYKYEHLRWYRLNLSTLHDAHGNPLLLDCKNVHLFATPLAASLEEVAPGARHATLSLSIPRVAPEHEGHYVCEVQDRRSHDKHCHKKYLSVQALEAPRLTQNLTDLLVNVSDSLEMQCLVAGAHAPSIVWYKDERLLEEKSGVDLADSNQKLSIQRVREEDAGRYLCSVCNAKGCVNSSASVAVEGSEDKGSMEIVILVGTGVIAVFFWVLLLLIFCNMRRPAHADIKTGYLSIIMDPGEVPLEEQCEYLSYDASQWEFPRERLHLGRVLGYGAFGKVVEASAFGIHKGSSCDTVAVKMLKEGATASEHRALMSELKILIHIGNHLNVVNLLGACTKPQGPLMVIVEFCKYGNLSNFLRAKRDAFSPCAEKSPEQRGRFRAMVELARLDRRRPGSSDRVLFARFSKTEGGARRASPDQEAEDLWLSPLTMEDLVCYSFQVARGMEFLASRKCIHRDLAARNILLSESDVVKICDFGLARDIYKDPDYVRKGSARLPLKWMAPESIFDKVYTTQSDVWSFGVLLWEIFSLGASPYPGVQINEEFCQRLRDGTRMRAPELATPAIRRIMLNCWSGDPKARPAFSELVEILGDLLQGRGLQEEEEVCMAPRSSQSSEEGSFSQVSTMALHIAQADAEDSPPSLQRHSLAARYYNWVSFPGCLARGAETRGSSRMKTFEEFPMTPTTYKGSVDNQTDSGMVLASEEFEQIESRHRQESGFR

SEQ ID NO: 5466 - protein, 1306 aa, Homo Sapiens
MQRGAALCLRLWLCLGLLDGLVSGYSMTPPTLNITEESHVIDTGDSLSISCRGQHPLEWAWPGAQEAPATGDKDSEDTGVVRDCEGTDARPYCKVLLLHEVHANDTGSYVCYYKYIKARIEGTTAASSYVFVRDFEQPFINKPDTLLVNRKDAMWVPCLVSIPGLNVTLRSQSSVLWPDGQEVVWDDRRGMLVSTPLLHDALYLQCETTWGDQDFLSNPFLVHITGNELYDIQLLPRKSLELLVGEKLVLNCTVWAEFNSGVTFDWDYPGKQAERGKWVPERRSQQTHTELSSILTIHNVSQHDLGSYVCKANNGIQRFRESTEVIVHENPFISVEWLKGPILEATAGDELVKLPVKLAAYPPPEFQWYKDGKALSGRHSPHALVLKEVTEASTGTYTLALWNSAAGLRRNISLELVVNVPPQIHEKEASSPSIYSRHSRQALTCTAYGVPLPLSIQWHWRPWTPCKMFAQRSLRRRQQQDLMPQCRDWRAVTTQDAVNPIESLDTWTEFVEGKNKTVSKLVIQNANVSAMYKCVVSNKVGQDERLIYFYVTTIPDGFTIESKPSEELLEGQPVLLSCQADSYKYEHLRWYRLNLSTLHDAHGNPLLLDCKNVHLFATPLAASLEEVAPGARHATLSLSIPRVAPEHEGHYVCEVQDRRSHDKHCHKKYLSVQALEAPRLTQNLTDLLVNVSDSLEMQCLVAGAHAPSIVWYKDERLLEEKSGVDLADSNQKLSIQRVREEDAGRYLCSVCNAKGCVNSSASVAVEGSEDKGSMEIVILVGTGVIAVFFWVLLLLIFCNMRRPAHADIKTGYLSIIMDPGEVPLEEQCEYLSYDASQWEFPRERLHLGRVLGYGAFGKVVEASAFGIHKGSSCDTVAVKMLKEGATASEHRALMSELKILIHIGNHLNVVNLLGACTKPQGPLMVIVEFCKYGNLSNFLRAKRDAFSPCAEKSPEQRGRFRAMVELARLDRRRPGSSDRVLFARFSKTEGGARRASPDQEAEDLWLSPLTMEDLVCYSFQVARGMEFLASRKCIHRDLAARNILLSESDVVKICDFGLARDIYKDPDYVRKGSARLPLKWMAPESIFDKVYTTQSDVWSFGVLLWEIFSLGASPYPGVQINEEFCQRLRDGTRMRAPELATPAIRRIMLNCWSGDPKARPAFSELVEILGDLLQGRGLQEEEEVCMAPRSSQSSEEGSFSQVSTMALHIAQADAEDSPPSLQRHSLAARYYNWVSFPGCLARGAETRGSSRMKTFEEFPMTPTTYKGSVDNQTDSGMVLASEEFEQIESRHRQESGFRGTRRTRGA

SEQ ID NO: 5467 - protein, 295 aa, Homo Sapiens
MQRGAALCLRLWLCLGLLDGLVSGYSMTPPTLNITEESHVIDTGDSLSISCRGQHPLEWAWPGAQEAPATGDKDSEDTGVVRDCEGTDARPYCKVLLLHEVHANDTGSYVCYYKYIKARIEGTTAASSYVFVRDFEQPFINKPDTLLVNRKDAMWVPCLVSIPGLNVTLRSQSSVLWPDGQEVVWDDRRGMLVSTPLLHDALYLQCETTWGDQDFLSNPFLVHITGNELYDIQLLPRKSLELLVGEKLVLNCTVWAEFNSGVTFDWDYPGKQKIPSSASSGSKDPSWRPRQETSW

SEQ ID NO: 5468 - protein, 142 aa, Homo Sapiens
MVELARLDRRRPGSSDRVLFARFSKTEGGARRASPDQEAEDLWLSPLTMEDLVCYSFQVARGMEFLASRKCIHRDLAARNILLSESDVVKICDFGLARDIYKDPDYVRKGSARLPLKWMAPESIFDKVYTTQSDVWSFGVLL

SEQ ID NO: 5469 - protein, 126 aa, Homo Sapiens
MAKRVAIVGAGVSGLASIKCCLEEGLEPTCFERSDDLGGLWRFTEHVEEGRASLYKSVVSNSCKEMSCYSDFPFPEDYPNYVPNSQFLEYLKMYANHFDLLKHIQFKSGIQLTEQQLFPISCIRDS

SEQ ID NO: 5470 - protein, 532 aa, Homo Sapiens
MAKRVAIVGAGVSGLASIKCCLEEGLEPTCFERSDDLGGLWRFTEHVEEGRASLYKSVVSNSCKEMSCYSDFPFPEDYPNYVPNSQFLEYLKMYANHFDLLKHIQFKTKVCSVTKCSDSAVSGQWEVVTMHEEKQESAIFDAVMVCTGFLTNPYLPLDSFPGINAFKGQYFHSRQYKHPDIFKDKRVLVIGMGNSGTDIAVEASHLAEKVFLSTTGGGWVISRIFDSGYPWDMVFMTRFQNMLRNSLPTPIVTWLMERKINNWLNHANYGLIPEDRTQLKEFVLNDELPGRIITGKVFIRPSIKEVKENSVIFNNTSKEEPIDIIVFATGYTFAFPFLDESVVKVEDGQASLYKYIFPAHLQKPTLAIIGLIKPLGSMIPTGETQARWAVRVLKGVNKLPPPSVMIEEINARKENKPSWFGLCYCKALQSDYITYIDELLTYINAKPNLFSMLLTDPHLALTVFFGPCSPYQFRLTGPGKWEGARNAIMTQWDRTFKVIKARVVQESPSPFESFLKVFSFLALLVAIFLIFL

SEQ ID NO: 5471 - protein, 532 aa, Homo Sapiens; identical to SEQ ID NO: 5470

SEQ ID NO: 5472 - protein, 532 aa, Homo Sapiens; identical to SEQ ID NO: 5470

SEQ ID NO: 5473 - protein, 469 aa, Homo Sapiens
MAKRVAIVGAGVSGLASIKCCLEEGLEPTCFERSDDLGGLWRFTTKVCSVTKCSDSAVSGQWEVVTMHEEKQESAIFDAVMVCTGFLTNPYLPLDSFPGINAFKGQYFHSRQYKHPDIFKDKRVLVIGMGNSGTDIAVEASHLAEKVFLSTTGGGWVISRIFDSGYPWDMVFMTRFQNMLRNSLPTPIVTWLMERKINNWLNHANYGLIPEDRTQLKEFVLNDELPGRIITGKVFIRPSIKEVKENSVIFNNTSKEEPIDIIVFATGYTFAFPFLDESVVKVEDGQASLYKYIFPAHLQKPTLAIIGLIKPLGSMIPTGETQARWAVRVLKGVNKLPPPSVMIEEINARKENKPSWFGLCYCKALQSDYITYIDELLTYINAKPNLFSMLLTDPHLALTVFFGPCSPYQFRLTGPGKWEGARNAIMTQWDRTFKVIKARVVQESPSPFESFLKVFSFLALLVAIFLIFL

SEQ ID NO: 5474 - protein, 131 aa, Homo Sapiens
MAKKVAVIGAGVSGLISLKCCVDEGLEPTCFERTEDIGGVWRFKENVEDGRASIYQSVVTNTSKEMSCFSDFPMPEDFPNFLHNSKLLEYFRIFAKKFDLLKYIQFQTTVLSVRKCPDFSSSGQWKVVTQS

SEQ ID NO: 5475 - protein, 535 aa, Homo Sapiens [sequence omitted]

SEQ ID NO: 5476 - protein, 153 aa, Homo Sapiens
TQPREKTILSKRRCQKAKTKENVEDGRASIYQSVVTNTSKEMSCFSDFPMPEDFPNFLHNSKLLEYFRIFAKKFDLLKYIQFQTTVLSVRKCPDFSSSGQWKVVTQSNGKEQSAVFDAVMVCSGHHILPHIPLKSFPGFYQHQAWHLGHEPYL

SEQ ID NO: 5477 - protein, 218 aa, Homo Sapiens
MGKKVAIIGAGVSGLASIRSCLEEGLEPTCFEKSNDIGGLWKFSDHAEEGRASIYKSVFSNSSKEMMCFPDFPFPDDFPNFMHNSKIQEYIIAFAKEKNLLKYIQFKTFVSSVNKHPDFATTGQWDVTTERDGKKESAVFDAVMVCSGHHVYPNLPDYKEPGVFNGKRVLVVGLGNSGCDIATELSRTAEQVMISSRSGSWVMSRVWDNGYPWDMLLV

SEQ ID NO: 5478 - protein, 532 aa, Homo Sapiens
MGKKVAIIGAGVSGLASIRSCLEEGLEPTCFEKSNDIGGLWKFSDHAEEGRASIYKSVFSNSSKEMMCFPDFPFPDDFPNFMHNSKIQEYIIAFAKEKNLLKYIQFKTFVSSVNKHPDFATTGQWDVTTERDGKKESAVFDAVMVCSGHHVYPNLPKESFPGLNHFKGKCFHSRDYKEPGVFNGKRVLVVGLGNSGCDIATELSRTAEQVMISSRSGSWVMSRVWDNGYPWDMLLVTRFGTFLKNNLPTAISDWLYVKQMNARFKHENYGLMPLNGVLRKEPVFNDELPASILCGIVSVKPNVKEFTETSAIFEDGTIFEGIDCVIFATGYSFAYPFLDESIIKSRNNEIILFKGVFPPLLEKSTIAVIGFVQSLGAAIPTVDLQSRWAAQVIKGTCTLPSMEDMMNDINEKMEKKRKWFGKSETIQTDYIVYMDELSSFIGAKPNIPWLFLTDPKLAMEVYFGPCSPYQFRLVGPGQWPGARNAILTQWDRSLKPMQTRVVGRLQKPCFFFHWLKLFAIPILLIAVFLVLT

SEQ ID NO: 5479 - protein, 48 aa, Homo Sapiens
MGKKVAIIGAGVSGLASIRSCLEEGLEPTCFEKSNDIGGLWKFSRSHE

SEQ ID NO: 5480 - protein, 145 aa, Homo Sapiens
MTKKRIAVIGGGVSGLSSIKCCVEEGLEPVCFERTDDIGGLWRFQENPEEGRASIYKSVIINTSKEMMCFSDYPIPDHYPNFMHNAQVLEYFRMYAKEFDLLKYIRFKTTVCSVKKQPDFATSGQWEVVTESEGKKEMNVFDGVM

SEQ ID NO: 5481 - protein, 192 aa, Homo Sapiens
MTKKRIAVIGGGVSGLSSIKCCVEEGLEPVCFERTDDIGGLWRFQENPEEGRASIYKSVIINTSKEMMCFSDYPIPDHYPNFMHNAQVLEYFRMYAKEFDLLKYIRFKTTVCSVKKQPDFATSGQWEVVTESEGKKEMNVFDGVMVCTGHHTNAHLPLESFPGIEKFKGQYFHSRDYKNPEGFTGKRVIIIG

SEQ ID NO: 5482 - protein, 533 aa, Homo Sapiens
MTKKRIAVIGGGVSGLSSIKCCVEEGLEPVCFERTDDIGGLWRFQENPEEGRASIYKSVIINTSKEMMCFSDYPIPDHYPNFMHNAQVLEYFRMYAKEFDLLKYIRFKTTVCSVKKQPDFATSGQWEVVTESEGKKEMNVFDGVMVCTGHHTNAHLPLESFPGIEKFKGQYFHSRDYKNPEGFTGKRVIIIGIGNSGGDLAVEISQTAKQVFLSTRRGAWILNRVGDYGYPADVLFSSRLTHFIWKICGQSLANKYLEKKINQRFDHEMFGLKPKHRALSQHPTLNDDLPNRIISGLVKVKGNVKEFTETAAIFEDGSREDDIDAVIFATGYSFDFPFLEDSVKVVKNKISLYKKVFPPNLERPTLAIIGLIQPLGAIMPISELQGRWATQVFKGLKTLPSQSEMMAEISKAQEEIDKRYVESQRHTIQGDYIDTMEELADLVGVRPNLLSLAFTDPKLALHLLLGPCTPIHYRVQGPGKWDGARKAILTTDDRIRKPLMTRVVERSSSMTSTMTIGKFMLALAFFAIIIAYF

SEQ ID NO: 5483 - protein, 285 aa, Homo Sapiens
MTKKRIAVIGGGVSGLSSIKCCVEEGLEPVCFERTDDIGGLWRFQENPEEGRASIYKSVIINTSKEMMCFSDYPIPDHYPNFMHNAQVLEYFRMYAKEFDLLKYIRFKTTVCSVKKQPDFATSGQWEVVTESEGKKEMNVFDGVMVCTGHHTNAHLPLESFPGIEKFKGQYFHSRDYKNPEGFTGKRVIIIGIGNSGGDLAVEISQTAKQVFLSTRRGAWILNRVGDYGYPADVLFSSRLTHFIWKICGQSLANKYLEKKINQRFDHEMFGLKPKHRSKDIALTE

SEQ ID NO: 5484 - protein, 464 aa, Homo Sapiens
MTKKRIAVIGGGVSGLSSIKCCVEEGLEPVCFERTDDIGGLWRFQENPEEGRASIYKSVIINTSKEMMCFSDYPIPDHYPNFMHNAQVLEYFRMYAKEFDLLKYIRFKTTVCSVKKQPDFATSGQWEVVTESEGKKEMNVFDGVMVCTGHHTNAHLPLESFPGIEKFKGQYFHSRDYKNPEGFTGKRVIIIGIGNSGGDLAVEISQTAKQVFLSTRRGAWILNRVGDYGYPADVLFSSRLTHFIWKICGQSLANKYLEKKINQRFDHEMFGLKPKHRALSQHPTLNDDLPNRIISGLVKVKGNVKEFTETAAIFEDGSREDDIDAVIFATGYSFDFPFLEDSVKVVKNKISLYKKVFPPNLERPTLAIIGLIQPLGAIMPISELQGRWATQVFKGLKTLPSQSEMMAEISKAQEEIDKSLTMRKTSDKPKLKNILQIPDYLKTVKIINKESLRNCPGIKGPKET

SEQ ID NO: 5485 - protein, 278 aa, Homo Sapiens
MTKKRIAVIGGGVSGLSSIKCCVEEGLEPVCFERTDDIGGLWRFQENPEEGRASIYKSVIINTSKEMMCFSDYPIPDHYPNFMHNAQVLEYFRMYAKEFDLLKYIRFKTTVCSVKKQPDFATSGQWEVVTESEGKKEMNVFDGVMVCTGHHTNAHLPLESFPGIEKFKGQYFHSRDYKNPEGFTGKRVIIIGIGNSGGDLAVEISQTAKQVFLSTRRGAWILNRVGDYGYPADVLFSSRLTHFIWKICGQSLANKYLEKKINQRFDHEMFGLKPKHRL

SEQ ID NO: 5486 - protein, 464 aa, Homo Sapiens; identical to SEQ ID NO: 5484

SEQ ID NO: 5487 - protein, 376 aa, Homo Sapiens
MQWTSLLLLAGLFSLSQAQYEDDPHWWFHYLRSQQSTYYDPYDPYPYETYEPYPYGVDEGPAYTYGSPSPPDPRDCPQECDCPPNFPTAMYCDNRNLKYLPFVPSRMKYVYFQNNQITSIQEGVFDNATGLLWIALHGNQITSDKVGRKVFSKLRHLERLYLDHNNLTRMPGPLPRSLRELHLDHNQISRVPNNALEGLENLTALYLQHNEIQEVGSSMRGLRSLILLDLSYNHLRKVPDGLPSALEQLYMEHNNVYTVPDSYFRGAPKLLYVRLSHNSLTNNGLASNTFNSSSLLELDLSYNQLQKIPPVNTNLENLYLQGNRINEFSISSFCTVVDVVNFSKLQVLRLDGNEIKRSAMPADAPLCLRLASLIEI

SEQ ID NO: 5488 - protein, 1103 aa, Homo Sapiens
LRWTPLNSSTIIGYRITVVAAGEGIPIFEDFVDSSVGYYTVTGLEPGIDYDISVITLINGGESAPTTLTQQTAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTTIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTDELPQLVTLPHPNLHGPEILDVPSTVQKTPFVTHPGYDTGNGIQLPGTSGQQPSVGQQMIFEEHGFRRTTPPTTATPIRHRPRPYPPNVGEEIQIGHIPREDVDYHLYPHGPGLNPNASTGQEALSQTTISWAPFQDTSEYIISCHPVGTDEEPLQFRVPGTSTSATLTGLTRGATYNVIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 5489 - protein, 2355 aa, Homo Sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDTTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTDELPQLVTLPHPNLHGPEILDVPSTVQKTPFVTHPGYDTGNGIQLPGTSGQQPSVGQQMIFEEHGFRRTTPPTTATPIRHRPRPYPPNVGQEALSQTTISWAPFQDTSEYIISCHPVGTDEEPLQFRVPGTSTSATLTGLTRGATYNVIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 5490 - protein, 2477 aa, Homo Sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDTTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPEVPQLTDLSFVDITDSSIGLRWTPLNSSTIIGYRITVVAAGEGIPIFEDFVDSSVGYYTVTGLEPGIDYDISVITLINGGESAPTTLTQQTAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTDELPQLVTLPHPNLHGPEILDVPSTVQKTPFVTHPGYDTGNGIQLPGTSGQQPSVGQQMIFEEHGFRRTTPPTTATPIRHRPRPYPPNVGEEIQIGHIPREDVDYHLYPHGPGLNPNASTGQEALSQTTISWAPFQDTSEYIISCHPVGTDEEPLQFRVPGTSTSATLTGLTRGATYNVIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 5491 - protein, 2176 aa, Homo Sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDTTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTTIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTGQEALSQTTISWAPFQDTSEYIISCHPVGTDEEPLQFRVPGTSTSATLTGLTRGATYNVIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 5492 - protein, 2386 aa, Homo Sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDTTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTDELPQLVTLPHPNLHGPEILDVPSTVQKTPFVTHPGYDTGNGIQLPGTSGQQPSVGQQMIFEEHGFRRTTPPTTATPIRHRPRPYPPNVGEEIQIGHIPREDVDYHLYPHGPGLNPNASTGQEALSQTTISWAPFQDTSEYIISCHPVGTDEEPLQFRVPGTSTSATLTGLTRGATYNVIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 5493 - protein, 2296 aa, Homo Sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDTTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTTIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTDELPQLVTLPHPNLHGPEILDVPSTVQKTPFVTHPGYDTGNGIQLPGTSGQQPSVGQQMIFEEHGFRRTTPPTTATPIRHRPRPYPPNVGEEIQIGHIPREDVDYHLYPHGPGLNPNASTGQEALSQTTISWAPFQDTSEYIISCHPVGTDEEPLQFRVPGTSTSATLTGLTRGATYNVIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 5494 - protein, 2446 aa, Homo Sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDTTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPEVPQLTDLSFVDITDSSIGLRWTPLNSSTIIGYRITVVAAGEGIPIFEDFVDSSVGYYTVTGLEPGIDYDISVITLINGGESAPTTLTQQTAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTDELPQLVTLPHPNLHGPEILDVPSTVQKTPFVTHPGYDTGNGIQLPGTSGQQPSVGQQMIFEEHGFRRTTPPTTATPIRHRPRPYPPNVGQEALSQTTISWAPFQDTSEYIISCHPVGTDEEPLQFRVPGTSTSATLTGLTRGATYNVIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 5495 - protein, 2330 aa, Homo Sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDTTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTVQKTPFVTHPGYDTGNGIQLPGTSGQQPSVGQQMIFEEHGFRRTTPPTTATPIRHRPRPYPPNVGQEALSQTTISWAPFQDTSEYIISCHPVGTDEEPLQFRVPGTSTSATLTGLTRGATYNVIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 5496 - protein, 2240 aa, Homo Sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDTTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTTIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTVQKTPFVTHPGYDTGNGIQLPGTSGQQPSVGQQMIFEEHGFRRTTPPTTATPIRHRPRPYPPNVGQEALSQTTISWAPFQDTSEYIISCHPVGTDEEPLQFRVPGTSTSATLTGLTRGATYNVIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 5497 - protein, 657 aa, Homo Sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPVSIPPRNLGY

SEQ ID NO: 5498 - protein, 2267 aa, Homo Sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDTTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPEVPQLTDLSFVDITDSSIGLRWTPLNSSTIIGYRITVVAAGEGIPIFEDFVDSSVGYYTVTGLEPGIDYDISVITLINGGESAPTTLTQQTAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTTIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTGQEALSQTTISWAPFQDTSEYIISCHPVGTDEEPLQFRVPGTSTSATLTGLTRGATYNVIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 5499 - protein, 2265 aa, Homo Sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDTTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTTIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTDELPQLVTLPHPNLHGPEILDVPSTVQKTPFVTHPGYDTGNGIQLPGTSGQQPSVGQQMIFEEHGFRRTTPPTTATPIRHRPRPYPPNVGQEALSQTTISWAPFQDTSEYIISCHPVGTDEEPLQFRVPGTSTSATLTGLTRGATYNVIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 5500 - protein, 241 aa, Homo Sapiens
YLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTVQKTPFVTHPGYDTGNGIQLPGTSGQQPSVGQQMIFEEHGFRRTTPPTTATPIRHRPRPYPPNVGEEIQIGHIPREDVDYHLYPHGPGLNPNASTGQEALSQTTISWAPFQDTSEYIISCHPVGTDEEPLQ

SEQ ID NO: 5501 - protein, 1894 aa, Homo Sapiens
MAPEAGATLRAPRRLSWAALLLLAALLPVASSAAASVDHPLKPRHVKLLSTKMGLKVTWDPPKDATSRPVEHYNIAYGKSLKSLKYIKVNAETYSFLIEDVEPGVVYFVLLTAENHSGVSRPVYRAESPPGGEWIEIDGFPIKGPGPFNETVTEKEVPNKPLRVRVRSSDDRLSVAWKAPRLSGAKSPRRSRGFLLGYGESGRKMNYVPLTRDERTHEIKKLASESVYVVSLQSMNSQGRSQPVYRAALTKRKISEEDELDVPDDISVRVMSSQSVLVSWVDPVLEKQKKVVASRQYTVRYREKGELARWDYKQIANRRVLIENLIPDTVYEFAVRISQGERDGKWSTSVFQRTPESAPTTAPENLNVWPVNGKPTVVAASWDALPETEGKVKEYILSYAPALKPFGAKSLTYPGDTTSALVDGLQPGERYLFKIRATNRRGLGPHSKAFIVAMPTTSKADVEQNTEDNGKPEKPEPSSPSPRAPASSQHPSVPASPQGRNAKDLLLDLKNKILANGGAPRKPQLRAKKAEELDLQSTEITGEEELGSREDSPMSPSDTQDQKRTLRPPSRHGHSVVAPGRTAVRARMPALPRREGVDKPGFSLATQPRPGAPPSASASPAHHASTQGTSHRPSLPASLNDNDLVDSDEDERAVGSLHPKGAFAQPRPALSPSRQSPSSVLRDRSSVHPGAKPASPARRTPHSGAAEEDSSASAPPSRLSPPHGGSSRLLPTQPHLSSPLSKGGKDGEDAPATNSNAPSRSTMSSSVSSHLSSRTQVSEGAEASDGESHGDGDREDGGRQAEATAQTLRARPASGHFHLLRHKPFAANGRSPSRFSIGRGPRLQPSSSPQSTVPSRAHPRVPSHSDSHPKLSSGIHGDEEDEKPLPATVVNDHVPSSSRQPISRGWEDLRRSPQRGASLHRKEPIPENPKSTGADTHPQGKYSSLASKAQDVQQSTDADTEGHSPKAQPGSTDRHASPARPPAARSQQHPSVPRRMTPGRAPQQQPPPPVATSQHHPGPQSRDAGRSPSQPRLSLTQAGRPRPTSQGRSHSSSDPYTASSRGMLPTALQNQDEDAQGSYDDDSTEVEAQDVRAPAHAARAKEAAASLPKHQQVESPTGAGAGGDHRSQRGHAASPARPSRPGGPQSRARVPSRAAPGKSEPPSKRPLSSKSQQSVSAEDDEEEDAGFFKGGKEDLLSSSVPKWPSSSTPRGGKDADGSLAKEEREPAIALAPRGGSLAPVKRPLPPPPGSSPRASHVPSRLPPRSAATVSPVAGTHPWPQYTTRAPPGHFSTTPMLSLRQRMMHARFRNPLSRQPARPSYRQGYNGRPNVEGKVLPGSNGKPNGQRIINGPQGTKWVVDLDRGLVLNAEGRYLQDSHGNPLRIKLGGDGRTIVDLEGTPVVSPDGLPLFGQGRHGTPLANAQDKPILSLGGKPLVGLEVIKKTTHPPTTTMQPTTTTTPLPTTTTPRPTTATTRRTTTTRRTTTRRPTTTVRTTTRTTTTTTPTPTTPIPTCPPGTLERHDDDGNLIMSSNGIPECYAEEDEFSGLETDTAVPTEEAYVIYDEDYEFETSRPPTTTEPSTTATTPRVIPEEGAISSFPEEEFDLAGRKRFVAPYVTYLNKDPSAPCSLTDALDHFQVDSLDEIIPNDLKKSDLPPQHAPRNITVVAVEGCHSFVIVDWDKATPGDVVTGYLVYSASYEDFIRNKWSTQASSVTHLPIENLKPNTRYYFKVQAQNPHGYGPISPSVSFVTESDNPLLVVRPPGGEPIWIPFAFKHDPSYTDCHGRQYVKRTWYRKFVGVVLCNSLRYKIYLSDNLKDTFYSIGDSWGRGEDHCQFVDSHLDGRTGPQSYVEALPTIQGYYRQYRQEPVRFGNIGFGTPYYYVGWYECGVSIPGKW

SEQ ID NO: 5502 - protein, 1790 aa, Homo Sapiens
  misc_feature (1)..(1): Xaa can be any naturally occurring amino acid
XPRHVKLLSTKMGLKVTWDPPKDATSRPVEHYNIAYGKSLKSLKYIKVNAETYSFLIEDVEPGVVYFVLLTAENHSGVSRPVYRAESPPGGEWIEIDGFPIKGPGPFNETVTEKEVPNKPLRVRVRSSDDRLSVAWKAPRLSGAKSPRRSRGFLLGYGESGRKMNYVPLTRDERTHEIKKLASESVYVVSLQSMNSQGRSQPVYRAALTKRKISEEDELDVPDDISVRVMSSQSVLVSWVDPVLEKQKKVVASRQYTVRYREKGELARWDYKQIANRRVLIENLIPDTVYEFAVRISQGERDGKWSTSVFQRTPESAPTTAPENLNVWPVNGKPTVVAASWDALPETEGKVKASKADVEQNTEDNGKPEKPEPSSPSPRAPASSQHPSVPASPQGRNAKDLLLDLKNKILANGGAPRKPQLRAKKAEELDLQSTEITGEEELGSREDSPMSPSDTQDQKRTLRPPSRHGHSVVAPGRTAVRARMPALPRREGVDKPGFSLATQPRPGAPPSASASPAHHASTQGTSHRPSLPASLNDNDLVDSDEDERAVGSLHPKGAFAQPRPALSPSRQSPSSVLRDRSSVHPGAKPASPARRTPHSGAAEEDSSASAPPSRLSPPHGGSSRLLPTQPHLSSPLSKGGKDGEDAPATNSNAPSRSTMSSSVSSHLSSRTQVSEGAEASDGESHGDGDREDGGRQAEATAQTLRARPASGHFHLLRHKPFAANGRSPSRFSIGRGPRLQPSSSPQSTVPSRAHPRVPSHSDSHPKLSSGIHGDEEDEKPLPATVVNDHVPSSSRQPISRGWEDLRRSPQRGASLHRKEPIPENPKSTGADTHPQGKYSSLASKAQDVQQSTDADTEGHSPKAQPGSTDRHASPARPPAARSQQHPSVPRRMTPGRAPQQQPPPPVATSQHHPGPQSRDAGRSPSQPRLSLTQAGRPRPTSQGRSHSSSDPYTASSRGMLPTALQNQDEDAQGSYDDDSTEVEAQDVRAPAHAARAKEAAASLPKHQQVESPTGAGAGGDHRSQRGHAASPARPSRPGGPQSRARVPSRAAPGKSEPPSKRPLSSKSQQSVSAEDDEEEDAGFFKGGKEDLLSSSVPKWPSSSTPRGGKDADGSLAKEEREPAIALAPRGGSLAPVKRPLPPPPGSSPRASHVPSRLPPRSAATVSPVAGTHPWPQYTTRAPPGHFSTTPMLSLRQRMMHARFRNPLSRQPARPSYRQGYNGRPNVEGKVLPGSNGKPNGQRIINGPQGTKWVVDLDRGLVLNAEGRYLQDSHGNPLRIKLGGDGRTIVDLEGTPVVSPDGLPLFGQGRHGTPLANAQDKPILSLGGKPLVGLEVIKKTTHPPTTTMQPTTTTTPLPTTTTPRPTTATTRRTTTTRRTTTRRPTTTVRTTTRTTTTTTPTPTTPIPTCPPGTLERHDDDGNLIMSSNGIPECYAEEDEFSGLETDTAVPTEEAYVIYDEDYEFETSRPPTTTEPSTTATTPRVIPEEGAISSFPEEEFDLAGRKRFVAPYVTYLNKDPSAPCSLTDALDHFQVDSLDEIIPNDLKKSDLPPQHAPRNITVVAVEGCHSFVIVDWDKATPGDVVTGYLVYSASYEDFIRNKWSTQASSVTHLPIENLKPNTRYYFKVQAQNPHGYGPISPSVSFVTESDNPLLVVRPPGGEPIWIPFAFKHDPSYTDCHGRQYVKRTWYRKFVGVVLCNSLRYKIYLSDNLKDTFYSIGDSWGRGEDHCQFVDSHLDGRTGPQSYVEALPTIQGYYRQYRQEPVRFGNIGFGTPYYYVGWYECGVSIPGKW

SEQ ID NO: 5503 - protein, 733 aa, Homo Sapiens
MAGGRETCLPLIGFILICLKMVASAKSAPEIPTIDQAYSKLSNSITVEWATVPGATSYLLTAEDGDTVIETTVANSPGTVTGLKAATWYEITIRSISAAGRSQASPPKQAKTVLAAPILEVSSPSSDSILVQWEAVYMAIAFSVSIMRANGLGSIWKENTTNTSLTFTSLEAGTLYTIKAYAWNANRIPGDDSTCNQRTSPRAPANIQVSFDSGALKASFSWARAEGAFNYTVMALSDSSELTCSTTFSSCTISSLQCGTEYLISVLASNDAGSSKSSSAMTLKTVACAPGRVTIQEDPPGHLSVAWSSVDLGDYYVVFVKSDDGLEVHCNTSLTQCNFLSECGFTYFISVFVYNKAGQSPLGDIFNYTTAPCCPSDINPVLVSSDRVEIVWSPVRGAELYETKAVDGYNMVECNDTTPACTLSALECDTKYNITVYSFNEVRGSNMSCTPQFITTAPCSPEIKNVSRDAFSMINVHWRSTNDDATYTVTAQGEKGLYQCSSTGESCTMRGLPCGSVFSVTAVAETQAGRSLPSYSVPLETVPCCPTGLTVTQITQSVINVSWTIGRVAQTHVAVLESHTGQSKCHTHQNHCLLGCITCGINYTVTLKAISATGLTADCSYQSYFSGACCPLGVKLYRLGPNGIRIYWQASRGSANYSTDLYGSKGIFTCTPSAGLSFCDVTEIPCGDVYTVMVSPVAKTGLKLTFCPKKIYSVTCSGSTLGMVIYRGKRNEE

SEQ ID NO: 5504 - protein, 499 aa, Homo Sapiens
  misc_feature (1)..(1): Xaa can be any naturally occurring amino acid
XEGAFNYTVMALSDSSELTCSTTFSSCTISSLQCGTEYLISVLASNDAGSSKSSSAMTLKTVACAPGRVTIQEDPPGHLSVAWSSVDLGDYYVVFVKSDDGLEVHCNTSLTQCNFLSECGFTYFISVFVYNKAGQSPLGDIFNYTTAPCCPSDINPVLVSSDRVEIVWSPVRGAELYETKAVDGYNMVECNDTTPACTLSALECDTKYNITVYSFNEVRGSNMSCTPQFITTAPCSPEIKNVSRDAFSMINVHWRSTNDDATYTVTAQGEKGLYQCSSTGESCTMRGLPCGSVFSVTAVAETQAGRSLPSYSVPLETVPCCPTGLTVTQITQSVINVSWTIGRVAQTHVAVLESHTGQSKCHTHQNHCLLGCITCGINYTVTLKAISATGLTADCSYQSYFSGACCPLGVKLYRLGPNGIRIYWQASRGSANYSTDLYGSKGIFTCTPSAGLSFCDVTEIPCGDVYTVMVSPVAKTGLKLTFCPKKIYSVIYRGKRNEE

SEQ ID NO: 5505 - protein, 46 aa, Homo Sapiens
MAVSDVPSLSVGKEVQWEKLIAKAASIRDICHINMVQICWQLFLKC

SEQ ID NO: 5506 - protein, 1237 aa, Homo Sapiens
MAVSDVPSLSVGKEVQWEKLIAKAASIRDICKQRPYQHGADMLAAISQVLNECTKPDQATPAALVLQGLHALCQAEVVCIRSTWNALSPKLSCDTRPLILKTLSELFSLVPSLTVNTTEYENFKVQVLSFLWTHTQNKDPIVANAAYRSLANFSAGEHTILHLPEKIRPEIPIPEELDDDEDVEDVDLSVPGSCYLKLLSLTPPLVLPALEEFFTSLVKQEMVNMPRGIYHSALKGGARSDQGKTVAGIPNFILKMYETNKQPGLKPGLAGGMLFCYDVSMYQSKDGKPLNRLMASRGRSFKQTSLALVHEVHIQLSEWHRAIFLPQAWLAYMNRAYHAILQGRLGELELQLKHGKEEPEEVQYKKSTAWLWVRDMLTDEITKAAAKESPVVKGNALLALSSLAVVVSRHEASLSSDSDGLLEVQPNFLSMKEWVSMVLDTLLVIVDSHYQPRGQLLSWFYYKSYSGENTASAIARSAAATALSLLVPVFIISCKEKVEEILNMLTARLPGKPSADESQAVQIHMGLALGMFLSRLCEEKLSDISGQEMNLLLMKSLDALENCCFDTSLEYNTGCILGVGLVLSLMSHSSQMQSRVHVAALLRKLSAHVDDSGSQSRTFQEVLAYTLSCVCTSAFSAGIIEATEAEDVMNKLRLLVENSQQTSGFALALGNIVHGLSVCGHGKAEDLGSKLLPAWIRIVLTEGTPTMLCLAALHGMVALVGSEGDVMQLKSEAIQTSHFQGRLNEVIRTLTQVISVSGVIGLQSNAVWLLGHLHLSTLSSSQSRASVPTDYSYLPESSFIGAAIGFFITGGKKGPESVPPSLLKVVMKPIATVGESYQYPPVNWAALLSPLMRLNFGEEIQQLCLEIMVTQAQSSQNAAALLGLWVTPPLIHSLSLNTKRYLLISAPLWIKHISDEQILGFVENLMVAVFKAASPLGSPELCPSALHGLSQAMKLPSPAHHLWSLLSEATGKIFDLLPNKIRRKDLELYISIAKCLLEMTDDDANRIAQVTKSNIEKAAFVKLYLVSQGRFPLVNLTDMLSVAVQHREKEVLAWMILHSLYQARIVSHANTGVLKRMEWLLELMGYIRNVAYQSTSFHNTALDKALDFFLLIFATAVVAWADHTAPLLLGLSASWLPWHQENGPAGPVPSFLGRSPMHRVTLQEVLTLLPNSMALLLQKEPWKEQTQKFIDWLFSIMESPKEALSAQSRDLLKATLLSLRVLPEFKKKAVWTRAYGW

SEQ ID NO: 5507 - protein, 99 aa, Homo Sapiens
MLTARLPGKPSADESQAVQIHMGLALGMFLSRLCEEKLSDISGQEMNLLLMKSLDALENCCFDTSLEYNTGCILGVGLVLSLMSHSSQMQSRVHVAALL

SEQ ID NO: 5508 - protein, 128 aa, Homo Sapiens
MLTARLPGKPSADESQAVQIHMGLALGMFLSRLCEEKLSDISGQEMNLLLMKSLDALENCCFDTSLEYNTGCILGVGLVLSLMSHSSQMQSRVHVAALLRKLSAHVDDSGSQSRTFQEVLAYTLSCVC

SEQ ID NO: 5509 - protein, 180 aa, Homo Sapiens
MPKVFSVYFVCLCPALGKICDISGQEMNLLLMKSLDALENCCFDTSLEYNTGCILGVGLVLSLMSHSSQMQSRVHVAALLRKLSAHVDDSGSQSRTFQEVLAYTLSCVCTSAFSAGIIEATEAEDVMNKLRLLVENSQQTSGFALALGNIVHGLSVCGHGKAEDLGSKLLPAWIRIVLTE

SEQ ID NO: 5510 - protein, 1801 aa, Homo Sapiens
MSDDIRKRFEFPNSLIQSQAVGHLIAAVLKENGFSEKIHQSTNQTPALNLLWEKCCSDNVVVRTACCEGLVALVAQDHAEFSYVLNGILNLIPSTRNTHGLIKAIMHLLQMQALKEGQGGEKNIQSIYTIRNHPHPLITVLEHRPDCWPVFLQQLTAFFQQCPERLEVSCIQIMAPFLWYLYCEPSQLQEYAKLRLALLKVLLQPQVLCDKDQPSILEQQILQLCCDIVPCLQVKDLIQTTEAMMFIEEVCLSLLRHPVFWKIQLTQMSLQLLCVSEVSLKITGECSSSIHLLEHSVELLKEDFPVELVIIGIALLLLQTPASQQKPILNLALKLLSVTEDQKIPKSSLLLVMPILQILSSTALEDCISVDEEGPSRQQLALNLLEMIQQECYRDDHQKLSYKLVCPVTSMYGTIFTAWRILEVMTDSSAASDWLASVESLLPITAVIPAPAFLLLAHLLVEDKGQNLHQILKVTTELAQADSSQVPNLIPVLMFKLGRPLEPILYNDILYTLPKLGVHKVCIGQILRIIQLLGTTPRLRAVTLRLLTSLWEKQDRVYPELQRFMAVSDVPSLSVGKEVQWEKLIAKAASIRDICKQRPYQHGADMLAAISQVLNECTKPDQATPAALVLQGLHALCQAEVVCIRSTWNALSPKLSCDTRPLILKTLSELFSLVPSLTVNTTEYENFKVQVLSFLWTHTQNKDPIVANAAYRSLANFSAGEHTILHLPEKIRPEIPIPEELDDDEDVEDVDLSVPGSCYLKLLSLTPPLVLPALEEFFTSLVKQEMVNMPRGIYHSALKGGARSDQGKTVAGIPNFILKMYETNKQPGLKPGLAGGMLFCYDVSMYQSKDGKPLNRLMASRGRSFKQTSLALVHEVHIQLSEWHRAIFLPQAWLAYMNRAYHAILQGRLGELELQLKHGKEEPEEVQYKKSTAWLWVRDMLTDEITKAAAKESPVVKGNALLALSSLAVVVSRHEASLSSDSDGLLEVQPNFLSMKEWVSMVLDTLLVIVDSHYQPRGQLLSWFYYKSYSGENTASAIARSAAATALSLLVPVFIISCKEKVEEILNMLTARLPGKPSADESQAVQIHMGLALGMFLSRLCEEKLSDISGQEMNLLLMKSLDALENCCFDTSLEYNTGCILGVGLVLSLMSHSSQMQSRVHVAALLRKLSAHVDDSGSQSRTFQEVLAYTLSCVCTSAFSAGIIEATEAEDVMNKLRLLVENSQQTSGFALALGNIVHGLSVCGHGKAEDLGSKLLPAWIRIVLTEGTPTMLCLAALHGMVALVGSEGDVMQLKSEAIQTSHFQGRLNEVIRTLTQVISVSGVIGLQSNAVWLLGHLHLSTLSSSQSRASVPTDYSYLPESSFIGAAIGFFITGGKKGPESVPPSLLKVVMKPIATVGESYQYPPVNWAALLSPLMRLNFGEEIQQLCLEIMVTQAQSSQNAAALLGLWVTPPLIHSLSLNTKRYLLISAPLWIKHISDEQILGFVENLMVAVFKAASPLGSPELCPSALHGLSQAMKLPSPAHHLWSLLSEATGKIFDLLPNKIRRKDLELYISIAKCLLEMTDDDANRIAQVTKSNIEKAAFVKLYLVSQGRFPLVNLTDMLSVAVQHREKEVLAWMILHSLYQARIVSHANTGVLKRMEWLLELMGYIRNVAYQSTSFHNTALDKALDFFLLIFATAVVAWADHTAPLLLGLSASWLPWHQENGPAGPVPSFLGRSPMHRVTLQEVLTLLPNSMALLLQKEPWKEQTQKFIDWLFSIMESPKEALSAQSRDLLKATLLSLRVLPEFKKKAVWTRAYGW

SEQ ID NO: 5511 - protein, 1801 aa, Homo Sapiens; identical to SEQ ID NO: 5510

SEQ ID NO: 5512 - protein, 181 aa, Homo Sapiens
MLPAATEGQKDMVWKWMPLLLLLVCVATMCSAQDRTDLLNVCMDAKHHKTKPGPEDKLHDQCSPWKKNACCTASTSQELHKDTSRLYNFNWDHCGKMEPACKRHFIQDTCLYECSPNLGPWIQQVNQSWRKERFLDVPLCKEDCQRWWEDCHTSHTCKSNWHRGWDWTSGVNKCPAGALCR

SEQ ID NO: 5513 - protein, 198 aa, Homo Sapiens
MLPAATELRLQGQKDMVWKWMPLLLLLVCVATMCSAQDRTDLLNVCMDAKHHKTKPGPEDKLHDQCSPWKKNACCTASTSQELHKDTSRLYNFNWDHCGKMEPACKRHFIQDTCLYECSPNLGPWIQQVNQSWRKERFLDVPLCKEDCQRWWEDCHTSHTCKSNWHRGWDWTSGVNKCPAGALCRTFESYFPTPAALC

SEQ ID NO: 5514 - protein, 214 aa, Homo Sapiens
MLPAATEVQCSPWKKNACCTASTSQELHKDTSRLYNFNWDHCGKMEPACKRHFIQDTCLYECSPNLGPWIQQVNQSWRKERFLDVPLCKEDCQRWWEDCHTSHTCKSNWHRGWDWTSGVNKCPAGALCRTFESYFPTPAALCEGLWSHSYKVSNYSRGSGRCIQMWFDSAQGNPNEEVARFYAAAMHVNAGEMLHGTGGLLLSLALMLQLWLLG

SEQ ID NO: 5515 - protein, 210 aa, Homo Sapiens
MLPAATEVQGQKDMVWKWMPLLLLLVCVATMCSAQDRTDLLNVCMDAKHHKTKPGPEDKLHDQCSPWKKNACCTASTSQELHKDTSRLYNFNWDHCGKMEPACKRHFIQDTCLYECSPNLGPWIQQVNQSWRKERFLDVPLCKEDCQRWWEDCHTSHTCKSNWHRGWDWTSGVNKCPAGALCRTFESYFPTPAALCEGLWSHSYKVSNYS

SEQ ID NO: 5516 - protein, 148 aa, Homo Sapiens
MLPAATEVQKDHAGSCGEGNLKGKKLEEGRLDTKHRAMLRLQGQKDMVWKWMPLLLLLVCVATMCSAQDRTDLLNVCMDAKHHKTKPGPEDKLHDQCSPWKKNACCTASTSQELHKDTSRLYNFNWDHCGKMEPACKRHFIQDTCLYE

SEQ ID NO: 5517 - protein, 251 aa, Homo Sapiens
MLPAATEVQLRLQGQKDMVWKWMPLLLLLVCVATMCSAQDRTDLLNVCMDAKHHKTKPGPEDKLHDQCSPWKKNACCTASTSQELHKDTSRLYNFNWDHCGKMEPACKRHFIQDTCLYECSPNLGPWIQQVNQSWRKERFLDVPLCKEDCQRWWEDCHTSHTCKSNWHRGWDWTSAALCEGLWSHSYKVSNYSRGSGRCIQMWFDSAQGNPNEEVARFYAAAMHVNAGEMLHGTGGLLLSLALMLQLWLLG

SEQ ID NO: 5518 - protein, 244 aa, Homo Sapiens
MLPAATEVQLRLQGQKDMVWKWMPLLLLLVCVATMCSAQDRTDLLNVCMDAKHHKTKPGPEDKLHDQCSPWKKNACCTASTSQELHKDTSRLYNFNWDHCGKMEPACSATSSRTPVSMSAHQPGALDPAGIRAGAKNASWMCPYAKRTVSAGGRIVTPPTRARATGTEDGTGPQELTSAQLGLSAAPLSPTSPLQLPFVKASGVTHTRSATTAEGAAAASRCGLIQPRATPTRKWRGSMLQPCM

SEQ ID NO: 5519 - protein, 169 aa, Homo Sapiens
MVWKWMPLLLLLVCVATMCSAQDRTDLLNVCMDAKHHKTKPGPEDKLHDQCSPWKKNACCTASTSQELHKDTSRLYNFNWDHCGKMEPACKRHFIQDTCLYECSPNLGPWIQQVNQSWRKERFLDVPLCKEDCQRWWEDCHTSHTCKSNWHRGWDWTSAALCEGLWSHS

SEQ ID NO: 5520 - protein, 171 aa, Homo Sapiens
MVWKWMPLLLLLVCVATMCSAQDRTDLLNVCMDAKHHKTKPGPEDKLHDQCSPWKKNACCTASTSQELHKDTSRLYNFNWDHCGKMEPACKRHFIQDTCLYECSPNLGPWIQQVNQSWRKERFLDVPLCKEDCQRWWEDCHTSHTCKSNWHRGWDWTSGVNKCPAGALCRT

SEQ ID NO: 5521 - protein, 255 aa, Homo Sapiens
MVWKWMPLLLLLVCVATMCSAQDRTDLLNVCMDAKHHKTKPGPEDKLHDQCSPWKKNACCTASTSQELHKDTSRLYNFNWDHCGKMEPACKRHFIQDTCLYECSPNLGPWIQQVNQSWRKERFLDVPLCKEDCQRWWEDCHTSHTCKSNWHRGWDWTSGVNKCPAGALCRTFESYFPTPAALCEGLWSHSYKVSNYSRGSGRCIQMWFDSAQGNPNEEVARFYAAAMHVNAGEMLHGTGGLLLSLALMLQLWLLG

SEQ ID NO: 5522 - protein, 74 aa, Homo Sapiens
MAWQMMQLLLLALVTAAGSAQPRSARARTDLLNVCMNAKHHKTQPSPEDELYGQCSPWKKNACCTASTSQELHK

SEQ ID NO: 5523 - protein, 104 aa, Homo Sapiens
MAWQMMQLLLLALVTAAGSAQPRSARARTDLLNVCMNAKHHKTQPSPEDELYGQCSPWKKNACCTASTSQELHKDTSRLYNFNWDHCGKMEPTCKRHFIQDSCL

SEQ ID NO: 5524 - protein, 178 aa, Homo Sapiens
MDMAWQMMQLLLLALVTAAGSAQPRSARARTDLLNVCMNAKHHKTQPSPEDELYGQCSPWKKNACCTASTSQELHKDTSRLYNFNWDHCGKMEPTCKRHFIQDSCLYECSPNLGPWIRQVNQSWRKERILNVPLCKEDCERWWEDCRTSYTCKSNWHKGWNWTSGINECPAGALCSTF

SEQ ID NO: 5525 - protein, 245 aa, Homo Sapiens
MDMAWQMMQLLLLALVTAAGSAQPRSARARTDLLNVCMNAKHHKTQPSPEDELYGQCSPWKKNACCTASTSQELHKDTSRLYNFNWDHCGKMEPTCKRHFIQDSCLYECSPNLGPWIRQVNQSWRKERILNVPLCKEDCERWWEDCRTSYTCKSNWHKGWNWTSGINECPAGALCSTFESYFPTPAALCEGLWSHSFKVSNYSRGSGRCIQMWFDSAQGNPNEEVAKFYAAAMNAGAPSRGIIDS

SEQ ID NO: 5526 - protein, 172 aa, Homo Sapiens
MDMAWQMMQLLLLALVTAAGSAQPRSARARTDLLNVCMNAKHHKTQPSPEDELYGQVGAPQGPSPGSVPLDDLPGAEEPEYGGDGCGGERLSPVSSPPSAVPGRRMPAARPAPARSCTRTPPACTTLTGITVVRWNPPASATLSRTAVSMSAHPTWGPGSGRSTRAGAKSAF

SEQ ID NO: 5527 - protein, 86 aa, Homo Sapiens
MGLSAAAPLWGPPGLLLAIALHPALSVPPRRDYCVLGAGPAGLQMAYFLQRAGRDYAVFERAPRPGSFFTRYPRHRKLISINKRYT

SEQ ID NO: 5528 - protein, 684 aa, Homo Sapiens
MGLSAAAPLWGPPGLLLAIALHPALSVPPRRDYCVLGAGPAGLQMAYFLQRAGRDYAVFERAPRPGSFFTRYPRHRKLISINKRYTGKANAEFNLRHDWNSLLSHDPRLLFRHYSRAYFPDARDMVRYLGDFADTLGLRVQYNTTIAHVTLDKDRQAWNGHYFILTDQKGQVHQCSVLFVATGLSVPNQVDFPGSEYAEGYESVSVDPEDFVGQNVLILGRGNSAFETAENILGVTNFIHMLSRSRVRLSWATHYVGDLRAINNGLLDTYQLKSLDGLLESDLTDLAILKDSKGKFHVTPKFFLEEANTNQSADSITLPQDDNDNFAMRVPYDRVIRCLGWNFDFSIFNKSLRLNSGNAFGKKYPLIRASYESKGSRGLFILGTASHSVDYRKSAGGFIHGFRYTVRAVHRLLEHRHHSVTWPATELPITQLTSSIVRRVNEASGLYQMFGVLADVILLKENSTAFEYLEEFPIQMLAQLETLTGRKAKHGLFVINMEYGRNFSGPDKDVFFDDRSVGHTEDAWQSNFLHPVIYYYRYLPTEQEVRFRPAHWPLPRPTAIHHIVEDFLTDWTAPIGHILPLRRFLENCLDTDLRSFYAESCFLFALTRQKLPPFCQQGYLRMQGLVSTESLWQHRVESRLLRDYAPTGRRLEDSSQQLGDQEPLGSPLAPGPLAQSVDSNKEEL

SEQ ID NO: 5529 - protein, 684 aa, Homo Sapiens; identical to SEQ ID NO: 5528

SEQ ID NO: 5530 - protein, 684 aa, Homo Sapiens; identical to SEQ ID NO: 5528

SEQ ID NO: 5531 - protein, 157 aa, Homo Sapiens
MLPEQGPQPSTMPLWCLLAACTSLPRQAATMLEEAASPNEAVHASTSGSGALTDQTFTDLSAAEASSEEVPDFMEVPHSVHHKINCFFYLEKQLCQLPSPLCLSSLLTLKLKTTVPAPGRWWSFQPHKAFPLLVGTPGSWQSTIDPAWAAPSQPSPG

SEQ ID NO: 5532 - protein, 57 aa, Homo Sapiens
MAAVRALVASRLAAASAFTSLSPGGRTPSQRAALHLSVPRPAARVALDPGAPEPWRG

SEQ ID NO: 5533 - protein, 237 aa, Homo Sapiens
MAAVRALVASRLAAASAFTSLSPGGRTPSQRAALHLSVPRPAARVALVLSGCGVYDGTEIHEASAILVHLSRGGAEVQIFAPDVPQMHVIDHTKGQPSEGESRNVLTESARIARGKITDLANLSAANHDAAIFPGGFGAAKNLLCCIAPVLAAKVLRGVEVTVGHEQEEGGKWPYAGTAEAIKALGAKHCVKEVVEAHVDQKNKVVTTPAFMCETALHYIHDGIGAMVRKVLELTGK

SEQ ID NO: 5534 - protein, 268 aa, Homo Sapiens
MAAVRALVASRLAAASAFTSLSPGGRTPSQRAALHLSVPRPAARVALVLSGCGVYDGTEIHEASAILVHLSRGGAEVQIFAPDVPQMHVIDHTKGQPSEGESRNVLTESARIARGKITDLANLSAANHDAAIFPGGFGAAKNLSTFAVDGKDCKVNKEVERVLKEFHQAGKPIGLCCIAPVLAAKVLRGVEVTVGHEQEEGGKWPYAGTAEAIKALGAKHCVKEVVEAHVDQKNKVVTTPAFMCETALHYIHDGIGAMVRKVLELTGK

SEQ ID NO: 5535 - protein, 182 aa, Homo Sapiens
MHVIDHTKGQPSEGESRNVLTESARIARGKITDLANLSAANHDAAIFPGGFGAAKNLSTFAVDGKDCKVNKEVERVLKEFHQAGKPIGLCCIAPVLAAKVLRGVEVTVGHEQEEGGKWPYAGTAEAIKALGAKHCVKEVVEAHVDQKNKVVTTPAFMCETALHYIHDGIGAMVRKVLELTGK

SEQ ID NO: 5536 - protein, 224 aa, Homo Sapiens; identical to SEQ ID NO: 1864

SEQ ID NO: 5537 - protein, 106 aa, Homo Sapiens
  misc_feature (1)..(1): Xaa can be any naturally occurring amino acid
XDGTEIHEASAILVHLSRGGAEVQIFAPDVPQMHVIDHTKGQPSEGESRNVLTESARIARGKITDLANLSAANHDAAIFPGGFGAAKNLGSPYSDPAKHRSLGLQL

SEQ ID NO: 5538 - protein, 137 aa, Homo Sapiens
  misc_feature (1)..(1): Xaa can be any naturally occurring amino acid
XDGTEIHEASAILVHLSRGGAEVQIFAPDVPQMHVIDHTKGQPSEGESRNVLTESARIARGKITDLANLSAANHDAAIFPGGFGAAKNLSTFAVDGKDCKVNKEVERVLKEFHQAGKPIGGSPYSDPAKHRSLGLQL

SEQ ID NO: 5539 - protein, 537 aa, Homo Sapiens
MLNTLQTNAGYLEQVKRQRGDPQTQLEAMELYLARSGLQVEDLDRLNIIHVTGTKGKGSTCAFTECILRSYGLKTGFFSSPHLVQVRERIRINGQPISPELFTKYFWRLYHRLEETKDGSCVSMPPYFRFLTLMAFHVFLQEKVDLAVVEVGIGGAYDCTNIIRKPVVCGVSSLGIDHTSLLGDTVEKIAWQKGGIFKQGVPAFTVLQPEGPLAVLRDRAQQISCPLYLCPMLEALEEGGPPLTLGLEGEHQRSNAALALQLAHCWLQRQDRHGAGEPKASRPGLLWQLPLAPVFQPTSHMRLGLRNTEWPGRTQVLRRGPLTWYLDGAHTASSAQACVRWFRQALQGRERPSGGPEVRVLLFNATGDRDPAALLKLLQPCQFDYAVFCPNLTEVSSTGNADQQNFTVTLDQVLLRCLEHQQHWNHLDEEQASPDLWSAPSPEPGGSASLLLAPHPPHTCSASSLVFSCISHALQWISQGRDPIFQPPSPPKGLLTHPVAHSGASILREAAAIHVLVTGSLHLVGGVLKLLEPALSQ

SEQ ID NO: 5540 - protein, 265 aa, Homo Sapiens
MLNTLQTNAGYLEQVKRQRGDPQTQLEAMELYLARSGLQVEDLDRLNIIHVTGTKGKGSTCAFTECILRSYGLKTGFFSSPHLVQVRERIRINGQPISPELFTKYFWRLYHRLEETKDGSCVSMPPYFRFLTLMAFHVFLQEKVDLAVVEVGIGGAYDCTNIIRKPVVCGVSSLGIDHTSLLGDTVEKIAWQKGGIFKQGVPAFTVLQPEGPLAVLRDRAQQISVLGSQRHPGQGSCGSCPWHLCSSPHPTCGSGFGTRSGRAGR

SEQ ID NO: 5541 - protein, 194 aa, Homo Sapiens
MLNTLQTNAGYLEQVKRQRGDPQTQLEAMELYLARSGLQVEDLDRLNIIHVTGTKGKGSTCAFTECILRSYGLKTGFFSSPHLVQVRERIRINGQPISPELFTKYFWRLYHRLEETKVDLAVVEVGIGGAYDCTNIIRKPVVCGVSSLGIDHTSLLGDTVEKIAWQKGGIFKQGVPAFTVLQPEGPLAVLRDRA

SEQ ID NO: 5542 - protein, 375 aa, Homo Sapiens
MSRARSHLRAALFLAAASARGITTQVAARRGLSAWPVPQEPSMEYQDAVRMLNTLQTNAGYLEQVKRQRGDPQTQLEAMELYLARSGLQVEDLDRLNIIHVTGTKGKGSTCAFTECILRSYGLKTGFFSSPHLVQVRERIRINGQPISPELFTKYFWRLYHRLEETKDGSCVSMPPYFRFLTLMAFHVFLQEKVDLAVVEVGIGGAYDCTNIIRKPVVCGVSSLGIDHTSLLGDTVEKIAWQKGGIFKQGVPAFTVLQPEGPLAVLRDRAQQISVLGSQRHPGQGSCGSCPWHLCSSPHPTCGSGFGTRSGRAGRRCCGAGPSPGTWTVRTPPAARRPACAGSARRCRAARGRAVAPRFESCSSMLPGTGTRRPC

SEQ ID NO: 5543 - protein, 587 aa, Homo Sapiens
MSRARSHLRAALFLAAASARGITTQVAARRGLSAWPVPQEPSMEYQDAVRMLNTLQTNAGYLEQVKRQRGDPQTQLEAMELYLARSGLQVEDLDRLNIIHVTGTKGKGSTCAFTECILRSYGLKTGFFSSPHLVQVRERIRINGQPISPELFTKYFWRLYHRLEETKDGSCVSMPPYFRFLTLMAFHVFLQEKVDLAVVEVGIGGAYDCTNIIRKPVVCGVSSLGIDHTSLLGDTVEKIAWQKGGIFKQGVPAFTVLQPEGPLAVLRDRAQQISCPLYLCPMLEALEEGGPPLTLGLEGEHQRSNAALALQLAHCWLQRQDRHGAGEPKASRPGLLWQLPLAPVFQPTSHMRLGLRNTEWPGRTQVLRRGPLTWYLDGAHTASSAQACVRWFRQALQGRERPSGGPEVRVLLFNATGDRDPAALLKLLQPCQFDYAVFCPNLTEVSSTGNADQQNFTVTLDQVLLRCLEHQQHWNHLDEEQASPDLWSAPSPEPGGSASLLLAPHPPHTCSASSLVFSCISHALQWISQGRDPIFQPPSPPKGLLTHPVAHSGASILREAAAIHVLVTGSLHLVGGVLKLLEPALSQ

SEQ ID NO: 5544 - protein, 375 aa, Homo Sapiens; identical to SEQ ID NO: 5542

SEQ ID NO: 5545 - protein, 561 aa, Homo Sapiens
MSRARSHLRAALFLAAASARGITTQVAARRGLSAWPVPQEPSMEYQDAVRMLNTLQTNAGYLEQVKRQRGDPQTQLEAMELYLARSGLQVEDLDRLNIIHVTGTKGKGSTCAFTECILRSYGLKTGFFSSPHLVQVRERIRINGQPISPELFTKYFWRLYHRLEETKVDLAVVEVGIGGAYDCTNIIRKPVVCGVSSLGIDHTSLLGDTVEKIAWQKGGIFKQGVPAFTVLQPEGPLAVLRDRAQQISCPLYLCPMLEALEEGGPPLTLGLEGEHQRSNAALALQLAHCWLQRQDRHGAGEPKASRPGLLWQLPLAPVFQPTSHMRLGLRNTEWPGRTQVLRRGPLTWYLDGAHTASSAQACVRWFRQALQGRERPSGGPEVRVLLFNATGDRDPAALLKLLQPCQFDYAVFCPNLTEVSSTGNADQQNFTVTLDQVLLRCLEHQQHWNHLDEEQASPDLWSAPSPEPGGSASLLLAPHPPHTCSASSLVFSCISHALQWISQGRDPIFQPPSPPKGLLTHPVAHSGASILREAAAIHVLVTGSLHLVGGVLKLLEPALSQ

SEQ ID NO: 5546 - protein, 1976 aa, Homo Sapiens
MGVLKVWLGLALALAEFAVLPHHSEGACVYQDSLLADATIWKPDSCQSCRCHGDIVICKPAVCRNPQCAFEKGEVLQIAANQCCPECVLRTPGSCHHEKKIHEHGTEWASSPCSVCSCNHGEVRCTPQPCPPLSCGHQELAFIPEGSCCPVCVGLGKPCSYEGHVFQDGEDWRLSRCAKCLCRNGVAQCFTAQCQPLFCNQDETVVRVPGKCCPQCSARSCSAAGQVYEHGEQWSENACTTCICDRGEVRCHKQACLPLRCGKGQSRARRHGQCCEECVSPAGSCSYDGVVRYQDEMWKGSACEFCMCDHGQVTCQTGECAKVECARDEELIHLDGKCCPECISRNGYCVYEETGEFMSSNASEVKRIPEGEKWEDGPCKVCECRGAQVTCYEPSCPPCPVGTLALEVKGQCCPDCTSVHCHPDCLTCSQSPDHCDLCQDPTKLLQNGWCVHSCGLGFYQAGSLCLACQPQCSTCTSGLECSSCQPPLLMRHGQCVPTCGDGFYQDRHSCAVCHESCAGCWGPTEKHCLACRDPLHVLRDGGCESSCGKGFYNRQGTCSACDQSCDSCGPSSPRCLTCTEKTVLHDGKCMSECPGGYYADATGRCKVCHNSCASCSGPTPSHCTACSPPKALRQGHCLPRCGEGFYSDHGVCKACHSSCLACMGPAPSHCTGCKKPEEGLQVEQLSDVGIPSGECLAQCRAHFYLESTGICEACHQSCFRCAGKSPHNCTDCGPSHVLLDGQCLSQCPDGYFHQEGSCTECHPTCRQCHGPLESDCISCYPHISLTNGNCRTSCREEQFLNLVGYCADCHHLCQHCAADLHNTGSICLRCQNAHYLLLGDHCVPDCPSGYYAERGACKKCHSSCRTCQGRGPFSCSSCDTNLVLSHTGTCSTTCFPGHYLDDNHVCQPCNTHCGSCDSQASCTSCRDPNKVLLFGECQYESCAPQYYLDFSTNTCKECDWSCSACSGPLKTDCLQCMDGYVLQDGACVEQCLSSFYQDSGLCKNCDSYCLQCQGPHECTRCKGPFLLLEAQCVQECGKGYFADHAKHKCTACPQGCLQCSHRDRCHLCDHGFFLKSGLCVYNCVPGFSVHTSNETCSGKIHTPSLHVNGSLILPIGSIKPLDFSLLNVQDQEGRVEDLLFHVVSTPTNGQLVLSRNGKEVQLDKAGRFSWKDVNEKKVRFVHSKEKLRKGYLFLKISDQQFFSEPQLINIQAFSTQAPYVLRNEVLHISRGERATITTQMLDIRDDDNPQDVVIEIIDPPLHGQLLQTLQSPATPIYQFQLDELSRGLLHYAHDGSDSTSDVAVLQANDGHSFHNILFQVKTVPQNDRGLQLVANSMVWVPEGGMLQITNRILQAEAPGASAEEIIYKITQDYPQFGEVVLLVNMPADSPADEGQHLPDGRTATPTSTFTQQDINEGIVWYRHSGAPAQSDSFRFEVSSASNAQTRLESHMFNIAILPQTPEAPKVSLEASLHMTAREDGLTVIQPHSLSFINSEKPSGKIVYNITLPLHPNQGIIEHRDHPHSPIRYFTQEDINQGKVMYRPPPAAPHLQELMAFSFAGLPESVKFHFTVSDGEHTSPEMVLTIHLLPSDQQLPVFQVTAPRLAVSPGGSTSVGLQVVVRDAETAPKELFFELRRPPQHGVLLKHTAEFRRPMATGDTFTYEDVEKNALQYIHDGSSTREDSMEISVTDGLTVTMLEVRVEVSLSEDRGPRLAAGSSLSITVASKSTAIITRSHLAYVDDSSPDPEIWIQLNYLPSYGTLLRISGSEVEELSEVSNFTMEDINNKKIRYSAVFETDGHLVTDSFYFSVSDMDHNHLDNQIFTIMITPAENPPPVIAFADLITVDEGGRAPLSFHHFFATDDDDNLQRDAIIKLSALPKYGCIENTGTGDRFGPETASDLEASFPIQDVLENYIYYFQSVHESIEPTHDIFSFYVSDGTSRSEIHSINITIEVKTLEVGKVEPLTTIFHTIRELSL

SEQ ID NO: 5547 - protein, 4012 aa, Homo Sapiens
MGVLKVWLGLALALAEFAVLPHHSEGACVYQDSLLADATIWKPDSCQSCRCHGDIVICKPAVCRNPQCAFEKGEVLQIAANQCCPECVLRTPGSCHHEKKIHEHGTEWASSPCSVCSCNHGEVRCTPQPCPPLSCGHQELAFIPEGSCCPVCVGLGKPCSYEGHVFQDGEDWRLSRCAKCLCRNGVAQCFTAQCQPLFCNQDETVVRVPGKCCPQCSARSCSAAGQVYEHGEQWSENACTTCICDRGEVRCHKQACLPLRCGKGQSRARRHGQCCEECVSPAGSCSYDGVVRYQDEMWKGSACEFCMCDHGQVTCQTGECAKVECARDEELIHLDGKCCPECISRNGYCVYEETGEFMSSNASEVKRIPEGEKWEDGPCKVCECRGAQVTCYEPSCPPCPVGTLALEVKGQCCPDCTSVHCHPDCLTCSQSPDHCDLCQDPTKLLQNGWCVHSCGLGFYQAGSLCLACQPQCSTCTSGLECSSCQPPLLMRHGQCVPTCGDGFYQDRHSCAVCHESCAGCWGPTEKHCLACRDPLHVLRDGGCESSCGKGFYNRQGTCSACDQSCDSCGPSSPRCLTCTEKTVLHDGKCMSECPGGYYADATGRCKVCHNSCASCSGPTPSHCTACSPPKALRQGHCLPRCGEGFYSDHGVCKACHSSCLACMGPAPSHCTGCKKPEEGLQVEQLSDVGIPSGECLAQCRAHFYLESTGICEACHQSCFRCAGKSPHNCTDCGPSHVLLDGQCLSQCPDGYFHQEGSCTECHPTCRQCHGPLESDCISCYPHISLTNGNCRTSCREEQFLNLVGYCADCHHLCQHCAADLHNTGSICLRCQNAHYLLLGDHCVPDCPSGYYAERGACKKCHSSCRTCQGRGPFSCSSCDTNLVLSHTGTCSTTCFPGHYLDDNHVCQPCNTHCGSCDSQASCTSCRDPNKVLLFGECQYESCAPQYYLDFSTNTCKECDWSCSACSGPLKTDCLQCMDGYVLQDGACVEQCLSSFYQDSGLCKNCDSYCLQCQGPHECTRCKGPFLLLEAQCVQECGKGYFADHAKHKCTACPQGCLQCSHRDRCHLCDHGFFLKSGLCVYNCVPGFSVHTSNETCSGKIHTPSLHVNGSLILPIGSIKPLDFSLLNVQDQEGRVEDLLFHVVSTPTNGQLVLSRNGKEVQLDKAGRFSWKDVNEKKVRFVHSKEKLRKGYLFLKISDQQFFSEPQLINIQAFSTQAPYVLRNEVLHISRGERATITTQMLDIRDDDNPQDVVIEIIDPPLHGQLLQTLQSPATPIYQFQLDELSRGLLHYAHDGSDSTSDVAVLQANDGHSFHNILFQVKTVPQNDRGLQLVANSMVWVPEGGMLQITNRILQAEAPGASAEEIIYKITQDYPQFGEVVLLVNMPADSPADEGQHLPDGRTATPTSTFTQQDINEGIVWYRHSGAPAQSDSFRFEVSSASNAQTRLESHMFNIAILPQTPEAPKVSLEASLHMTAREDGLTVIQPHSLSFINSEKPSGKIVYNITLPLHPNQGIIEHRDHPHSPIRYFTQEDINQGKVMYRPPPAAPHLQELMAFSFAGLPESVKFHFTVSDGEHTSPEMVLTIHLLPSDQQLPVFQVTAPRLAVSPGGSTSVGLQVVVRDAETAPKELFFELRRPPQHGVLLKHTAEFRRPMATGDTFTYEDVEKNALQYIHDGSSTREDSMEISVTDGLTVTMLEVRVEVSLSEDRGPRLAAGSSLSITVASKSTAIITRSHLAYVDDSSPDPEIWIQLNYLPSYGTLLRISGSEVEELSEVSNFTMEDINNKKIRYSAVFETDGHLVTDSFYFSVSDMDHNHLDNQIFTIMITPAENPPPVIAFADLITVDEGGRAPLSFHHFFATDDDDNLQRDAIIKLSALPKYGCIENTGTGDRFGPETASDLEASFPIQDVLENYIYYFQSVHESIEPTHDIFSFYVSDGTSRSEIHSINITIERKNDEPPRMTLQPLRVQLSSGVVISNSSLSLQDLDTPDNELIFVLTKKPDHGHVLWRQTASEPLENGRVLVQGSTFTYQDILAGLVGYVPSVPGMVVDEFQFSLTDGLHVDTGRMKIYTELPASDTPHLAINQGLQLSAGSVARITEQHLKVTDIDSDDHQVMYIMKEDPGAGRLQMMKHGNLEQISIKGPIRSFTQADISQGHVEYSHGTGEPGGSFAFKFDVVDGEGNRLIDKSFSISILEDKSPPVITTNKGLVLDENSVKKITTLQLSATDQDSGPTELIYRITRQPQLGHLEHAASPGIQISSFTQADLTSRNVQYVHSSEAEKHSDAFSFTLSDGVSEVTQTFHITLHPVDDSLPVVQNLGMRVQEGMRKTITEFELKAVDADTEAESVTFTIVQPPRHGTIERTSNGQHFHLTSTFTMKDIYQNRVSYSHDGSNSLKDRFTFTVSDGTNPFFIIEEGGKEIMTAAPQPFRVDILPVDDGTPRIVTNLGLQWLEYMDGKATNLITKKELLTMDPDTEDAQLVYEITTGPKHGFVENKLQPGRAAATFTQEDVNLGLIRYVLHKEKIREMMDSFQFLVKDSKPNVVSDNVFHIQWSLISFKYTSYNVSEKAGSVSVTVQRTGNLNQYAIVLCRTEQGTASSSSRVSSQPGQQDYVEYAGQVQFDEREDTKSCTIVINDDDVFENVESFTVELSMPAYALLGEFTQAKVIINDTEDEPTLEFDKKIYWVNESAGFLFAPIERKGDASSIVSAICYTVPKSAMGSSLYALESGSDFKSRGMSAASRVIFGPGVTMSTCDVMLIDDSEYEEEEEFEIALADASDNARIGRVATAKVLISGPNDASTVSLGNTAFTVSEDAGTVKIPVIRHGTDLSTFASVWCATRPSDPASATPGVDYVPSSRKVEFGPGVIEQYCTLTILDDTQYPVIEGLETFVVFLSSAQGAELTKPFQAVIAINDTFQDVPSMQFAKDLLLVKEKEGVLHVPITRSGDLSYESSVRCYTQSHSAQVMEDFEERQNADSSRITFLKGDKVKNCTVYIHDDSMFEPEEQFRVYLGLPLGNHWSGARIGKNNMATITISNDEDAPTIEFEEAAYQVREPAGPDAIAILNIKVIRRGDQNRTSKVRCSTRDGSAQSGVDYYPKSRVLKFSPGVDHIFFKVEILSNEDREWHESFSLVLGPDDPVEAVLGDVTTATVTILDQEAAGSLILPAPPIVVTLADYDHVEEVTKEGVKKSPSPGYPLVCVTPCDPHFPRYAVMKERCSEAGINQTSVQFSWEVAAPTDGNGARSPFETITDNTPFTSVNHMVLDSIYFSRRFHVRCVAKAVDKVGHVGTPLRSNIVTIGTDSAICHTPVVAGTSRGFQAQSFIATLKYLDVKHKEHPNRIHISVQIPHQDGMLPLISTMPLHNLHFLLSESIYRHQHVCSNLVTTYDLRGISEAGFLDDVVYDSTALGPGYDRPFQFDPSVREPKTIQLYKHLNLKSCVWTFDAYYDMTELIDVCGGSVTADFQVRDSAQSFLTVHVPLYVSYIYVTAPRGWASLEHHTEMEFSFFYDTVLWRTGIQTDSVLSARLQIIRIYIREDGRLVIEFKTHAKFRGQFVMEHHTLPEVKSFVLTPDHLGGIEFDLQLLWSAQTFDSPHQLWRATSSYNRKDYSGEYTIYLIPCTVQPTQPWVDPGEKPLACTAHAPERFLIPIAFQQTNRPVPVVYSLNTEFQLCNNEKVFLMDPNTSDMSLAEMDYKGAFSKGQILYGRVLWNPEQNLNSAYKLQLEKVYLCTGKDGYVPFFDPTGTIYNEGPQYGCIQPNKHLKHRFLLLDRNQPEVTDKYFHDVPFEAHFASELPDFHVVSNMPGVDGFTLKVDALYKVEAGHQWYLQVIYIIGPDTISGPRVQRSLTAPLRRNRRDLVEPDGQLILDDSLIYDNEGDQVKNGTNMKSLNLEMQELAVAASLSQTGASIGSALAAIMLLLLVFLVACFINRKCQKQRKKKPAEDILEEYPLNTKVEVPKRHPDRVEKNVNRHYCTVRNVNILSEPEAAYTFKGAKVKRLNLEVRVHNNLQDGTEV

SEQ ID NO: 5548 - protein, 39 aa, Homo Sapiens
MGVLKVWLGLALALAEFAVLPHHSEGACVYQDSLLAEGG

SEQ ID NO: 5549 - protein, 652 aa, Homo Sapiens
  misc_feature (1)..(1): Xaa can be any naturally occurring amino acid
XCSYEGHVFQDGEDWRLSRCAKCLCRNGVAQCFTAQCQPLFCNQDETVVRVPGKCCPQCSARSCSAAGQVYEHGEQWSENACTTCICDRGEVRCHKQACLPLRCGKGQSRARRHGQCCEECVSPAGSCSYDGVVRYQDEMWKGSACEFCMCDHGQVTCQTGECAKVECARDEELIHLDGKCCPECISRNGYCVYEETGEFMSSNASEVKRIPEGEKWEDGPCKVCECRGAQVTCYEPSCPPCPVGTLALEVKGQCCPDCTSVHCHPDCLTCSQSPDHCDLCQDPTKLLQNGWCVHSCGLGFYQAGSLCLACQPQCSTCTSGLECSSCQPPLLMRHGQCVPTCGDGFYQDRHSCAVCHESCAGCWGPTEKHCLACRDPLHVLRDGGCESSCGKGFYNRQGTCSACDQSCDSCGPSSPRCLTCTEKTVLHDGKCMSECPGGYYADATGRCKVCHNSCASCSGPTPSHCTACSPPKALRQGHCLPRCGEGFYSDHGVCKACHSSCLACMGPAPSHCTGCKKPEEGLQVEQLSDVGIPSGECLAQCRAHFYLESTGICEACHQSCFRCAGKSPHNCTDCGPSHVLLDGQCLSQCPDGYFHQEGSCTECHPTCRQCHGPLESDCISCYPHISLTNGNCRTSCREEQFLNLVGYCAGE

SEQ ID NO: 5550 - protein, 666 aa, Homo Sapiens
  misc_feature (1)..(1): Xaa can be any naturally occurring amino acid
XGEVLQIAANQCCPECVLRTPGSCHHEKKIHEHGTEWASSPCSVCSCNHGEVRCTPQPCPPLSCGHQELAFIPEGSCCPVCVGLGKPCSYEGHVFQDGEDWRLSRCAKCLCRNGVAQCFTAQCQPLFCNQDETVVRVPGKCCPQCSARSCSAAGQVYEHGEQWSENACTTCICDRGEVRCHKQACLPLRCGKGQSRARRHGQCCEECVSPAGSCSYDGVVRYQDEMWKGSACEFCMCDHGQVTCQTGECAKVECARDEELIHLDGKCCPECISRNGYCVYEETGEFMSSNASEVKRIPEGEKWEDGPCKVCECRGAQVTCYEPSCPPCPVGTLALEVKGQCCPDCTSVHCHPDCLTCSQSPDHCDLCQDPTKLLQNGWCVHSCGLGFYQAGSLCLACQPQCSTCTSGLECSSCQPPLLMRHGQCVPTCGDGFYQDRHSCAVCHESCAGCWGPTEKHCLACRDPLHVLRDGGCESSCGKGFYNRQGTCSACDQSCDSCGPSSPRCLTCTEKTVLHDGKCMSECPGGYYADATGRCKVCHNSCASCSGPTPSHCTACSPPKALRQGHCLPRCGEGFYSDHGVCKACHSSCLACMGPAPSHCTGCKKPEEGLQVEQLSDVGIPSGECLAQCRAHFYLESTGICEGQNLDFCQNLEVISAVCLGISSTEN

SEQ ID NO: 5551 - protein, 426 aa, Homo Sapiens
  misc_feature (1)..(1): Xaa can be any naturally occurring amino acid
XTLPLHPNQGLPESVKFHFTVSDGEHTSPEMVLTIHLLPSDQQLPVFQVTAPRLAVSPGGSTSVGLQVVVRDAETAPKELFFELRRPPQHGVLLKHTAEFRRPMATGDTFTYEDVEKNALQYIHDGSSTREDSMEISVTDGLTVTMLEVRVEVSLSEDRGPRLAAGSSLSITVASKSTAIITRSHLAYVDDSSPDPEIWIQLNYLPSYGTLLRISGSEVEELSEVSNFTMEDINNKKIRYSAVFETDGHLVTDSFYFSVSDMDHNHLDNQIFTIMITPAENPPPVIAFADLITVDEGGRAPLSFHHFFATDDDDNLQRDAIIKLSALPKYGCIENTGTGDRFGPETASDLEASFPIQDVLENYIYYFQSVHESIEPTHDIFSFYVSDGTSRSEIHSINITIEVKTLEVGKVEPLTTIFHTIRELSL

SEQ ID NO: 5552 - protein, 222 aa, Homo Sapiens
MLDESLAVRRSKKCKEMIMHWEKKEDIDIVNTVDQLDKTAPRITLLHSPSQVGLLKNGCYGIYITSRVLKASDPDTEDDQIIFKILQGPKHGHLENTTTGEFIHEKFSQKDLNSKTILYIINPSLEVNSDTVEFQIMDPTGNSATPQILELKWSHIEWSQTEYEVCENVGLLPLEIIRRGYSMDSAFVGIKVNQVSAAVGKDFTVIPSKLIQFDPGSSILCL

SEQ ID NO: 5553 - protein, 2179 aa, Homo Sapiens
MNSLSWGAANAVLLLLLLAWASPTFISINRGVRVMKGHSAFLSGDDLKFAIPKEKDACKVEVVMNEPITQRVGKLTPQVFDCHFLPNEVKYVHNGCPILDEDTVKLRLYRFTERDTFIETFILWVYLLEPDCNIIHMSNNVLEVPEFNGLSQAIDKNLLRFDYDRMASLECTVSLDTARTRLPAHGQMVLGEPRPEEPRGDQPHSFFPESQLRAKLKCPGGSCTPGLKKIGSLKVSCEEFLLMGLRYQHLDPPSPNIDYISIQLDLTDTRSKIVYKSESAWLPVYIRAGIPNQIPKAAFMAVFILEVDQFILTSLTTSVLDCEEDETPKPLLVFNITKAPLQGYVTHLLDHTRPISSFTWKDLSDMQIAYQPPNSSHSERRHDEVELEVYDFFFERSAPMTVHISIRTADTNAPRVSWNTGLSLLEGQSRAITWEQFQVVDNDDIGAVRLVTVGGLQHGWLTLRGGKGFLFTVADLQAGVVRYHHDDSDSTKDFVVFRIFDGHHSIRHKFPINVLPKDDSPPFLITNVVIELEEGQTILIQGSMLRASDVDASDDYIFFNITKPPQAGEIMKKPGPGLIGYPVHGFLQRDLFNGIIYYRHFGGEIFEDSFQFVLWDSHEPPNLSVPQVATIHITPVDDQLPKEAPGVSRHLVVKETEVAYITKKQLHFIDSESYDRELVYTITTPPFFSFSHRHLDAGKLFMVDSIPKVVKNPTALELRSFTQHAVNYMKVAYMPPMQDIGPHCRDVQFTFSVSNQHGGTLHGICFNITILPVDNQVPEAFTNPLKVTEGGQSIISTEHILISDADTKLDNIDLSLRELPLHGRVELNGFPLNSGGTFSWGDLHTLKVRYQHDGTEVLQDDLLLEVTDGTNSAEFVLHVEVFPVNDEPPVLKADLMPVMNCSEGGEVVITSEYIFATDVDSDNLKLMFVIAREPQHGVVRRAGVTVDQFSQRDVISEAVTYKHTGGEIGLMPCFDTITLVVSDGEAGPFVNGCCYNGPNPSVPLHASFPVYDLNITVYPVDNQPPSIAIGPVFVVDEGCSTALTVNHLSATDPDTAADDLEFVLVSPPQFGYLENILPSVGFEKSNIGISIDSFQWKDMNAFHINYVQSRHLRIEPTADQFTVYVTDGKHHSLEIPFSIIINPTNDEAPDFVVQNITVCEGQMKELDSSIISAVDLDIPQDALLFSITQKPRHGLLIDRGFSKDFSENKQPANPHQKHAPVHSFSMELLKTGMRLTYMHDDSESLADDFTIQLSDGKHKILKTISVEVIPVNDEKPMLSKKAEIAMNMGETRIISSAILSAIDEDSPREKIYYVFERLPQNGQLQLKIGRDWVPLSPGMKCTQEEVDLNLLRYTHTGAMDSQNQDSFTFYLWDGNNRSPALDCQITIKDMEKGDIVILTKPLVVSKGDRGFLTTTTLLAVDGTDKPEELLYVITSPPRYGQIEYVHYPGVPITNFSQMDVVGQTVCYVHKSKVTVSSDRFRFIISNGLRTEHGVFEITLETVDRALPVVTRNKGLRLAQGAVGLLSPDLLQLTDPDTPAENLTFLLVQLPQHGQLYLWGTGLLQHNFTQQDVDSKNVAYRHSGGDSQTDCFTFMATDGTNQGFIVNGRVWEEPVLFTIQVDQLDKTAPRITLLHSPSQVGLLKNGCYGIYITSRVLKASDPDTEDDQIIFKILQGPKHGHLENTTTGEFIHEKFSQKDLNSKTILYIINPSLEVNSDTVEFQIMDPTGNSATPQILELKWSHIEWSQTEYEVCENVGLLPLEIIRRGYSMDSAFVGIKVNQVSAAVGKDFTVIPSKLIQFDPGMSTKMWNIAITYDGLEEDDEVFEVILNSPVNAVLGTKTKAAVKILDSKGGQCHPSYSSNQSKHSTWEKGIWHLLPPGSSSSTTSGSFHLERRPLPSSMQLAVIRGDTLRGFDSTDLSQRKLRTRGNGKTVRPSSVYRNGTDIIYNYHGIVSLKLEDDSFPTHKRKAKVSIISQPQKTIKVAELPQADKVESTTDSHFPRQDQLPSFPKNCTLELKGLFHFEEGIQKLYQCNGIAWKAWSPQTKDVEDKSCPAGWHQHSGYCHILITEQKGTWNAAAQACREQYLGNLVTVFSRQHMRWLWDIGGRKSFWIGLNDQVHAGHWEWIGGEPVAFTNGRRGPSQRSKLGKSCVLVQRQGKWQTKDCRRAKPHNYVCSRKL

SEQ ID NO: 5554 - protein, 2179 aa, Homo Sapiens; identical to SEQ ID NO: 5553

SEQ ID NO: 5555 - protein, 1335 aa, Homo Sapiens
MNSLSWGAANAVLLLLLLAWASPTFISINRGVRVMKGHSAFLSGDDLKFAIPKEKDACKVEVVMNEPITQRVGKLTPQVFDCHFLPNEVKYVHNGCPILDEDTVKLRLYRFTERDTFIETFILWVYLLEPDCNIIHMSNNVLEVPEFNGLSQAIDKNLLRFDYDRMASLECTVSLDTARTRLPAHGQMVLGEPRPEEPRGDQPHSFFPESQLRAKLKCPGGSCTPGLKKIGSLKVSCEEFLLMGLRYQHLDPPSPNIDYISIQLDLTDTRSKIVYKSESAWLPVYIRAGIPNQIPKAAFMAVFILEVDQFILTSLTTSVLDCEEDETPKPLLVFNITKAPLQGYVTHLLDHTRPISSFTWKDLSDMQIAYQPPNSSHSERRHDEVELEVYDFFFERSAPMTVHISIRTADTNAPRVSWNTGLSLLEGQSRAITWEQFQVVDNDDIGAVRLVTVGGLQHGWLTLRGGKGFLFTVADLQAGVVRYHHDDSDSTKDFVVFRIFDGHHSIRHKFPINVLPKDDSPPFLITNVVIELEEGQTILIQGSMLRASDVDASDDYIFFNITKPPQAGEIMKKPGPGLIGYPVHGFLQRDLFNGIIYYRHFGGEIFEDSFQFVLWDSHEPPNLSVPQVATIHITPVDDQLPKEAPGVSRHLVVKETEVAYITKKQLHFIDSESYDRELVYTITTPPFFSFSHRHLDAGKLFMVDSIPKVVKNPTALELRSFTQHAVNYMKVAYMPPMQDIGPHCRDVQFTFSVSNQHGGTLHGICFNITILPVDNQVPEAFTNPLKVTEGGQSIISTEHILISDADTKLDNIDLSLRELPLHGRVELNGFPLNSGGTFSWGDLHTLKVRYQHDGTEVLQDDLLLEVTDGTNSAEFVLHVEVFPVNDEPPVLKADLMPVMNCSEGGEVVITSEYIFATDVDSDNLKLMFVIAREPQHGVVRRAGVTVDQFSQRDVISEAVTYKHTGGEIGLMPCFDTITLVVSDGEAGPFVNGCCYNGPNPSVPLHASFPVYDLNITVYPVDNQPPSIAIGPVFVVDEGCSTALTVNHLSATDPDTAADDLEFVLVSPPQFGYLENILPSVGFEKSNIGISIDSFQWKDMNAFHINYVQSRHLRIEPTADQFTVYVTDGKHHSLEIPFSIIINPTNDEAPDFVVQNITVCEGQMKELDSSIISAVDLDIPQDALLFSITQKPRHGLLIDRGFSKDFSENKQPANPHQKHAPVHSFSMELLKTGMRLTYMHDDSESLADDFTIQLSDGKHKILKTISVEVIPVNDEKPMLSKKAEIAMNMGETRIISSAILSAIDEDSPREKIYYVFERLPQNGQLQLKECQLRCGI

SEQ ID NO: 5556 - protein, 715 aa, Homo Sapiens
MVTQESMLKAALPLFTRFIISNGLRTEHGVFEITLETVDRALPVVTRNKGLRLAQGAVGLLSPDLLQLTDPDTPAENLTFLLVQLPQHGQLYLWGTGLLQHNFTQQDVDSKNVAYRHSGGDSQTDCFTFMATDGTNQGFIVNGRVWEEPVLFTIQVDQLDKTAPRITLLHSPSQVGLLKNGCYGIYITSRVLKASDPDTEDDQIIFKILQGPKHGHLENTTTGEFIHEKFSQKDLNSKTILYIINPSLEVNSDTVEFQIMDPTGNSATPQILELKWSHIEWSQTEYEVCENVGLLPLEIIRRGYSMDSAFVGIKVNQVSAAVGKDFTVIPSKLIQFDPGMSTKMWNIAITYDGLEEDDEVFEVILNSPVNAVLGTKTKAAVKILDSKGGQCHPSYSSNQSKHSTWEKGIWHLLPPGSSSSTTSGSFHLERRPLPSSMQLAVIRGDTLRGFDSTDLSQRKLRTRGNGKTVRPSSVYRNGTDIIYNYHGIVSLKLEDDSFPTHKRKAKVSIISQPQKTIKVAELPQADKVESTTDSHFPRQDQLPSFPKNCTLELKGLFHFEEGIQKLYQCNGIAWKAWSPQTKDVEDKSCPAGWHQHSGYCHILITEQKGTWNAAAQACREQYLGNLVTVFSRQHMRWLWDIGGRKSFWIGLNDQVHAGHWEWIGGEPVAFTNGRRGPSQRSKLGKSCVLVQRQGKWQTKDCRRAKPHNYVCSRKL

SEQ ID NO: 5557 - protein, 2139 aa, Homo Sapiens
MAGASRHPTGTPRQLLVALACLLLSRPALQGRASSLGTEPDPALYLPARGALDGTRPDGPSVLIANPGLRVPLGRSLWLDPLRDLVIGVQPGDRCEVTVLDALPRLKGALSPRRFPCTFGPRQVQYTHFGSHSPGRARVLLQLRYDAPTHTLVLPFTLAVDLVFSQLELVTRNRPLVVEKLRSWSRAIDRRVLDFASLKSGATATRRCRLTPLPHEDGPLPKYGRLVDAVGAPLPRGKGVDCEAFLRAGVRYQHTATSSPNRDYVPMMVELLGPEGQDAGSAGVLVREHFQLLVRIRGGAENTPPRPSFMATMMMEVDPLVLTALTPDALAAEDVESDPGDLVFNILNAPTHPPGHPGQQGYVVSTDDPLGLPVSFFTQQELRELKIAYQPPAENSHGERLFQLELEVVDGDGAASDPFAFMVTVKSMNTLVPVASHNRGLVLFEGQSRPLSSTHSIPISDKDNLEEVKMAAVRGLRHGQLVVFGAPAGCKYFTPADLAAGRVVYQHDGSNTYSDNIIFRMEDGHHQVDFLFPLTILPVDDEPPMVNTNTGLSLTEGQVVQISPFVLSATDIDSEDSTIHFVLENQPLKGNEEEPQWELAPGSSHSGHYLGDLLLQQAELPLSTEDEDWHYMEKEGLYEKVVTEWLQRDIMEGRLFYRHLGPHSPQSVMVQLAFHVQDDHDPPNLSKQHIFTIKVQPVDILSPQLYPGTTLEMTVQEYQLTHFQKNFLRYIDQDSDDQNLWYTLLTLPTDTDGNHQVRAGEIVLTDSPDTLIMHFTQAQVNQHKVAYQPPQKLGIAPRVVQFTYQVEDAAGNSVPGTFTLFLQPVDNQPPEVTNRGFAILEGGSFNLSSNELHVTDPDTDIDQIVFILVRGPQHGHLQYFKRCMVPGESFMQADVINGSVSYQHGRDQTTTSDTFHLEVSDGVHHIPITIPISVHPNVANRSPRISLRSSSLLDVSIDVLENKATEITMGVIHGKRKDVGDLMLSFIVKDSPKLGTILVNGLPTERFTQEDLINGRVAYAHTAGEVGFQKQHDAFSLILSKDSYQWVVGNSIIEKVQVQVTVLPVDNVGPKVFVGESFIVYEGEKNSLTLQHLHVEDVDTHQDELLCTVTSQPASGYLEKIASAPGSKMSQSGSPISAFSLRDIQVRHINYVQSIHKGVEPQEDQFTFYCSDGINFSPNVFFPIIILPTNDEQPKLFAHEFKVLEGMSLVIDTQLLNGADADLPPNELHFQLTALPRHGRIIQQLATGSQPIHSFTLKEIQEASTIVYEHDDSETKEDSFEVWLSDGKHTTHRKVPIVVTLVDDETPHLTVNNGLKVEKGHSEIITNRILKATDLDSDDKSLSFVLHSGPQQGLLQRLRKPRGEVRNNLTLGMNFTQDEINRGLICYIHTGQEGIVDIIKFDVTDGVNTLTDHYFYVTIGNLDSVFPEVISKRITLIEGARVTLTNNLLTNSDINSSDEHHFSITRAPSLGHLESSDYAGEPIASFTQLQLASNKISYVHTSNDEKKMDSFEFQVIGELYPVFRTFRIFITDVDNKKPILTIHRLTLQKEDSQLITLLELTVEDSDTPDDLILFTITQVPMHGKILYNGSRPVTTFTKQDLNKNLISYKHDGSETTEDSFSLTVTDGTHTDFYVLPDTALATHKPQVMRVQIRSLDNRLPQITTNRGAPALKRLHTGHMGFLITSKSLKAEDQDSPHRLLKYKVTRGPEHGFIIKTGLGNQSTRVFTQADIDEMKISYVLNEGSNASKDIFYFSVEDNGGNKLTNQPFHLNWAWICLEKEYYIVDEDSTFLEVTLTRRGYLGETSFISIGTKDETAKKDKDFKWKTNKQIQFNPGQTTATWRVRIIPDNEYETSETFQIILSEPLMAVLEFPEMATVEIVDPGDESTVYIPEAEYKIEEDIGELLIPVRRSGDASQELIVICSTRQGSATGTISSTVLFSDYISRPEDHTSILHFDKNETQKTCQVLIIDDSLYEEEESFSVSLRLPVGGQLGARFPTTKVTILADRYDEPVLHFGDAEYHVNESARYVEVCVWRRGTDLSQPSSIAVRSRKSEQESAEAGTDYVGISRNLDFAPGVRMQTFQVTILDDLGQPTLEGPEKFELLLQMPMGAVLGEPNKTTIFIEDTITDCKQSACSSFD

SEQ ID NO: 5558 - protein, 1284 aa, Homo Sapiens
MHVFIVGMSLSSVTLASALQVRGEALSEEEIWSLLFLAAEQLLEDLRNDSSDYVVCPWSALLSAAGSLSFQGRVSHIEAAPFKAPELLQGQSEDEQPDASQPLQLCEPLHSILLTMCEDQPHRRCTLQSVLEACRVHEKEVSVYPAPAGLHIRRLVGLVLGTISEVEKRVVEESSSVQQNRSYLLRKRLRGTSSESPAAQAPECLHPCRVSERSTETQSSPEPHWSTLTHSHCSLLVNRALPGADPQDQQAGRRLSSGSVHSAADSSWPTTPSQRGFLQRRSKFSRPEFILLAGEAPMTLHLPGSVVTKKGKSYLALRDLCVVLLNGQHLEVKCDVESTVGAVFNAVTSFANLEELTYFGLAYMKSKEFFFLDSETRLCKIAPEGWREQPQKTSMNTFTLFLRIKFFVSHYGLLQHSLTRHQFYLQLRKDILEERLYCNEEILLQLGVLALQAEFGNYPKEVESKPYFHVEDYIPASLIERMTALRVQVEVSEMHRLSSALWGEDAELKFLRVTQQLPEYGVLVHQVFSEKRRPEEEMALGICAKGVIVYEVKNNSRIAMLRFQWRETGKISTYQKKFTITSSVTGKKHTFVTDSAKTSKYLLDLCSAQHGFNAQMGSGQPSHVLFDHDKFVQMANLSPAHQARSKPLIWIQRLSCSENELFVSRLQGAAGGLLSTSMDNFNVDGSKEAGAEGIGRSPCTGREQLKSACVIQKPMTWDSLSGPPVQSMHAGSKNNRRKSFIAEPGREIVRVTLKRDPHRGFGFVINEGEYSGQADPGIFISSIIPGGPAEKAKTIKPGGQILALNHISLEGFTFNMAVRMIQNSPDNIELIISQSKGVGGNNPDEEKNSTANSGVSSTDILSFGYQGSLLSHTQDQDRNTEELDMAGVQSLVPRLRHQLSFLPLKGAGSSCPPSPPEISAGEIYFVELVKEDGTLGFSVTGGINTSVPYGGIYVKSIVPGGPAAKEGQILQGDRLLQVDGVILCGLTHKQAVQCLTGPGQVARLVLERRVPRSTQQCPSANDSMGDERTAVSLVTALPGRPSSCVSVTDGPKFEVKLKKNANGLGFSFVQMEKESCSHLKSDLVRIKRLFPGQPAEENGAIAAGDIILAVNGRSTEGLIFQEVLHLLRGAPQEVTLLLCRPPPGALPELEQEWQTPELSADKEFTRATCTDSCTSPILDQEDSWRDSASPDAGEGLGLRPESSQKAIREAQWGQNRERPWASSLTHSPESHPHLCKLHQERDESTLATSLEKDVRQNCYSVCDIMRLGRYSFSSPLTRLSTDIF

SEQ ID NO: 5559 - protein, 66 aa, Homo Sapiens
MQPLTKDAGMSLSSVTLASALQVRGEALSEEEIWSLLFLAAEQLLEDLRNAPAALRAPALHPADHV

SEQ ID NO: 5560 - protein, 1309 aa, Homo Sapiens
MQPLTKDAGMSLSSVTLASALQVRGEALSEEEIWSLLFLAAEQLLEDLRNDSSDYVVCPWSALLSAAGSLSFQGRVSHIEAAPFKAPELLQGQSEDEQPDASQMHVYSLGMTLYWSAGFHVPPHQPLQLCEPLHSILLTMCEDQPHRRCTLQSVLEACRVHEKEVSVYPAPAGLHIRRLVGLVLGTISEVEKRVVEESSSVQQNRSYLLRKRLRGTSSESPAAQAPECLHPCRVSERSTETQSSPEPHWSTLTHSHCSLLVNRALPGADPQDQQAGRRLSSGSVHSAADSSWPTTPSQRGFLQRRSKFSRPEFILLAGEAPMTLHLPGSVVTKKGKSYLALRDLCVVLLNGQHLEVKCDVESTVGAVFNAVTSFANLEELTYFGLAYMKSKEFFFLDSETRLCKIAPEGWREQPQKTSMNTFTLFLRIKFFVSHYGLLQHSLTRHQFYLQLRKDILEERLYCNEEILLQLGVLALQAEFGNYPKEQVESKPYFHVEDYIPASLIERMTALRVQVEVSEMHRLSSALWGEDAELKFLRVTQQLPEYGVLVHQVFSEKRRPEEEMALGICAKGVIVYEVKNNSRIAMLRFQWRETGKISTYQKKFTITSSVTGKKHTFVTDSAKTSKYLLDLCSAQHGFNAQMGSGQPSHVLFDHDKFVQMANLSPAHQARSKPLIWIQRLSCSENELFVSRLQGAAGGLLSTSMDNFNVDGSKEAGAEGIGRSPCTGREQLKSACVIQKPMTWDSLSGPPVQSMHAGSKNNRRKSFIAEPGREIVRVTLKRDPHRGFGFVINEGEYSGQADPGIFISSIIPGGPAEKAKTIKPGGQILALNHISLEGFTFNMAVRMIQNSPDNIELIISQSKGVGGNNPDEEKNSTANSGVSSTDILSFGYQGSLLSHTQDQDRNTEELDMAGVQSLVPRLRHQLSFLPLKGAGSSCPPSPPEISAGEIYFVELVKEDGTLGFSVTGGINTSVPYGGIYVKSIVPGGPAAKEGQILQGDRLLQVDGVILCGLTHKQAVQCLTGPGQVARLVLERRVPRSTQQCPSANDSMGDERTAVSLVTALPGRPSSCVSVTDGPKFEVKLKKNANGLGFSFVQMEKESCSHLKSDLVRIKRLFPGQPAEENGAIAAGDIILAVNGRSTEGLIFQEVLHLLRGAPQEVTLLLCRPPPGALPELEQEWQTPELSADKEFTRATCTDSCTSPILDQEDSWRDSASPDAGEGLGLRPESSQKAIREAQWGQNRERPWASSLTHSPESHPHLCKLHQERDESTLATSLEKDVRQNCYSVCDIMRLGRYSFSSPLTRLSTDIF

SEQ ID NO: 5561 - protein, 1397 aa, Homo Sapiens
MQPLTKDAGMSLSSVTLASALQVRGEALSEEEIWSLLFLAAEQLLEDLRNDSSDYVVCPWSALLSAAGSLSFQGRVSHIEAAPFKAPELLQGQSEDEQPDASQMHVYSLGMTLYWSAGFHVPPHQPLQLCEPLHSILLTMCEDQPHRRCTLQSVLEACRVHEKEVSVYPAPAGLHIRRLVGLVLGTISEVEKRVVEESSSVQQNRSYLLRKRLRGTSSESPAAQAPECLHPCRVSERSTETQSSPEPHWSTLTHSHCSLLVNRALPGADPQDQQAGRRLSSGSVHSAADSSWPTTPSQRGFLQRRSKFSRPEFILLAGEAPMTLHLPGSVVTKKGKSYLALRDLCVVLLNGQHLEVKCDVESTVGAVFNAVTSFANLEELTYFGLAYMKSKEFFFLDSETRLCKIAPEGWREQPQKTSMNTFTLFLRIKFFVSHYGLLQHSLTRHQFYLQLRKDILEERLYCNEEILLQLGVLALQAEFGNYPKEQVESKPYFHVEDYIPASLIERMTALRVQVEVSEMHRLSSALWGEDAELKFLRVTQQLPEYGVLVHQVFSEKRRPEEEMALGICAKGVIVYEVKNNSRIAMLRFQWRETGKISTYQKKFTITSSVTGKKHTFVTDSAKTSKYLLDLCSAQHGFNAQMGSGQPSHVLFDHDKFVQMANLSPAHQARSKPLIWIQRLSCSENELFVSRLQGAAGGLLSTSMDNFNVDGSKEAGAEGIGRSPCTGREQLKSACVIQKPMTWDSLSGPPVQSMHAGSKNNRRKSFIAEPGREIVRVTLKRDPHRGFGFVINEGEYSGQADPGIFISSIIPGGPAEKAKTIKPGGQILALNHISLEGFTFNMAVRMIQNSPDNIELIISQSKGVGGNNPDEEKNSTANSGVSSTDILSFGYQGSLLSHTQDQDRNTEELDMAGVQSLVPRLRHQLSFLPLKGAGSSCPPSPPEISAGEIYFVELVKEDGTLGFSVTGGINTSVPYGGIYVKSIVPGGPAAKEGQILQGDRLLQVDGVILCGLTHKQAVQCLTGPGQVARLVLERRVPRSTQQCPSANDSMGDERTAVSLVTALPGRPSSCVSVTDGPKFEVKLKKNANGLGFSFVQMEKESCSHLKSDLVRIKRLFPGQPAEENGAIAAGDIILAVNGRSTEGLIFQEVLHLLRGAPQEVTLLLCRPPPGALPELEQEWQTPELSADKEFTRATCTDSCTSPILDQEDSWRDSASPDAGEGLGLRPESSQKAIREAQWGQNRERPWASSLTHSPESHPHLCKLHQERDESTLATSLEKDVRQNCYSVCDIMRLGSPELDGEDGEGDMYHPCGAPSPTSEDEEYLTINSTCQGQLPCEECLEADSGTIPLPQFCSWGTVPESLPPEESPESGSEWEDLEEPVALEYGALRSLSFGGLNV

SEQ ID NO: 5562 - protein, 325 aa, Homo Sapiens
MVCGSPGGMLLLRAGLLALAALCLLRVPGARAAACEPVRIPLCKSLPWNMTKMPNHLHHSTQANAILAIEQFEGLLGTHCSPDLLFFLCAMYAPICTIDFQHEPIKPCKSVCERARQGCEPILIKYRHSWPENLACEELPVYDRGVCISPEAIVTADGADFPMDSSNGNCRGASSERCKCKPIRATQKTYFRNNYNYVIRAKVKEIKTKCHDVTAVVEVKEILKSSLVNIPRDTVNLYTSSGCLCPPLNVNEEYIIMGYEDEERSRLLLVEGSIAEKWKDRLGKKVKRWDMKLRHLGLSKSDSSNSDSTQSQKSGRNSNPRQARN

SEQ ID NO: 5563 - protein, 129 aa, Homo Sapiens
MKTLQFFFLFCCWKAICCNSCELTNITIAIEKEECRFCISINTTWCAGYCYTRDLVYKDPARPKIQKTCTFKELVYETVRVPGCAHHADSLYTYPVATQCHCGKCDSDSTDCTVRGLGPSYCSFGEMKE

SEQ ID NO: 5564 - protein, 129 aa, Homo Sapiens; identical to SEQ ID NO: 5563

SEQ ID NO: 5565 - protein, 129 aa, Homo Sapiens; identical to SEQ ID NO: 5563

SEQ ID NO: 5566 - protein, 695 aa, Homo Sapiens
MALLLVSLLAFLSLGSGCHHRICHCSNRVFLCQESKVTEIPSDLPRNAIELRFVLTKLRVIQKGAFSGFGDLEKIEISQNDVLEVIEADVFSNLPKLHEIRIEKANNLLYINPEAFQNLPNLQYLLISNTGIKHLPDVHKIHSLQKVLLDIQDNINIHTIERNSFVGLSFESVILWLNKNGIQEIHNCAFNGTQLDELNLSDNNNLEELPNDVFHGASGPVILDISRTRIHSLPSYGLENLKKLRARSTYNLKKLPTLEKLVALMEASLTYPSHCCAFANWRRQISELHPICNKSILRQEVDYMTQARGQRSSLAEDNESSYSRGFDMTYTEFDYDLCNEVVDVTCSPKPDAFNPCEDIMGYNILRVLIWFISILAITGNIIVLVILTTSQYKLTVPRFLMCNLAFADLCIGIYLLLIASVDIHTKSQYHNYAIDWQTGAGCDAAGFFTVFASELSVYTLTAITLERWHTITHAMQLDCKVQLRHAASVMVMGWIFAFAAALFPIFGISSYMKVSICLPMDIDSPLSQLYVMSLLVLNVLAFVVICGCYIHIYLTVRNPNIVSSSSDTRIAKRMAMLIFTDFLCMAPISFFAISASLKVPLITVSKAKILLVLFHPINSCANPFLYAIFTKNFRRDFFILLSKCGCYEMQAQIYRTETSSTVHNTHPRNGHCSSAPRVTSGSTYILVPLSHLAQN

SEQ ID NO: 5567 - protein, 278 aa, Homo Sapiens
MALLLVSLLAFLSLGSGCHHRICHCSNRVFLCQESKVTEIPSDLPRNAIELRFVLTKLRVIQKGAFSGFGDLEKIEISQNDVLEVIEADVFSNLPKLHEIRIEKANNLLYINPEAFQNLPNLQYLLISNTGIKHLPDVHKIHSLQKVLLDIQDNINIHTIERNSFVGLSFESVILWLNKNGIQEIHNCAFNGTQLDELNLSDNNNLEELPNDVFHGASGPVILSELHPICNKSILRQEVDYMTQARGQRSSLAEDNESSYSRGFDMTYTEFDYDLCNE

SEQ ID NO: 5568 - protein, 669 aa, Homo Sapiens
MALLLVSLLAFLSLGSGCHHRICHCSNRVFLCQESKVTEIPSDLPRNAIELRFVLTKLRVIQKGAFSGFGDLEKIEISQNDVLEVIEADVFSNLPKLHEIRIEKANNLLYINPEAFQNLPNLQYLLISNTGIKHLPDVHKIHSLQKVLLWLNKNGIQEIHNCAFNGTQLDELNLSDNNNLEELPNDVFHGASGPVILDISRTRIHSLPSYGLENLKKLRARSTYNLKKLPTLEKLVALMEASLTYPSHCCAFANWRRQISELHPICNKSILRQEVDYMTQARGQRSSLAEDNESSYSRGFDMTYTEFDYDLCNEVVDVTCSPKPDAFNPCEDIMGYNILRVLIWFISILAITGNIIVLVILTTSQYKLTVPRFLMCNLAFADLCIGIYLLLIASVDIHTKSQYHNYAIDWQTGAGCDAAGFFTVFASELSVYTLTAITLERWHTITHAMQLDCKVQLRHAASVMVMGWIFAFAAALFPIFGISSYMKVSICLPMDIDSPLSQLYVMSLLVLNVLAFVVICGCYIHIYLTVRNPNIVSSSSDTRIAKRMAMLIFTDFLCMAPISFFAISASLKVPLITVSKAKILLVLFHPINSCANPFLYAIFTKNFRRDFFILLSKCGCYEMQAQIYRTETSSTVHNTHPRNGHCSSAPRVTSGSTYILVPLSHLAQN

SEQ ID NO: 5569 - protein, 152 aa, Homo Sapiens
MALLLVSLLAFLSLGSGCHHRICHCSNRVFLCQESKVTEIPSDLPRNAIELRFVLTKLRVIQKGAFSGFGDLEKIEISQNDVLEVIEADVFSNLPKLHEIRIEKANNLLYINPEAFQNLPNLQYLSFSSFVLENAKVENGDHRAFSDRTNAL

SEQ ID NO: 5570 - protein, 215 aa, Homo Sapiens
GPVCGLDGKTYRNECALLKARCKEQPELEVQYQGRCKKTCRDVFCPGSSTCVVDQTNNAYCVTCNRICPEPASSEQYLCGNDGVTYSSACHLRKATCLLGRSIGLAYEGKCITKSCEDIQCTGGKKCLWDFKVGRGRCSLCDELCPDSKSDEPVCASDNATYASECAMKEAACSSGVLLEVKHSGSCNSISEDTEEEEEDEDQDYSFPISSILEW

SEQ ID NO: 5571 - protein, 344 aa, Homo Sapiens
MVRARHQPGGLCLLLLLLCQFMEDRSAQAGNCWLRQAKNGRCQVLYKTELSKEECCSTGRLSTSWTEEDVNDNTLFKWMIFNGGAPNCIPCKETCENVDCGPGKKCRMNKKNKPRCVCAPDCSNITWKGPVCGLDGKTYRNECALLKARCKEQPELEVQYQGRCKKTCRDVFCPGSSTCVVDQTNNAYCVTCNRICPEPASSEQYLCGNDGVTYSSACHLRKATCLLGRSIGLAYEGKCIKAKSCEDIQCTGGKKCLWDFKVGRGRCSLCDELCPDSKSDEPVCASDNATYASECAMKEAACSSGVLLEVKHSGSCNSISEDTEEEEEDEDQDYSFPISSILEW

SEQ ID NO: 5572 - protein, 317 aa, Homo Sapiens
MVRARHQPGGLCLLLLLLCQFMEDRSAQAGNCWLRQAKNGRCQVLYKTELSKEECCSTGRLSTSWTEEDVNDNTLFKWMIFNGGAPNCIPCKETCENVDCGPGKKCRMNKKNKPRCVCAPDCSNITWKGPVCGLDGKTYRNECALLKARCKEQPELEVQYQGRCKKTCRDVFCPGSSTCVVDQTNNAYCVTCNRICPEPASSEQYLCGNDGVTYSSACHLRKATCLLGRSIGLAYEGKCIKAKSCEDIQCTGGKKCLWDFKVGRGRCSLCDELCPDSKSDEPVCASDNATYASECAMKEAACSSGVLLEVKHSGSCN

SEQ ID NO: 5573 - protein, 102 aa, Homo Sapiens
  misc_feature (1)..(1): Xaa can be any naturally occurring amino acid
XSACHLRKATCLLGRSIGLAYEGKCITKSCEDIQCTGGKKCLWDFKVGRGRCSLCDELCPDSKSDEPVCASDNATYASECAMKEAACSSGVLLEVKHSGSCN

SEQ ID NO: 5574 - protein, 140 aa, Homo Sapiens
MWKRWLALALALVAVAWVRAEEELRSKSKICANVFCGAGRECAVTEKGEPTCLCIEQCKPHKRPVCGSNGKTYLNHCELHRDACLTGSKIQVDYDGHCKEKKSVSPSASPVVCYQSNRDELRRRIIQWLEAEIIPDGWFS

SEQ ID NO: 5575 - protein, 308 aa, Homo Sapiens
MWKRWLALALALVAVAWVRAEEELRSKSKICANVFCGAGRECAVTEKGEPTCLCIEQCKPHKRPVCGSNGKTYLNHCELHRDACLTGSKIQVDYDGHCKEKKSVSPSASPVVCYQSNRDELRRRIIQWLEAEIIPDGWFSKGSNYSEILDKYFKNFDNGDSRLDSSEFLKFVEQNETAINITTYPDQENNKLLRGLCVDALIELSDENADWKLSFQEFLKCLNPSFNPPEKKCALEDETYADGAETEVDCNRCVCACGNWVCTAMTCDGKNQKGAQTQTEEEMTRYVQELQKHQETAEKTKRVSTKEI

SEQ ID NO: 5576 - protein, 273 aa, Homo Sapiens
MWKRWLALALALVAVAWVRAEQCKPHKRPVCGSNGKTYLNHCELHRDACLTGSKIQVDYDGHCKEKKSVSPSASPVVCYQSNRDELRRRIIQWLEAEIIPDGWFSKGSNYSEILDKYFKNFDNGDSRLDSSEFLKFVEQNETAINITTYPDQENNKLLRGLCVDALIELSDENADWKLSFQEFLKCLNPSFNPPEKKCALEDETYADGAETEVDCNRCVCACGNWVCTAMTCDGKNQKGAQTQTEEEMTRYVQELQKHQETAEKTKRVSTKEI

SEQ ID NO: 5577 - protein, 20 aa, Homo Sapiens
  misc_feature (1)..(1): Xaa can be any naturally occurring amino acid
XSFQEFLKCLNPSFNPPEKK

SEQ ID NO: 5578 - protein, 84 aa, Homo Sapiens
MLGGRPRCECAPDCSGLPARLQVCGSDGATYRDECELRAARCRGHPDLSVMYRGRCRKSCEHVVCPRPQSCVVDQTGSAHCVVC

SEQ ID NO: 5579 - protein, 263 aa, Homo Sapiens
MRPGAPGPLWPLPWGALAWAVGFVSSMGSGNPAPGGVCWLQQGQEATCSLVLQTDVTRAECCASGNIDTAWSNLTHPGNKINLLGFLGLVHCLPCKDSCDGVECGPGKACRMLGGRPRCECAPDCSGLPARLQVCGSDGATYRDECELRAARCRGHPDLSVMYRGRCRKSCEHVVCPRPQSCVVDQTGSAHCVVCRAAPCPVPSSPGQELCGNNNVTYISSCHMRQATCFLGRSIGVRHAGSCAGTPEEPPGGESAEEEENFV

SEQ ID NO: 5580 - protein, 92 aa, Homo Sapiens
MRQATCFLGRSIGVRHAGSCAGADAGRGHRPVLGAGEPPALRPQCSYRPLQAPLRSRQVVSLQKRKRTSCEPAGQAWAWCPRPPIIPCYLLP

SEQ ID NO: 5581 - protein, 40 aa, Homo Sapiens
MRQATCFLGRSIGVRHAGSCAGTPEEPPGGESAEEEENFV

SEQ ID NO: 5582 - protein, 40 aa, Homo Sapiens; identical to SEQ ID NO: 5581

SEQ ID NO: 5583 - protein, 40 aa, Homo Sapiens; identical to SEQ ID NO: 5581

SEQ ID NO: 5584 - protein, 673 aa, Homo Sapiens
MKPGGFWLHLTLLGASLPAALGWMDPGTSRGPDVGVGESQAEEPRSFEVTRREGLSSHNELLASCGKKFCSRGSRCVLSLAPEDRVSVTTVTVGLSTVLTCAVHGDLRPPIIWKRNGLTLNFLDLEDINDFGEDDSLYITKVTTIHMGNYTCHASGHEQLFQTHVLQVNVPPVIRVYPESQAQEPGVAASLRCHAEGIPMPRITWLKNGVDVSTQMSKQLSLLANGSELHISSVRYEDTGAYTCIAKNEVGVDEDISSLFIEDSARKTLANILWREEGLSVGNMFYVFSDDGIIVIHPVDCEIQRHLKPTEKIFMSYEEICPQREKNATQPCQWVSAVNVRNRYIYVAQPALSRVLVVDIQAQKVLQSIGVDPLPAKLSYDKSHDQVWVLSWGDVHKSRPSLQVITEASTGQSQHLIRTPFAGVDDFFIPPTNLIINHIRFGFIFNKSDPAVHKVDLETMMPLKTIGLHHHGCVPQAMAHTHLGGYFFIQCRQDSPASAARQLLVDSVTDSVLGPNGDVTGTPHTSPDGRFIVSAAADSPWLHVQEITVRGEIQTLYDLQINSGISDLAFQRSFTESNQYNIYAALHTEPDLLFLELSTGKVGMLKNLKEPPAGPAQPWGGTHRIMRDSGLFGQYLLTPARESLFLINGRQNTLRCEVSGIKGGTTVVWVGEV

SEQ ID NO: 5585 - protein, 842 aa, Homo Sapiens
MKPGGFWLHLTLLGASLPAALGWMDPGTSRGPDVGVGESQAEEPRSFEVTRREGLSSHNELLASCGKKFCSRGSRCVLSRKTGEPECQCLEACRPSYVPVCGSDGRFYENHCKLHRAACLLGKRITVIHSKDCFLKGDTCTMAGYARLKNVLLALQTRLQPLQEGDSRQDPASQKRLLVESLFRDLDADGNGHLSSSELAQHVLKKQDLDEDLLGCSPGDLLRFDDYNSDSSLTLREFYMAFQVVQLSLAPEDRVSVTTVTVGLSTVLTCAVHGDLRPPIIWKRNGLTLNFLDLEDINDFGEDDSLYITKVTTIHMGNYTCHASGHEQLFQTHVLQVNVPPVIRVYPESQAQEPGVAASLRCHAEGIPMPRITWLKNGVDVSTQMSKQLSLLANGSELHISSVRYEDTGAYTCIAKNEVGVDEDISSLFIEDSARKTLANILWREEGLSVGNMFYVFSDDGIIVIHPVDCEIQRHLKPTEKIFMSYEEICPQREKNATQPCQWVSAVNVRNRYIYVAQPALSRVLVVDIQAQKVLQSIGVDPLPAKLSYDKSHDQVWVLSWGDVHKSRPSLQVITEASTGQSQHLIRTPFAGVDDFFIPPTNLIINHIRFGFIFNKSDPAVHKVDLETMMPLKTIGLHHHGCVPQAMAHTHLGGYFFIQCRQDSPASAARQLLVDSVTDSVLGPNGDVTGTPHTSPDGRFIVSAAADSPWLHVQEITVRGEIQTLYDLQINSGISDLAFQRSFTESNQYNIYAALHTEPDLLFLELSTGKVGMLKNLKEPPAGPAQPWGGTHRIMRDSGLFGQYLLTPARESLFLINGRQNTLRCEVSGIKGGTTVVWVGEV

SEQ ID NO: 5586 - protein, 157 aa, Homo Sapiens
MNPVPQMEMQKSPVFCVAHAGSCRPELFLFGHLGSSWGLDLKEEEPRSFEVTRREGLSSHNELLASCGKKFCSRGSRCVLSRKTGEPECQCLEACRPSYVPVCGSDGRFYENHCKLHRAACLLGKRITVIHSKDCFLKGDTCTMAGYARLKNVLLAL

SEQ ID NO: 5587 - protein, 846 aa, Homo Sapiens
MFKCWSVVLVLGFIFLESEGRPTKEGGYGLKSYQPLMRLRHKEKNQESSRVKGFMIQDGPFGSCENKYCGLGRHCVTSRETGQAECACMDLCKRHYKPVCGSDGEFYENHCEVHRAACLKKQKITIVHNEDCFFKGDKCKTTEYSKMKNMLLDLQNQKYIMQENENPNGDDISRKKLLVDQMFKYFDADSNGLVDINELTQVIKQEELGKDLFDCTLYVLLKYDDFNADKHLALEEFYRAFQVIQLSLPEDQKLSITAATVGQSAVLSCAIQGTLRPPIIWKRNNIILNNLDLEDINDFGDDGSLYITKVTTTHVGNYTCYADGYEQVYQTHIFQVNVPPVIRVYPESQAREPGVTASLRCHAEGIPKPQLGWLKNGIDITPKLSKQLTLQANGSEVHISNVRYEDTGAYTCIAKNEAGVDEDISSLFVEDSARKTLANILWREEGLGIGNMFYVFYEDGIKVIQPIECEFQRHIKPSEKLLGFQDEVCPKAEGDEVQRCVWASAVNVKDKFIYVAQPTLDRVLIVDVQSQKVVQAVSTDPVPVKLHYDKSHDQVWVLSWGTLEKTSPTLQVITLASGNVPHHTIHTQPVGKQFDRVDDFFIPTTTLIITHMRFGFILHKDEAALQKIDLETMSYIKTINLKDYKCVPQSLAYTHLGGYYFIGCKPDSTGAVSPQVMVDGVTDSVIGFNSDVTGTPYVSPDGHYLVSINDVKGLVRVQYITIRGEIQEAFDIYTNLHISDLAFQPSFTEAHQYNIYGSSSTQTDVLFVELSSGKVKMIKSLKEPLKAEEWPWNRKNRQIQDSGLFGQYLMTPSKDSLFILDGRLNKLNCEITEVEKGNTVIWVGDA

SEQ ID NO: 5588 - protein, 837 aa, Homo Sapiens
MFKCWSVVLVLGFIFLESEGRPTKEGGYGLKSYQPLMRLRHKEKNQESSRVKGFMIQDGPFGSCENKYCGLGRHCVTSRETGQAECACMDLCKRHYKPVCGSDGEFYENHCEVHRAACLKKQKITIVHNEDCFFKGDKCKTTEYSKMKNMLLDLQNQKYIMQENENPNGDDISRKKLLVDQMFKYFDADSNGLVDINELTQVIKQEELGKDLFDCTLYVLLKYDDFNADKHLALEEFYRAFQVIQLSLPEDQKLSITAATVGQSAVLSCAIQGTLRPPIIWKRNNIILNNLDLEDINDFGDDGSLYITKVTTTHVGNYTCYADGYEQVYQTHIFQVNVPPVIRVYPESQAREPGVTASLRCHAEGIPKPQLGWLKNGIDITPKLSKQLTLQANGSEVHISNVRYEDTGAYTCIAKNEAGVDEDISSLFVEDSARKTRLGIGNMFYVFYEDGIKVIQPIECEFQRHIKPSEKLLGFQDEVCPKAEGDEVQRCVWASAVNVKDKFIYVAQPTLDRVLIVDVQSQKVVQAVSTDPVPVKLHYDKSHDQVWVLSWGTLEKTSPTLQVITLASGNVPHHTIHTQPVGKQFDRVDDFFIPTTTLIITHMRFGFILHKDEAALQKIDLETMSYIKTINLKDYKCVPQSLAYTHLGGYYFIGCKPDSTGAVSPQVMVDGVTDSVIGFNSDVTGTPYVSPDGHYLVSINDVKGLVRVQYITIRGEIQEAFDIYTNLHISDLAFQPSFTEAHQYNIYGSSSTQTDVLFVELSSGKVKMIKSLKEPLKAEEWPWNRKNRQIQDSGLFGQYLMTPSKDSLFILDGRLNKLNCEITEVEKGNTVIWVGDA

SEQ ID NO: 5589 - protein, 847 aa, Homo Sapiens
MFKCWSVVLVLGFIFLESEGRPTKEGGYGLKSYQPLMRLRHKQEKNQESSRVKGFMIQDGPFGSCENKYCGLGRHCVTSRETGQAECACMDLCKRHYKPVCGSDGEFYENHCEVHRAACLKKQKITIVHNEDCFFKGDKCKTTEYSKMKNMLLDLQNQKYIMQENENPNGDDISRKKLLVDQMFKYFDADSNGLVDINELTQVIKQEELGKDLFDCTLYVLLKYDDFNADKHLALEEFYRAFQVIQLSLPEDQKLSITAATVGQSAVLSCAIQGTLRPPIIWKRNNIILNNLDLEDINDFGDDGSLYITKVTTTHVGNYTCYADGYEQVYQTHIFQVNVPPVIRVYPESQAREPGVTASLRCHAEGIPKPQLGWLKNGIDITPKLSKQLTLQANGSEVHISNVRYEDTGAYTCIAKNEAGVDEDISSLFVEDSARKTLANILWREEGLGIGNMFYVFYEDGIKVIQPIECEFQRHIKPSEKLLGFQDEVCPKAEGDEVQRCVWASAVNVKDKFIYVAQPTLDRVLIVDVQSQKVVQAVSTDPVPVKLHYDKSHDQVWVLSWGTLEKTSPTLQVITLASGNVPHHTIHTQPVGKQFDRVDDFFIPTTTLIITHMRFGFILHKDEAALQKIDLETMSYIKTINLKDYKCVPQSLAYTHLGGYYFIGCKPDSTGAVSPQVMVDGVTDSVIGFNSDVTGTPYVSPDGHYLVSINDVKGLVRVQYITIRGEIQEAFDIYTNLHISDLAFQPSFTEAHQYNIYGSSSTQTDVLFVELSSGKVKMIKSLKEPLKAEEWPWNRKNRQIQDSGLFGQYLMTPSKDSLFILDGRLNKLNCEITEVEKGNTVIWVGDA

SEQ ID NO: 5590 - protein, 138 aa, Homo Sapiens
MSSSRVGLRLAACLLNVSEAGRKYIVENIAKAALLDKNGKKHPQVSVLNIFSDQDYKRSVITIATSVDKLGLAEDLVLHVPGCSVFLFGEADLPEKRSLVQRRKQLGWFTRRDFSALQPDLGAAPSQRCGLTACFRAL

SEQ ID NO: 5591 - protein, 147 aa, Homo Sapiens
MSSSRVGLRLAACLLNVSEAGRKYIVENIAKAALLDKNGKKHPQVSVLNIFSDQDYKRSVITIATSVDKLGLAEDLVLHVPGCSVFLFGEADLPEKRSLVQRRKQLGWFTRRDFSALQPDLGAAPSQRCGLTGSEHGFCFALFFFFF

SEQ ID NO: 5592 - protein, 114 aa, Homo Sapiens
MSSSRVGLRLAACLLNVSEAGRKYIVENIAKAALLDKNGKKHPQVSVLNIFSDQDYKRSVITIATSVDKLGSSVLAACLEAFQAIDMEVQEGIHPCLGAVDLIPIYPLSGVTVE

SEQ ID NO: 5593 - protein, 77 aa, Homo Sapiens
MSSSRVGLRLAACLLNVSEAGRKYIVENIAKAALLDKNGKKHPQVSVLNIFSDQDYKRSVITIATSVDKLVDKRNQA

SEQ ID NO: 5594 - protein, 466 aa, Homo Sapiens
MRAPGMRSRPAGPALLLLLLFLGAAESVRRAQPPRRYTPDWPSLDSRPLPAWFDEAKFGVFIHWGVFSVPAWGSEWFWWHWQGEGRPQYQRFMRDNYPPGFSYADFGPQFTARFFHPEEWADLFQAAGAKYVVLTTKHHEGFTNWPSPVSWNWNSKDVGPHRDLVGELGTALRKRNIRYGLYHSLLEWFHPLYLLDKKNGFKTQHFVSAKTMPELYDLVNSYKPDLIWSDGEWECPDTYWNSTNFLSWLYNDSPVKDEVVVNDRWGQNCSCHHGGYYNCEDKFKPQSLPDHKWEMCTSIDKFSWGYRRDMALSDVTEESEIISELVQTVSLGGNYLLNIGPTKDGLIVPIFQERLLAVGKWLSINGEAIYASKPWRVQWEKNTTSVWYTSKGSAVYAIFLHWPENGVLNLESPITTSTTKITMLGIQGDLKWSTDPDKGLFISLPQLPPSAVPAEFAWTIKLTGVK

SEQ ID NO: 5595 - protein, 467 aa, Homo Sapiens
MRPQELPRLAFPLLLLLLLLLPPPPCPAHSATRFDPTWESLDARQLPAWFDQAKFGIFIHWGVFSVPSFGSEWFWWYWQKEKIPKYVEFMKDNYPPSFKYEDFGPLFTAKFFNANQWADIFQASGAKYIVLTSKHHEGFTLWGSEYSWNWNAIDEGPKRDIVKELEVAIRNRTDLRFGLYYSLFEWFHPLFLEDESSSFHKRQFPVSKTLPELYELVNNYQPEVLWSDGDGGAPDQYWNSTGFLAWLYNESPVRGTVVTNDRWGAGSICKHGGFYTCSDRYNPGHLLPHKWENCMTIDKLSWGYRREAGISDYLTIEELVKQLVETVSCGGNLLMNIGPTLDGTISVVFEERLRQMGSWLKVNGEAIYETHTWRSQNDTVTPDVWYTSKPKEKLVYAIFLKWPTSGQLFLGHPKAILGATEVKLLGHGQPLNWISLEQNGIMVELPQLTIHQMPCKWGWALALTNVI

SEQ ID NO: 5596 - protein, 109 aa, Homo Sapiens
QLVETVSCGGNLLMNIGPTLDGTISVVFEERLRQMGSWLKVNGEAIYETHTWRSQNDTVTPDVWYTSKPKEKLVYAIFLKWPTSGQLFLGHPKAILGATEVRGNFTLFL

SEQ ID NO: 5597 - protein, 69 aa, Homo Sapiens
KPAHLNANDWATNGVGRKVSHSYGYGLWTQAPWWPWPRIGPQWPPSGSASSTSSPSPKTSGNGSRCGRP

SEQ ID NO: 5598 - protein, 69 aa, Homo Sapiens
MELRPWLLWVVAATGTLVLLAADAQGQKVFTNTWAVRIPGGPAVANSVARKHGFLNLGQIFGDYYHFWH

SEQ ID NO: 5599 - protein, 794 aa, Homo Sapiens
MELRPWLLWVVAATGTLVLLAADAQGQKVFTNTWAVRIPGGPAVANSVARKHGFLNLGQIFGDYYHFWHRGVTKRSLSPHRPRHSRLQREPQVQWLEQQVAKRRTKRDVYQEPTDPKFPQQWYLSGVTQRDLNVKAAWAQGYTGHGIVVSILDDGIEKNHPDLAGNYDPGASFDVNDQDPDPQPRYTQMNDNRHGTRCAGEVAAVANNGVCGVGVAYNARIGGVRMLDGEVTDAVEARSLGLNPNHIHIYSASWGPEDDGKTVDGPARLAEEAFFRGVSQGRGGLGSIFVWASGNGGREHDSCNCDGYTNSIYTLSISSATQFGNVPWYSEACSSTLATTYSSGNQNEKQIVTTDLRQKCTESHTGTSASAPLAAGIIALTLEANKNLTWRDMQHLVVQTSKPAHLNANDWATNGVGRKVSHSYGYGLLDAGAMVALAQNWTTVAPQRKCIIDILTEPKDIGKRLEVRKTVTACLGEPNHITRLEHAQARLTLSYNRRGDLAIHLVSPMGTRSTLLAARPHDYSADGFNDWAFMTTHSWDEDPSGEWVLEIENTSEANNYGTLTKFTLVLYGTAPEGLPVPPESSGCKTLTSSQACVVCEEGFSLHQKSCVQHCPPGFAPQVLDTHYSTENDVETIRASVCAPCHASCATCQGPALTDCLSCPSHASLDPVEQTCSRQSQSSRESPPQQQPPRLPPEVEAGQRLRAGLLPSHLPEVVAGLSCAFIVLVFVTVFLVLQLRSGFSFRGVKVYTMDRGLISYKGLPPEAWQEECPSDSEEDEGRGERTAFIKDQSAL

SEQ ID NO: 5600 - protein, 794 aa, Homo Sapiens; identical to SEQ ID NO: 5599

SEQ ID NO: 5601 - protein, 794 aa, Homo Sapiens; identical to SEQ ID NO: 5599

SEQ ID NO: 5602 - protein, 175 aa, Homo Sapiens
MELRPWLLWVVAATGTLVLLAADAQGQKVFTNTWAVRIPGGPAVANSVARKHGFLNLGQIFGDYYHFWHRGVTKRSLSPHRPRHSRLQREPQWLEQQVAKRRTKRDVYQEPTDPKFPQQWYLSGVTQRDLNVKAAWAQGYTGHGIVVSILDDGIEKNHPDLAGNYDPGASFDVND

SEQ ID NO: 5603 - protein, 216 aa, Homo Sapiens
PNHIHIYSASWGPEDDGKTVDGPARLAEEAFFRGVSQGRGGLGSIFVWASGNGGREHDSCNCDGYTNSIYTLSISSATQFGNVPWYSEACSSTLATTYSSGNQNEKQIVTTDLRQKCTESHTGTSASAPLAAGIIALTLEANKNLTWRDMQHLVVQTSKPAHLNANDWATNGVGRKVSHSYGYGLLDAGAMVALAQNWTTVAPQRKCIIDILTEPK

SEQ ID NO: 5604 - protein, 451 aa, Homo Sapiens
MVELGKFERKEFKSSSLQDGHTKMEEAPTHLNSFLKKEGLTFNRKRKWELDSYPIMLWWSPLTGETGRLGQCGADACFFTINRTYLHHHMTKAFLFYGTDFNIDSLPLPRKAHHDWAVFHEESPKNNYKLFHKPVITLFNYTATFSRHSHLPLTTQYLESIEVLKSLRYLVPLQSKNKLRKRLAPLVYVQSDCDPPSDRDSYVRELMTYIEVDSYGECLRNKDLPQQLKNPASMDADGFYRIIAQYKFILAFENAVCDDYITEKFWRPLKLGVVPVYYGSPSITDWLPSNKSAILVSEFSHPRELASYIRRLDSDDRLYEAYVEWKLKGEISNQRLLTALRERKWGVQDVNQDNYIDAFECMVCTKVWANIRLQEKGLPPKRWEAEDTHLSCPEPTVFAFSPLRTPPLSSLREMWISSFEQSKKEAQALRWLVDRNQNFSSQEFWGLVFKD

SEQ ID NO: 5605 - protein, 451 aa, Homo Sapiens; identical to SEQ ID NO: 5604

SEQ ID NO: 5606 - protein, 479 aa, Homo Sapiens
MVRIQRRKLLASCLCVTATVFLLVTLQVMVELGKFERKEFKSSSLQDGHTKMEEAPTHLNSFLKKEGLTFNRKRKWELDSYPIMLWWSPLTGETGRLGQCGADACFFTINRTYLHHHMTKAFLFYGTDFNIDSLPLPRKAHHDWAVFHEESPKNNYKLFHKPVITLFNYTATFSRHSHLPLTTQYLESIEVLKSLRYLVPLQSKNKLRKRLAPLVYVQSDCDPPSDRDSYVRELMTYIEVDSYGECLRNKDLPQQLKNPASMDADGFYRIIAQYKFILAFENAVCDDYITEKFWRPLKLGVVPVYYGSPSITDWLPSNKSAILVSEFSHPRELASYIRRLDSDDRLYEAYVEWKLKGEISNQRLLTALRERKWGVQDVNQDNYIDAFECMVCTKVWANIRLQEKGLPPKRWEAEDTHLSCPEPTVFAFSPLRTPPLSSLREMWISSFEQSKKEAQALRWLVDRNQNFSSQEFWGLVFKD

SEQ ID NO: 5607 - protein, 492 aa, Homo Sapiens
MAAGPIRVVLVLLGVLSVCAASGHGSVAEREAGGEAEWAEPWDGAVFRPPSALGAVGVTRSSGTPRPGREEAGDLPVLLWWSPGLFPHFPGDSERIECARGACVASRNRRALRDSRTRALLFYGTDFRASAAPLPRLAHQSWALLHEESPLNNFLLSHGPGIRLFNLTSTFSRHSDYPLSLQWLPGTAYLRRPVPPPMERAEWRRRGYAPLLYLQSHCDVPADRDRYVRELMRHIPVDSYGKCLQNRELPTARLQDTATATTEDPELLAFLSRYKFHLALENAICNDYMTEKLWRPMHLGAVPVYRGSPSVRDWMPNNHSVILIDDFESPQKLAEFIDFLDKNDEEYMKYLAYKQPGGITNQFLLDSLKHREWGVNDPLLPNYLNGFECFVCDYELARLDAEKAHAASPGDSPVFEPHIAQPSHMDCPVPTPGFGNVEEIPENDSWKEMWLQDYWQGLDQGEALTAMIHNNETEQTKFWDYLHEIFMKRQHL

SEQ ID NO: 5608 - protein, 476 aa, Homo Sapiens
MAAGPIRVVLVLLGVLSVCAASGHGSVAEREAGGEAEWAEPWDGAVFRPPSALGAVGVTRSSGTPRPGREEAGDLPVLLWWSPGLFPHFPGDSERIECARGACVASRNRRALRDSRTRALLFYGTDFRASAAPLPRLAHQSWALLHEESPLNNFLLSHGPGIRLFNLTSTFSRHSDYPLSLQWLPGTAYLRRPVPPPMERAEWRRRGYAPLLYLQSHCDVPADRDRYVRELMRHIPVDSYGKCLQNRELPTARLQDTATATTEDPELLAFLSRYKFHLALENAICNDYMTEKLWRPMHLGAVPVYRGSPSVRDWMPNNHSVILIDDFESPQKLAEFIDFLDKNDEEYMKYLAYKQPGGITNQFLLDSLKHREWGVNDPLLPNYLNGFECFVCDYELARLDAEKAHAASPGDSPVFEPHIAQPSHMDCPVPTPGFGNVEEIPENDSSLVQVRDHCICLRFLWPHSEKGRTHNYAAVP

SEQ ID NO: 5609 - protein, 135 aa, Homo Sapiens
MNLRKSGTLGHPGSLDETTYERLAEETLDSLAEFFEDLADKPYTFEDYDVSFGSGVLTVKLGGDLGTYVINKQTPNKQIWLSSPSSGPKRYDWTGKNWVYSHDGVSLHELLAAELTKALKTKLDLSSLAYSGKDA

SEQ ID NO: 5610 - protein, 135 aa, Homo Sapiens; identical to SEQ ID NO: 5609

SEQ ID NO: 5611 - protein, 171 aa, Homo Sapiens
MWTLGRRAVAGLLASPSPAQAQTLTRVPRPAELAPLCGRRGLRTDIDATCTPRRASSNQRGLNQIWNVKKQSVYLMNLRKSGTLGHPGSLDETTYERLAEETLDSLAEFFEDLADKPYTFEDYDVSFGSGVLTVKLGGDLGTYVINKQTPNKQIWLSSPSRLTWLLWLFHP

SEQ ID NO: 5612 - protein, 196 aa, Homo Sapiens
MWTLGRRAVAGLLASPSPAQAQTLTRVPRPAELAPLCGRRGLRTDIDATCTPRRASSNQRGLNQIWNVKKQSVYLMNLRKSGTLGHPGSLDETTYERLAEETLDSLAEFFEDLADKPYTFEDYDVSFGSGVLTVKLGGDLGTYVINKQTPNKQIWLSSPSRYVVDLSVMTGLGKTGCTPTTACPSMSCWPQSSLKP

SEQ ID NO: 5613 - protein, 210 aa, Homo Sapiens
MWTLGRRAVAGLLASPSPAQAQTLTRVPRPAELAPLCGRRGLRTDIDATCTPRRASSNQRGLNQIWNVKKQSVYLMNLRKSGTLGHPGSLDETTYERLAEETLDSLAEFFEDLADKPYTFEDYDVSFGSGVLTVKLGGDLGTYVINKQTPNKQIWLSSPSSGPKRYDWTGKNWVYSHDGVSLHELLAAELTKALKTKLDLSSLAYSGKDA

SEQ ID NO: 5614 - protein, 210 aa, Homo Sapiens; identical to SEQ ID NO: 5613

SEQ ID NO: 5615 - protein, 196 aa, Homo Sapiens
MWTLGRRAVAGLLASPSPAQAQTLTRVPRPAELAPLCGRRGLRTDIDATCTPRRASSNQRGLNQIWNVKKQSVYLMNLRKSGTLGHPGSLDETTYERLAEETLDSLAEFFEDLADKPYTFEDYDVSFGVNVAPVAVPSLRKSEDHALQTGHVLDYLCFCLLGFQSASEQRSNPDSVVHRMAGDGVWLCRPGWSAMA

SEQ ID NO: 5616 - protein, 91 aa, Homo Sapiens
MWTLGRRAVAGLLASPSPAQAQTLTRVPRPAELAPLCGRRGLRTDIDATCTPRRASSNQRGLNQIWNVKKQSVYLMNLRKSGTLGHPGVVS

SEQ ID NO: 5617 - protein, 19 aa, Homo Sapiens
MAELTVEVRGSNGAFYKAI

SEQ ID NO: 5618 - protein, 621 aa, Homo Sapiens
MAELTVEVRGSNGAFYKGFIKDVHEDSLTVVFENNWQPERQVPFNEVRLPPPPDIKKEISEGDEVEVYSRANDQEPCGWWLAKVRMMKGEFYVIEYAACDATYNEIVTFERLRPVNQNKTVKKNTFFKCTVDVPEDLREACANENAHKDFKKAVGACRIFYHPETTQLMILSASEATVKRVNILSDMHLRSIRTKLMLMSRNEEATKHLECTKQLAAAFHEEFVVREDLMGLAIGTHGSNIQQARKVPGVTAIELDEDTGTFRIYGESADAVKKARGFLEFVEDFIQVPRNLVGKVIGKNGKVIQEIVDKSGVVRVRIEGDNENKLPREDGMVPFVFVGTKESIGNVQVLLEYHIAYLKEVEQLRMERLQIDEQLRQIGSRSYSGRGRGRRGPNYTSGYGTNSELSNPSETESERKDELSDWSLAGEDDRDSRHQRDSRRRPGGRGRSVSGGRGRGGPRGGKSSISSVLKDPDSNPYSLLDNTESDQTADTDASESHHSTNRRRRSRRRRTDEDAVLMDGMTESDTASVNENGLVTVADYISRAESQSRQRNLPRETLAKNKKEMAKDVIEEHGPSEKAINGPTSASGDDISKLQRTPGEEKINTLKEENTQEAAVLNGVS

SEQ ID NO: 5619 - protein, 539 aa, Homo Sapiens
MAELTVEVRGSNGAFYKGFIKDVHEDSLTVVFENNWQPERQVPFNEVRLPPPPDIKKEISEGDEVEVYSRANDQEPCGWWLAKVRMMKGEFYVIEYAACDATYNEIVTFERLRPVNQNKTVKKNTFFKCTVDVPEDLREACANENAHKDFKKAVGACRIFYHPETTQLMILSASEATVKRVNILSDMHLRSIRTKLMLMSRNEEATKHLECTKQLAAAFHEEFVVREDLMGLAIGTHGSNIQQARKVPGVTAIELDEDTGTFRIYGESADAVKKARGFLEFVEDFIQVPRNLVGKVIGKNGKVIQEIVDKSGVVRVRIEGDNENKLPREDGMVPFVFVGTKESIGNVQVLLEYHIAYLKEVEQLRMERLQIDEQLRQIGSRSYSGRGRGRRGPNYTSGYGTNSELSNPSETESERKDELSDWSLAGEDDRDSRHQRDSRRRPGGRGRSVSGGRGRGGPRGGKSSISSVLKDPDSNPYSLLDNTESDQTADTDASESHHSTNRRRRSRRRRTDEDAVLMDGMTESDTASVNENGLGKRCD

SEQ ID NO: 5620 - protein, 490 aa, Homo Sapiens
MAELTVEVRGSNGAFYKVYSRANDQEPCGWWLAKVRMMKGEFYVIEYAACDATYNEIVTFERLRPVNQNKTVKKNTFFKCTVDVPEDLREACANENAHKDFKKAVGACRIFYHPETTQLMILSASEATVKRVNILSDMHLRSIRTKLMLMSRNEEATKHLECTKQLAAAFHEEFVVREDLMGLAIGTHGSNIQQARKVPGVTAIELDEDTGTFRIYGESADAVKKARGFLEFVEDFIQVPRNLVGKVIGKNGKVIQEIVDKSGVVRVRIEGDNENKLPREDGMVPFVFVGTKESIGNVQVLLEYHIAYLKEVEQLRMERLQIDEQLRQIGSRSYSGRGRGRRGPNYTSGYGTNSELSNPSETESERKDELSDWSLAGEDDRDSRHQRDSRRRPGGRGRSVSGGRGRGGPRGGKSSISSVLKDPDSNPYSLLDNTESDQTADTDASESHHSTNRRRRSRRRRTDEDAVLMDGMTESDTASVNENGLGKRCD

SEQ ID NO: 5621 - protein, 75 aa, Homo Sapiens
MMKGEFYVIEYAACDATYNEIVTFERLRPVNQNKTVKKNTFFKCTVDVPEDLREACANENAHKDFKKAVGACRIF

SEQ ID NO: 5622 - protein, 94 aa, Homo Sapiens
MMKGEFYVIEYAACDATYNEIVTFERLRPVNQNKTVKKNTFFKCTVDVPEDLREACANENAHKDFKKAVGACRIFYHPETTQLMILSASEATVK

SEQ ID NO: 5623 - protein, 119 aa, Homo Sapiens
MMKGEFYVIEYAACDATYNEIVTFERLRPVNQNKTVKKNTFFKCTVDVPEDLREACANENAHKDFKKAVGACRIFYHPETTQLMILSASEATVKRVNILSDMHLRSIRTKLMLMSRNEE

SEQ ID NO: 5624 - protein, 123 aa, Homo Sapiens
MMKGEFYVIEYAACDATYNEIVTFERLRPVNQNKTVKKNTFFKCTVDVPEDLREACANENAHKDFKKAVGACRIFYHPETTQLMILSASEATVKRVNILSDMHLRSIRTKLMLMSRNEEATKH

SEQ ID NO: 5625 - protein, 536 aa, Homo Sapiens
MMKGEFYVIEYAACDATYNEIVTFERLRPVNQNKTVKKNTFFKCTVDVPEDLREACANENAHKDFKKAVGACRIFYHPETTQLMILSASEATVKRVNILSDMHLRSIRTKLMLMSRNEEATKHLECTKQLAAAFHEEFVVREDLMGLAIGTHGSNIQQARKVPGVTAIELDEDTGTFRIYGESADAVKKARGFLEFVEDFIQVPRNLVGKVIGKNGKVIQEIVDKSGVVRVRIEGDNENKLPREDGMVPFVFVGTKESIGNVQVLLEYHIAYLKEVEQLRMERLQIDEQLRQIGSRSYSGRGRGRRGPNYTSGYGTNSELSNPSETESERKDELSDWSLAGEDDRDSRHQRDSRRRPGGRGRSVSGGRGRGGPRGGKSSISSVLKDPDSNPYSLLDNTESDQTADTDASESHHSTNRRRRSRRRRTDEDAVLMDGMTESDTASVNENGLVTVADYISRAESQSRQRNLPRETLAKNKKEMAKDVIEEHGPSEKAINGPTSASGDDISKLQRTPGEEKINTLKEENTQEAAVLNGVS

SEQ ID NO: 5626 - protein, 454 aa, Homo Sapiens
MMKGEFYVIEYAACDATYNEIVTFERLRPVNQNKTVKKNTFFKCTVDVPEDLREACANENAHKDFKKAVGACRIFYHPETTQLMILSASEATVKRVNILSDMHLRSIRTKLMLMSRNEEATKHLECTKQLAAAFHEEFVVREDLMGLAIGTHGSNIQQARKVPGVTAIELDEDTGTFRIYGESADAVKKARGFLEFVEDFIQVPRNLVGKVIGKNGKVIQEIVDKSGVVRVRIEGDNENKLPREDGMVPFVFVGTKESIGNVQVLLEYHIAYLKEVEQLRMERLQIDEQLRQIGSRSYSGRGRGRRGPNYTSGYGTNSELSNPSETESERKDELSDWSLAGEDDRDSRHQRDSRRRPGGRGRSVSGGRGRGGPRGGKSSISSVLKDPDSNPYSLLDNTESDQTADTDASESHHSTNRRRRSRRRRTDEDAVLMDGMTESDTASVNENGLGKRCD

SEQ ID NO: 5627 - protein, 151 aa, Homo Sapiens
MRAVNILVYFFGFFWWFFNVQGFIKDVHEDSLTVVFENNWQPERQVPFNEVRLPPPPDIKKEISEGDEVEVYSRANDQEPCGWWLAKVRMMKGEFYVIEYAACDATYNEIVTFERLRPVNQNKTVKKNTFFKCTVDVPEDLREACANENAH

SEQ ID NO: 5628 - protein, 608 aa, Homo Sapiens
MVTEGFIKDVHEDSLTVVFENNWQPERQVPFNEVRLPPPPDIKKEISEGDEVEVYSRANDQEPCGWWLAKVRMMKGEFYVIEYAACDATYNEIVTFERLRPVNQNKTVKKNTFFKCTVDVPEDLREACANENAHKDFKKAVGACRIFYHPETTQLMILSASEATVKRVNILSDMHLRSIRTKLMLMSRNEEATKHLECTKQLAAAFHEEFVVREDLMGLAIGTHGSNIQQARKVPGVTAIELDEDTGTFRIYGESADAVKKARGFLEFVEDFIQVPRNLVGKVIGKNGKVIQEIVDKSGVVRVRIEGDNENKLPREDGMVPFVFVGTKESIGNVQVLLEYHIAYLKEVEQLRMERLQIDEQLRQIGSRSYSGRGRGRRGPNYTSGYGTNSELSNPSETESERKDELSDWSLAGEDDRDSRHQRDSRRRPGGRGRSVSGGRGRGGPRGGKSSISSVLKDPDSNPYSLLDNTESDQTADTDASESHHSTNRRRRSRRRRTDEDAVLMDGMTESDTASVNENGLVTVADYISRAESQSRQRNLPRETLAKNKKEMAKDVIEEHGPSEKAINGPTSASGDDISKLQRTPGEEKINTLKEENTQEAAVLNGVS

SEQ ID NO: 5629 - protein, 247 aa, Homo Sapiens
  misc_feature (1)..(1): Xaa can be any naturally occurring amino acid
XTNSELSNPSETESERKDELSDWSLAGEDDRDSRHQRDSRRRPGGRGRSVSGGRGRGGPRGGKSSISSVLKDPDSNPYSLLDNTESDQTADTDASESHHSTNRRRRSRRRRTDEDAVLMDGMTESDTASVNENGLDDSEKKPQRRNRSRRRRFRGQAEDRQPVTVADYISRAESQSRQRNLPRETLAKNKKEMAKDVIEEHGPSEKAINGPTSASGDDISKLQRTPGEEKINTLKEENTQEAAVLNG

SEQ ID NO: 5630 - protein, 144 aa, Homo Sapiens
MGRGYSGALQARGGLEEPLERGLRGPSFTQSPLHGAAAAYLSAQRDASLPVPGQRSDMQKVTLGLLVFLAGFPVLDANDLEDKNSPFYYDWHSLQVGGLICAGVLCAMGIIIVMSAKCKCKFGQKSGHHPGETPPLITPGSAQS

SEQ ID NO: 5631 - protein, 70 aa, Homo Sapiens
MQKVTLGLLVFLAGFPVLDANDLEDKNSPFYYDWHSLQVGGLICAGVLCAMGIIIVMSAKCKCKFGQKSG

SEQ ID NO: 5632 - protein, 87 aa, Homo Sapiens
MQKVTLGLLVFLAGFPVLDANDLEDKNSPFYYDWHSLQVGGLICAGVLCAMGIIIVMSAKCKCKFGQKSGHHPGETPPLITPGSAQS

SEQ ID NO: 5633 - protein, 87 aa, Homo Sapiens; identical to SEQ ID NO: 5632

SEQ ID NO: 5634 - protein, 87 aa, Homo Sapiens; identical to SEQ ID NO: 5632

SEQ ID NO: 5635 - protein, 96 aa, Homo Sapiens
MQKVTLGLLVFLAGFPVLDANDLEDKNSPFYYDWHSLQVGGLICAGVLCAMGIIIVMSEWRSSGEQAGRGWGSPPLTTQLSPTGAKCKCKFGQKSG

SEQ ID NO: 5636 - protein, 113 aa, Homo Sapiens
MQKVTLGLLVFLAGFPVLDANDLEDKNSPFYYDWHSLQVGGLICAGVLCAMGIIIVMSEWRSSGEQAGRGWGSPPLTTQLSPTGAKCKCKFGQKSGHHPGETPPLITPGSAQS

SEQ ID NO: 5637 - protein, 113 aa, Homo Sapiens; identical to SEQ ID NO: 5636

SEQ ID NO: 5638 - protein, 113 aa, Homo Sapiens; identical to SEQ ID NO: 5636

SEQ ID NO: 5639 - protein, 116 aa, Homo Sapiens
MQKVTLGLLVFLAGFPVLDANDLEDKNSPFYYGAPYIFVKRMGGQMERTQAGTEVPSTFLLDWHSLQVGGLICAGVLCAMGIIIVMSAKCKCKFGQKSGHHPGETPPLITPGSAQS

SEQ ID NO: 5640 - protein, 116 aa, Homo Sapiens; identical to SEQ ID NO: 5639

SEQ ID NO: 5641 - protein, 61 aa, Homo Sapiens
MQKVTLGLLVFLAGFPVLDANDLEDKNSPFYYGESPCPLSPPHNPTYCLVPRVPIQGWGLT

SEQ ID NO: 5642 - protein, 61 aa, Homo Sapiens; identical to SEQ ID NO: 5641

SEQ ID NO: 5643 - protein, 844 aa, Homo Sapiens
MGPGAPFARVGWPLPLLVVMAAGVAPVWASHSPHLPRPHSRVPPHPSSERRAVYIGALFPMSGGWPGGQACQPAVEMALEDVNSRRDILPDYELKLIHHDSKCDPGQATKYLYELLYNDPIKIILMPGCSSVSTLVAEAARMWNLIVLSYGSSSPALSNRQRFPTFFRTHPSATLHNPTRVKLFEKWGWKKIATIQQTTEVFTSTLDDLEERVKEAGIEITFRQSFFSDPAVPVKNLKRQDARIIVGLFYETEARKVFCEVYKERLFGKKYVWFLIGWYADNWFKIYDPSINCTVDEMTEAVEGHITTEIVMLNPANTRSISNMTSQEFVEKLTKRLKRHPEETGGFQEAPLAYDAIWALALALNKTSGGGGRSGVRLEDFNYNNQTITDQIYRAMNSSSFEGVSGHVVFDASGSRMAWTLIEQLQGGSYKKIGYYDSTKDDLSWSKTDKWIGGSPPADQTLVIKTFRFLSQKLFISVSVLSSLGIVLAVVCLSFNIYNSHVRYIQNSQPNLNNLTAVGCSLALAAVFPLGLDGYHIGRNQFPFVCQARLWLLGLGFSLGYGSMFTKIWWVHTVFTKKEEKKEWRKTLEPWKLYATVGLLVGMDVLTLAIWQIVDPLHRTIETFAKEEPKEDIDVSILPQLEHCSSRKMNTWLGIFYGYKGLLLLLGIFLAYETKSVSTEKINDHRAVGMAIYNVAVLCLITAPVTMILSSQQDAAFAFASLAIVFSSYITLVVLFVPKMRRLITRGEWQSEAQDTMKTGSSTNNNEEEKSRLLEKENRELEKIIAEKEERVSELRHQLQSRQQLRSRRHPPTPPEPSGGLPRGPPEPPDRLSCDGSRVHLLYK

SEQ ID NO: 5644 - protein, 844 aa, Homo Sapiens; identical to SEQ ID NO: 5643

SEQ ID NO: 5645 - protein, 131 aa, Homo Sapiens
MLLLLLLAPLFLRPPGAGGAQTPNATSEGCQIIHPPWEGGIRYRGLTRDQVKAINFLPVDYEIEYVCRGEREVVGPKVRKCLANGSWTDMDTPSRCGTLPSETQASALPGLQHGQVWEGAGDQAREAGRQW

SEQ ID NO: 5646 - protein, 97 aa, Homo Sapiens
MLLLLLLAPLFLRPPGAGGAQTPNATSEGCQIIHPPWEGGIRYRGLTRDQVKAINFLPVDYEIEYVCRGEREVVGPKVRKCLANGSWTDMDTPSRCV

SEQ ID NO: 5647 - protein, 899 aa, Homo Sapiens
MLLLLLLAPLFLRPPGAGGAQTPNATSEGCQIIHPPWEGGIRYRGLTRDQVKAINFLPVDYEIEYVCRGEREVVGPKVRKCLANGSWTDMDTPSRCVNRTPHSERRAVYIGALFPMSGGWPGGQACQPAVEMALEDVNSRRDILPDYELKLIHHDSKCDPGQATKYLYELLYNDPIKIILMPGCSSVSTLVAEAARMWNLIVLSYGSSSPALSNRQRFPTFFRTHPSATLHNPTRVKLFEKWGWKKIATIQQTTEVFTSTLDDLEERVKEAGIEITFRQSFFSDPAVPVKNLKRQDARIIVGLFYETEARKVFCEVYKERLFGKKYVWFLIGWYADNWFKIYDPSINCTVDEMTEAVEGHITTEIVMLNPANTRSISNMTSQEFVEKLTKRLKRHPEETGGFQEAPLAYDAIWALALALNKTSGGGGRSGVRLEDFNYNNQTITDQIYRAMNSSSFEGVSGHVVFDASGSRMAWTLIEQLQGGSYKKIGYYDSTKDDLSWSKTDKWIGGSPPADQTLVIKTFRFLSQKLFISVSVLSSLGIVLAVVCLSFNIYNSHVRYIQNSQPNLNNLTAVGCSLALAAVFPLGLDGYHIGRNQFPFVCQARLWLLGLGFSLGYGSMFTKIWWVHTVFTKKEEKKEWRKTLEPWKLYATVGLLVGMDVLTLAIWQIVDPLHRTIETFAKEEPKEDIDVSILPQLEHCSSRKMNTWLGIFYGYKGLLLLLGIFLAYETKSVSTEKINDHRAVGMAIYNVAVLCLITAPVTMILSSQQDAAFAFASLAIVFSSYITLVVLFVPKMRRLITRGEWQSEAQDTMKTGSSTNNNEEEKSRLLEKENRELEKIIAEKEERVSELRHQLQSRQQLRSRRHPPTPPEPSGGLPRGPPEPPDRLSCDGSRVHLLYK

SEQ ID NO: 5648 - protein, 137 aa, Homo Sapiens
MLLLLLLAPLFLRPPGAGGAQTPNATSEGCQIIHPPWEGGIRYRGLTRDQVKAINFLPVDYEIEYVCRGEREVVGPKVRKCLANGSWTDMDTPSRCVRICSKSYLTLENGKVFLTGGDLPALDGARVDFRCDPDFHL

SEQ ID NO: 5649 - protein, 156 aa, Homo Sapiens
MLLLLLLAPLFLRPPGAGGAQTPNATSEGCQIIHPPWEGGIRYRGLTRDQVKAINFLPVDYEIEYVCRGEREVVGPKVRKCLANGSWTDMDTPSRCVRICSKSYLTLENGKVFLTGGDLPALDGARVDFRCDPDFHLVGSSRSICSQGQWSTPKPH

SEQ ID NO: 5650 - protein, 193 aa, Homo Sapiens
MLLLLLLAPLFLRPPGAGGAQTPNATSEGCQIIHPPWEGGIRYRGLTRDQVKAINFLPVDYEIEYVCRGEREVVGPKVRKCLANGSWTDMDTPSRCVRICSKSYLTLENGKVFLTGGDLPALDGARVDFRCDPDFHLVGSSRSICSQGQWSTPKPHCQGTLPSETQASALPGLQHGQVWEGAGDQAREAGRQW

SEQ ID NO: 5651 - protein, 961 aa, Homo Sapiens
MLLLLLLAPLFLRPPGAGGAQTPNATSEGCQIIHPPWEGGIRYRGLTRDQVKAINFLPVDYEIEYVCRGEREVVGPKVRKCLANGSWTDMDTPSRCVRICSKSYLTLENGKVFLTGGDLPALDGARVDFRCDPDFHLVGSSRSICSQGQWSTPKPHCQVNRTPHSERRAVYIGALFPMSGGWPGGQACQPAVEMALEDVNSRRDILPDYELKLIHHDSKCDPGQATKYLYELLYNDPIKIILMPGCSSVSTLVAEAARMWNLIVLSYGSSSPALSNRQRFPTFFRTHPSATLHNPTRVKLFEKWGWKKIATIQQTTEVFTSTLDDLEERVKEAGIEITFRQSFFSDPAVPVKNLKRQDARIIVGLFYETEARKVFCEVYKERLFGKKYVWFLIGWYADNWFKIYDPSINCTVDEMTEAVEGHITTEIVMLNPANTRSISNMTSQEFVEKLTKRLKRHPEETGGFQEAPLAYDAIWALALALNKTSGGGGRSGVRLEDFNYNNQTITDQIYRAMNSSSFEGVSGHVVFDASGSRMAWTLIEQLQGGSYKKIGYYDSTKDDLSWSKTDKWIGGSPPADQTLVIKTFRFLSQKLFISVSVLSSLGIVLAVVCLSFNIYNSHVRYIQNSQPNLNNLTAVGCSLALAAVFPLGLDGYHIGRNQFPFVCQARLWLLGLGFSLGYGSMFTKIWWVHTVFTKKEEKKEWRKTLEPWKLYATVGLLVGMDVLTLAIWQIVDPLHRTIETFAKEEPKEDIDVSILPQLEHCSSRKMNTWLGIFYGYKGLLLLLGIFLAYETKSVSTEKINDHRAVGMAIYNVAVLCLITAPVTMILSSQQDAAFAFASLAIVFSSYITLVVLFVPKMRRLITRGEWQSEAQDTMKTGSSTNNNEEEKSRLLEKENRELEKIIAEKEERVSELRHQLQSRQQLRSRRHPPTPPEPSGGLPRGPPEPPDRLSCDGSRVHLLYK

SEQ ID NO: 5652 - protein, 578 aa, Homo Sapiens
MLLLLLLAPLFLRPPGAGGAQTPNATSEGCQIIHPPWEGGIRYRGLTRDQVKAINFLPVDYEIEYVCRGEREVVGPKVRKCLANGSWTDMDTPSRCVRICSKSYLTLENGKVFLTGGDLPALDGARVDFRCDPDFHLVGSSRSICSQGQWSTPKPHCQVNRTPHSERRAVYIGALFPMSGGWPGGQACQPAVEMALEDVNSRRDILPDYELKLIHHDSKCDPGQATKYLYELLYNDPIKIILMPGCSSVSTLVAEAARMWNLIVLSYGSSSPALSNRQRFPTFFRTHPSATLHNPTRVKLFEKWGWKKIATIQQTTEVFTSTLDDLEERVKEAGIEITFRQSFFSDPAVPVKNLKRQDARIIVGLFYETEARKVFCEVYKERLFGKKYVWFLIGWYADNWFKIYDPSINCTVDEMTEAVEGHITTEIVMLNPANTRSISNMTSQEFVEKLTKRLKRHPEETGGFQEAPLAYDAIWALALALNKTSGGGGRSGVRLEDFNYNNQTITDQIYRAMNSSSFEGVSGHVVFDASGSRMAWTLIEQLQGGSYKKIGYYDSTKDDLSWSKTDKWIVISRTHSPT

SEQ ID NO: 5653 - protein, 578 aa, Homo Sapiens; identical to SEQ ID NO: 5652

SEQ ID NO: 5654 - protein, 133 aa, Homo Sapiens
MPGAWMLLLLLLAPLFLRPPGAGGAQTPNATSEGCQIIHPPWEGGIRYRGLTRDQVKAINFLPVDYEIEYVCRGEREVVGPKVRKCLANGSWTDMDTPSRCVRICSKSYLTLENGKVFLTGGDLPALDGARVD

SEQ ID NO: 5655 - protein, 70 aa, Homo Sapiens
MRKSPGLSDCLWAWILLLSTLTGRRTSRKSHQNTDLYEVNEGKDVAMDSRHYKMNLKTIPLSSPGFWTDS

SEQ ID NO: 5656 - protein, 35 aa, Homo Sapiens
MRKSPGLSDCLWAWILLLSTLTGRSYGQPSLQDEL

SEQ ID NO: 5657 - protein, 85 aa, Homo Sapiens
MRKSPGLSDCLWAWILLLSTLTGRSYGQPSLQDELKDNTTVFTRILDRLLDGYDNRLRPGLGERVTEVKTDIFVTSFGPVSDHDM

SEQ ID NO: 5658 - protein, 168 aa, Homo Sapiens
MRKSPGLSDCLWAWILLLSTLTGRSYGQPSLQDELKDNTTVFTRILDRLLDGYDNRLRPGLGERVTEVKTDIFVTSFGPVSDHDMEYTIDVFFRQSWKDERLKFKGPMTVLRLNNLMASKIWTPDTFFHNGKKSVAHNMTMPNKLLRITEDGTLLYTMRLTVRAECPM

SEQ ID NO: 5659 - protein, 456 aa, Homo Sapiens
MRKSPGLSDCLWAWILLLSTLTGRSYGQPSLQDELKDNTTVFTRILDRLLDGYDNRLRPGLGERVTEVKTDIFVTSFGPVSDHDMEYTIDVFFRQSWKDERLKFKGPMTVLRLNNLMASKIWTPDTFFHNGKKSVAHNMTMPNKLLRITEDGTLLYTMRLTVRAECPMHLEDFPMDAHACPLKFGSYAYTRAEVVYEWTREPARSVVVAEDGSRLNQYDLLGQTVDSGIVQSSTGEYVVMTTHFHLKRKIGYFVIQTYLPCIMTVILSQVSFWLNRESVPARTVFGVTTVLTMTTLSISARNSLPKVAYATAMDWFIAVCYAFVFSALIEFATVNYFTKRGYAWDGKSVVPEKPKKVKDPLIKKNNTYAPTATSYTPNLARGDPGLATIAKSATIEPKEVKPETKPPEPKKTFNSVSKIDRLSRIAFPLLFGIFNLVYWATYLNREPQLKAPTPHQ

SEQ ID NO: 5660 - protein, 456 aa, Homo Sapiens; identical to SEQ ID NO: 5659

SEQ ID NO: 5661 - protein, 456 aa, Homo Sapiens; identical to SEQ ID NO: 5659

SEQ ID NO: 5662 - protein, 456 aa, Homo Sapiens; identical to SEQ ID NO: 5659

SEQ ID NO: 5663 - protein, 456 aa, Homo Sapiens; identical to SEQ ID NO: 5659

SEQ ID NO: 5664 - protein, 456 aa, Homo Sapiens; identical to SEQ ID NO: 5659

SEQ ID NO: 5665 - protein, 285 aa, Homo Sapiens
MRKSPGLSDCLWAWILLLSTLTGRSYGQPSLQDELKDNTTVFTRILDRLLDGYDNRLRPGLGERVTEVKTDIFVTSFGPVSDHDMEYTIDVFFRQSWKDERLKFKGPMTVLRLNNLMASKIWTPDTFFHNGKKSVAHNMTMPNKLLRITEDGTLLYTMRLTVRAECPMHLEDFPMDAHACPLKFGSYAYTRAEVVYEWTREPARSVVVAEDGSRLNQYDLLGQTVDSGIVQSSTGEYVVMTTHFHLKRKIGYFVIQTYLPCIMTVILSQVSFWLNRESVPARTVF

SEQ ID NO: 5666 - protein, 456 aa, Homo Sapiens; identical to SEQ ID NO: 5659

SEQ ID NO: 5667 - protein, 456 aa, Homo Sapiens; identical to SEQ ID NO: 5659

SEQ ID NO: 5668 - protein, 94 aa, Homo Sapiens
MRKSPGLSDCLWAWILLLSTLTGRSYGQPSLQDELKDNTTVFTRILDRLLDGYDNRLRPGLGERVTEVKTDIFVTSFGPVSDHDMIFALQNTAQ

SEQ ID NO: 5669 - protein, 471 aa, Homo Sapiens
MVQVSIASNELLQPAMRKSPGLSDCLWAWILLLSTLTGRSYGQPSLQDELKDNTTVFTRILDRLLDGYDNRLRPGLGERVTEVKTDIFVTSFGPVSDHDMEYTIDVFFRQSWKDERLKFKGPMTVLRLNNLMASKIWTPDTFFHNGKKSVAHNMTMPNKLLRITEDGTLLYTMRLTVRAECPMHLEDFPMDAHACPLKFGSYAYTRAEVVYEWTREPARSVVVAEDGSRLNQYDLLGQTVDSGIVQSSTGEYVVMTTHFHLKRKIGYFVIQTYLPCIMTVILSQVSFWLNRESVPARTVFGVTTVLTMTTLSISARNSLPKVAYATAMDWFIAVCYAFVFSALIEFATVNYFTKRGYAWDGKSVVPEKPKKVKDPLIKKNNTYAPTATSYTPNLARGDPGLATIAKSATIEPKEVKPETKPPEPKKTFNSVSKIDRLSRIAFPLLFGIFNLVYWATYLNREPQLKAPTPHQ

SEQ ID NO: 5670 - protein, 113 aa, Homo Sapiens
MVQVSIASNEVSYPSELLQPAMRKSPGLSDCLWAWILLLSTLTGRSYGQPSLQDELKDNTTVFTRILDRLLDGYDNRLRPGLGERVTEVKTDIFVTSFGPVSDHDMEYTIDVF

SEQ ID NO: 5671 - protein, 427 aa, Homo Sapiens
MEYTIDVFFRQKWKDERLKFKGPMNILRLNNLMASKIWTPDTFFHNGKKSVAHNMTMPNKLLRIQDDGTLLYTMRLTVQAECPMHLEDFPMDAHSCPLKFGSYAYTTSEVTYIWTYNASDSVQVAPDGSRLNQYDLLGQSIGKETIKSSTGEYTVMTAHFHLKRKIGYFVIQTYLPCIMTVILSQVSFWLNRESVPARTVFGVTTVLTMTTLSISARNSLPKVAYATAMDWFIAVCYAFVFSALIEFATVNYFTKRGWAWDGKSVVNDKSPSIKAEGITLTYNSVKAILQGAKLIWSKYIAFSWPSLFQEKTLEYLEKWMDCLTFKQSSKKEKASVMIQNNAYAVAVANYAPNLSKDPVLSTISKSATTPEPNKKPENKPAEAKKTFNSVSKIDRMSRIVFPVLFGTFNLVYWATYLNREPVLGVSP

SEQ ID NO: 5672 - protein, 137 aa, Homo Sapiens
MKTKLNIYNMQFLLFVFLVWDPARLVLANIQEDEAKNNITIFTRILDRLLDGYDNRLRPGLGDSITEVFTNIYVTSFGPVSDTDMEYTIDVFFRQKWKDERLKFKGPMNILRLNNLMASKIWTPDTFFHNGKKSVAH

SEQ ID NO: 5673 - protein, 152 aa, Homo Sapiens
MKTKLNIYNMQFLLFVFLVWDPARLVLANIQEDEAKNNITIFTRILDRLLDGYDNRLRPGLGDSITEVFTNIYVTSFGPVSDTDMEYTIDVFFRQKWKDERLKFKGPMNILRLNNLMASKIWTPDTFFHNGKKSVAHNMTMPNKLLRIQDDG

SEQ ID NO: 5674 - protein, 159 aa, Homo Sapiens
MKTKLNIYNMQFLLFVFLVWDPARLVLANIQEDEAKNNITIFTRILDRLLDGYDNRLRPGLGDSITEVFTNIYVTSFGPVSDTDMEYTIDVFFRQKWKDERLKFKGPMNILRLNNLMASKIWTPDTFFHNGKKSVAHNMTMPNKLLRIQDDGTLLYTMR

SEQ ID NO: 5675 - protein, 451 aa, Homo Sapiens
MKTKLNIYNMQFLLFVFLVWDPARLVLANIQEDEAKNNITIFTRILDRLLDGYDNRLRPGLGDSITEVFTNIYVTSFGPVSDTDMEYTIDVFFRQKWKDERLKFKGPMNILRLNNLMASKIWTPDTFFHNGKKSVAHNMTMPNKLLRIQDDGTLLYTMRLTVQAECPMHLEDFPMDAHSCPLKFGSYAYTTSEVTYIWTYNASDSVQVAPDGSRLNQYDLLGQSIGKETIKSSTGEYTVMTAHFHLKRKIGYFVIQTYLPCIMTVILSQVSFWLNRESVPARTVFGVTTVLTMTTLSISARNSLPKVAYATAMDWFIAVCYAFVFSALIEFATVNYFTKRGWAWDGKSVVNDKKKEKASVMIQNNAYAVAVANYAPNLSKDPVLSTISKSATTPEPNKKPENKPAEAKKTFNSVSKIDRMSRIVFPVLFGTFNLVYWATYLNREPVLGVSP

SEQ ID NO: 5676 - protein, 451 aa, Homo Sapiens; identical to SEQ ID NO: 5675

SEQ ID NO: 5677 - protein, 511 aa, Homo Sapiens
MKTKLNIYNMQFLLFVFLVWDPARLVLANIQEDEAKNNITIFTRILDRLLDGYDNRLRPGLGDSITEVFTNIYVTSFGPVSDTDMEYTIDVFFRQKWKDERLKFKGPMNILRLNNLMASKIWTPDTFFHNGKKSVAHNMTMPNKLLRIQDDGTLLYTMRLTVQAECPMHLEDFPMDAHSCPLKFGSYAYTTSEVTYIWTYNASDSVQVAPDGSRLNQYDLLGQSIGKETIKSSTGEYTVMTAHFHLKRKIGYFVIQTYLPCIMTVILSQVSFWLNRESVPARTVFGVTTVLTMTTLSISARNSLPKVAYATAMDWFIAVCYAFVFSALIEFATVNYFTKRGWAWDGKSVVNDKSPSIKAEGITLTYNSVKAILQGAKLIWSKYIAFSWPSLFQEKTLEYLEKWMDCLTFKQSSKKEKASVMIQNNAYAVAVANYAPNLSKDPVLSTISKSATTPEPNKKPENKPAEAKKTFNSVSKIDRMSRIVFPVLFGTFNLVYWATYLNREPVLGVSP

SEQ ID NO: 5678 - protein, 451 aa, Homo Sapiens; identical to SEQ ID NO: 5675

SEQ ID NO: 5679 - protein, 367 aa, Homo Sapiens
MKTKLNIYNMQFLLFVFLVWDPARLVLANIQEDEAKNNITIFTRILDRLLDGYDNRLRPGLGDSITEVFTNIYVTSFGPVSDTDMEYTIDVFFRQKWKDERLKFKGPMNILRLNNLMASKIWTPDTFFHNGKKSVAHNMTMPNKLLRIQDDGTLLYTMRLTVQAECPMHLEDFPMDAHSCPLKFGSYAYTTSEVTYIWTYNASDSVQVAPDGSRLNQYDLLGQSIGKETIKSSTGEYTVMTAHFHLKRKIGYFVIQTYLPCIMTVILSQVSFWLNRESVPARTVFGVTTVLTMTTLSISARNSLPKVAYATAMDWFIAVCYAFVFSALIEFATVNYFTKRGWAWDGKSVVNDKVSESFRVIIIKKIP

SEQ ID NO: 5680 - protein, 451 aa, Homo Sapiens; identical to SEQ ID NO: 5675

SEQ ID NO: 5681 - protein, 66 aa, Homo Sapiens
MKTKLNIYNMQFLLFVFLVWDPARLVLANIQEDEAKNNITIFTRILDRLLDGYDNRLRPGLGGIYN

SEQ ID NO: 5682 - protein, 66 aa, Homo Sapiens; identical to SEQ ID NO: 5681

SEQ ID NO: 5683 - protein, 66 aa, Homo Sapiens; identical to SEQ ID NO: 5681

SEQ ID NO: 5684 - protein, 73 aa, Homo Sapiens
MKTKLNIYNMQFLLFVFLVWDPARLVLANIQEDEAKNNITIFTRILDRLLDGYDNRLRPGLGVSRVESPVCVT

SEQ ID NO: 5685 - protein, 56 aa, Homo Sapiens
SSTGEYTVMTAHFHLKRKIGYFVIQTYLPCIMTVILSQVSFWLNRESVPARTVFGE

SEQ ID NO: 5686 - protein, 16 aa, Homo Sapiens
MDNGMFSGFIMIKNLL

SEQ ID NO: 5687 - protein, 86 aa, Homo Sapiens
MDNGMFSGFIMIKNLLLFCISMNLSSHFGFSQMPTSSVKDETNDNITIFTRILDGLLDGYDNRLRPGLGERITQVRTDIYVTSFGP

SEQ ID NO: 5688 - protein, 149 aa, Homo Sapiens
MDNGMFSGFIMIKNLLLFCISMNLSSHFGFSQMPTSSVKDETNDNITIFTRILDGLLDGYDNRLRPGLGERITQVRTDIYVTSFGPVSDTEMEYTIDVFFRQSWKDERLRFKGPMQRLPLNNLLASKIWTPDTFFHNGKKSIAHNMTTP

SEQ ID NO: 5689 - protein, 166 aa, Homo Sapiens
MDNGMFSGFIMIKNLLLFCISMNLSSHFGFSQMPTSSVKDETNDNITIFTRILDGLLDGYDNRLRPGLGERITQVRTDIYVTSFGPVSDTEMEYTIDVFFRQSWKDERLRFKGPMQRLPLNNLLASKIWTPDTFFHNGKKSIAHNMTTPNKLLRLEDDGTLLYTMR

SEQ ID NO: 5690 - protein, 462 aa, Homo Sapiens
MDNGMFSGFIMIKNLLLFCISMNLSSHFGFSQMPTSSVKDETNDNITIFTRILDGLLDGYDNRLRPGLGERITQVRTDIYVTSFGPVSDTEMEYTIDVFFRQSWKDERLRFKGPMQRLPLNNLLASKIWTPDTFFHNGKKSIAHNMTTPNKLLRLEDDGTLLYTMRLTISAECPMQLEDFPMDAHACPLKFGSYAYPNSEVVYVWTNGSTKSVVVAEDGSRLNQYHLMGQTVGTENISTSTGEYTIMTAHFHLKRKIGYFVIQTYLPCIMTVILSQVSFWLNRESVPARTVFGVTTVLTMTTLSISARNSLPKVAYATAMDWFIAVCYAFVFSALIEFATVNYFTKRGWAWDGKKALEAAKIKKKREVILNKSTNAFTTGKMSHPPNIPKEQTPAGTSNTTSVSVKPSEEKTSESKKTYNSISKIDKMSRIVFPVLFGTFNLVYWATYLNREPVIKGAASPK

SEQ ID NO: 5691 - protein, 462 aa, Homo Sapiens; identical to SEQ ID NO: 5690

SEQ ID NO: 5692 - protein, 462 aa, Homo Sapiens; identical to SEQ ID NO: 5690

SEQ ID NO: 5693 - protein, 86 aa, Homo Sapiens
MPTSSVKDETNDNITIFTRILDGLLDGYDNRLRPGLGERITQVRTDIYVTSFGPVSDTEMEYTIDVFFRQSWKDERLRFKGPMQRL

SEQ ID NO: 5694 - protein, 166 aa, Homo Sapiens
MPTSSVKDETNDNITIFTRILDGLLDGYDNRLRPGLGERITQVRTDIYVTSFGPVSDTEMEYTIDVFFRQSWKDERLRFKGPMQRLPLNNLLASKIWTPDTFFHNGKKSIAHNMTTPNKLLRLEDDGTLLYTMRLTISAECPMQLEDFPMDAHACPLKFGSYAYPN

SEQ ID NO: 5695 - protein, 258 aa, Homo Sapiens
EAGVRGTEEDGCWVCNLESVSQSQTWQENKLSEYQIDIFFAQTWTDSRLRFNSTMKILTLNSNMVGLIWIPDTIFRNSKTAEAHWITTPNQLLRIWNDGKILYTLRLTINAECQLQLHNFPMDEHSCPLIFSSYGYPKEEMIYRWRKNSVEAADQKSWRLYQFDFMGLRNTTEIVTTSAGDYVVMTIYFELSRRMGYFTIQTYIPCILTVVLSWVSFWIKKDATPARTALGITTVLTMTTLSTIARKSLPRVSYVTAM

SEQ ID NO: 5696 - protein, 467 aa, Homo Sapiens
MAPKLLLLLCLFSGLHARSRKVEEDEYEDSSSNQKWVLAPKSQDTDVTLILNKLLREYDKKLRPDIGIKPTVIDVDIYVNSIGPVSSINMEYQIDIFFAQTWTDSRLRFNSTMKILTLNSNMVGLIWIPDTIFRNSKTAEAHWITTPNQLLRIWNDGKILYTLRLTINAECQLQLHNFPMDEHSCPLIFSSYGYPKEEMIYRWRKNSVEAADQKSWRLYQFDFMGLRNTTEIVTTSAGDYVVMTIYFELSRRMGYFTIQTYIPCILTVVLSWVSFWIKKDATPARTALGITTVLTMTTLSTIARKSLPRVSYVTAMDLFVTVCFLFVFAALMEYATLNYYSSCRKPTTTKKTTSLLHPDSSRWIPERISLQAPSNYSLLDMRPPPTAMITLNNSVYWQEFEDTCVYECLDGKDCQSFFCCYEECKSGSWRKGRIHIDILELDSYSRVFFPTSFLLFNLVYWVGYLYL

SEQ ID NO: 5697 - protein, 253 aa, Homo Sapiens
MAPKLLLLLCLFSGLHARSRKVEEDEYEDSSSNQKWVLAPKSQDTDVTLILNKLLREYDKKLRPDIGIKPTVIDVDIYVNSIGPVSSINMEYQIDIFFAQTWTDSRLRFNSTMKILTLNSNMVGLIWIPDTIFRNSKTAEAHWITTPNQLLRIWNDGKILYTLRLTINAECQLQLHNFPMDEHSCPLIFSSYGYPKEEMIYRWRKNSVEAADQKSWRLYQFDFMGLRNTTEIVTTSAGRNLLKEAQLSKAREA

SEQ ID NO: 5698 - protein, 288 aa, Homo Sapiens
MDEHSCPLIFSSYGYPKEEMIYRWRKNSVEAADQKSWRLYQFDFMGLRNTTEIVTTSAGDYVVMTIYFELSRRMGYFTIQTYIPCILTVVLSWVSFWIKKDATPARTALGITTVLTMTTLSTIARKSLPRVSYVTAMDLFVTVCFLFVFAALMEYATLNYYSSCRKPTTTKKTTSLLHPDSSRWIPERISLQAPSNYSLLDMRPPPTAMITLNNSVYWQEFEDTCVYECLDGKDCQSFFCCYEECKSGSWRKGRIHIDILELDSYSRVFFPTSFLLFNLVYWVGYLYL

SEQ ID NO: 5699 - protein, 38 aa, Homo Sapiens
  misc_feature (1)..(1): Xaa can be any naturally occurring amino acid
XAECQLQLHNFPMDEHSCPLIFSSSTILAFRLSLHAYR

SEQ ID NO: 5700 - protein, 169 aa, Homo Sapiens
  misc_feature (1)..(1): Xaa can be any naturally occurring amino acid
XDYVVMTIYFELSRRMGYFTIQTYIPCILTVVLSWVSFWIKKDATPARTALGITTVLTMTTLSTIARKSLPRVSYVTAMDLFVTVCFLFVFAALMEYATLNYYSSCRKPTTTKKTTSLLHPDSSRWIPERISLQAPSKPSCCPACGLQGLPFRSLVSHPRISRAFCLPV

SEQ ID NO: 5701 - protein, 52 aa, Homo Sapiens
MNYSLHLAFVCLSLFTERMCIQGSQFNVEVGRSDKLSLPGFENLTAGYNKFL

SEQ ID NO: 5702 - protein, 59 aa, Homo Sapiens
MNYSLHLAFVCLSLFTERMCIQGSQFNVEVGRSDKLSLPGFENLTAGYNKFLRPNFGGE

SEQ ID NO: 5703 - protein, 92 aa, Homo Sapiens
MNYSLHLAFVCLSLFTERMCIQGSQFNVEVGRSDKLSLPGFENLTAGYNKFLRPNFGGEPVQIALTLDIASISSISESNMDYTATIYLRQRW

SEQ ID NO: 5704 - protein, 171 aa, Homo Sapiens
MNYSLHLAFVCLSLFTERMCIQGSQFNVEVGRSDKLSLPGFENLTAGYNKFLRPNFGGEPVQIALTLDIASISSISESNMDYTATIYLRQRWMDQRLVFEGNKSFTLDARLVEFLWVPDTYIVESKKSFLHEVTVGNRLIRLFSNGTVLYALRITTTVACNMDLSKYPMDT

SEQ ID NO: 5705 - protein, 189 aa, Homo Sapiens
MNYSLHLAFVCLSLFTERMCIQGSQFNVEVGRSDKLSLPGFENLTAGYNKFLRPNFGGEPVQIALTLDIASISSISESNMDYTATIYLRQRWMDQRLVFEGNKSFTLDARLVEFLWVPDTYIVESKKSFLHEVTVGNRLIRLFSNGTVLYALRITTTVACNMDLSKYPMDTQTCKLQLESWGYDGNDVE

SEQ ID NO: 5706 - protein, 440 aa, Homo Sapiens
MNYSLHLAFVCLSLFTERMCIQGSQFNVEVGRSDKLSLPGFENLTAGYNKFLRPNFGGEPVQIALTLDIASISSISESNMDYTATIYLRQRWMDQRLVFEGNKSFTLDARLVEFLWVPDTYIVESKKSFLHEVTVGNRLIRLFSNGTVLYALRITTTVACNMDLSKYPMDTQTCKLQLESWGYDGNDVEFTWLRGNDSVRGLEHLRLAQYTIERYFTLVTRSQQETGNYTRLVLQFELRRNVLYFILETYVPSTFLVVLSWVSFWISLDSVPARTCIGVTTVLSMTTLMIGSRTSLPNTNCFIKAIDVYLGICFSFVFGALLEYAVAHYSSLQQMAAKDRGTTKEVEEVSITNIINSSISSFKRKISFASIEISSDNVDYSDLTMKTSDKFKFVFREKMGRIVDYFTIQNPSNVDHYSKLLFPLIFMLANVFYWAYYMYF

SEQ ID NO: 5707 - protein, 440 aa, Homo Sapiens; identical to SEQ ID NO: 5706

SEQ ID NO: 5708 - protein, 349 aa, Homo Sapiens
MNYSLHLAFVCLSLFTERMCIQGSQFNVEVGRSDKLSLPGFENLTAGYNKFLRPNFGGEPVQIALTLDIASISSISESNMDYTATIYLRQRWMDQRLVFEGNKSFTLDARLVEFLWVPDTYIVESKKSFLHEVTVGNRLIRLFSNGTVLYALRITTTVACNMDLSKYPMDTQTCKLQLESWGYDGNDVEFTWLRGNDSVRGLEHLRLAQYTIERYFTLVTRSQQETGNYTRLVLQFELRRNVLYFILETYVPSTFLVVLSWVSFWISLDSVPARTCIGVTTVLSMTTLMIGSRTSLPNTNCFIKAIDVYLGICFSFVFGALLEYAVAHYSSLQQMAAKDRQKICYLYAA

SEQ ID NO: 5709 - protein, 289 aa, Homo Sapiens
MNYSLHLAFVCLSLFTERMCIQGSQFNVEVGRSDKLSLPGFENLTAGYNKFLRPNFGGEPVQIALTLDIASISSISESNMDYTATIYLRQRWMDQRLVFEGNKSFTLDARLVEFLWVPDTYIVESKKSFLHEVTVGNRLIRLFSNGTVLYALRITTTVACNMDLSKYPMDTQTCKLQLESWGYDGNDVEFTWLRGNDSVRGLEHLRLAQYTIERYFTLVTRSQQETGNYTRLVLQFELRRNVLYFILETYVPSTFLVVLSWVSFWISLDSVPARTCIGDNKGSRRSQYY

SEQ ID NO: 5710 - protein, 123 aa, Homo Sapiens
MARGSALLLASLLLAAALSASAGLWSPAKEKRGWTLNSAGYLLGPHAVGNHRSFSDKNGLTSKRELRPEDDMKPGSFDRSIPENNIMRTIIEFLSFLHLKEAGALDRLLDLPAAASSEDIERS

SEQ ID NO: 5711 - protein, 113 aa, Homo Sapiens
MLPPQKKPWESMAKGLVLGALFTSFLLLVYSYAVPPLHAGLASTRTPEAAASCSPPALEPEAVIRANGSAGECQPRRNIVFLKTHKTASSTLLNILFRFGQKHRLKFAFPNGR

SEQ ID NO: 5712 - protein, 164 aa, Homo Sapiens
MLPPQKKPWESMAKGLVLGALFTSFLLLVYSYAVPPLHAGLASTRTPEAAASCSPPALEPEAVIRANGSAGECQPRRNIVFLKTHKTASSTLLNILFRFGQKHRLKFAFPNGRNDFDYPTFFARSLVQDYRPGACFNIICNHMRFHYDEVRGLVPTNAIFITVL

SEQ ID NO: 5713 - protein, 265 aa, Homo Sapiens
MLPPQKKPWESMAKGLVLGALFTSFLLLVYSYAVPPLHAGLASTRTPEAAASCSPPALEPEAVIRANGSAGECQPRRNIVFLKTHKTASSTLLNILFRFGQKHRLKFAFPNGRNDFDYPTFFARSLVQDYRPGACFNIICNHMRFHYDEVRGLVPTNAIFITVLRDPARLFESSFHYFGPVVPLTWKLSAGDKLTEFLQDPDRYYDPNGFNAHYLRNLLFFDLGYDNSLDPSSPQVQEHILEVERRFHLVLLQEYFDESLVLLKD

SEQ ID NO: 5714 - protein, 71 aa, Homo Sapiens
MLPPQKKPWESMAKGLVLGALFTSFLLLVYSYAVPPLHAGLASTTPEAAASCSPPALEPEAVIRANGSAGE

SEQ ID NO: 5715 - protein, 76 aa, Homo Sapiens
MLPPQKKPWESMAKGLVLGALFTSFLLLVYSYAVPPLHAGLASTTPEAAASCSPPALEPEAVIRANGSAGECQPRR

SEQ ID NO: 5716 - protein, 85 aa, Homo Sapiens
MLPPQKKPWESMAKGLVLGALFTSFLLLVYSYAVPPLHAGLASTTPEAAASCSPPALEPEAVIRANGSAGECQPRRNIVFLKTHK

SEQ ID NO: 5717 - protein, 95 aa, Homo Sapiens
MLPPQKKPWESMAKGLVLGALFTSFLLLVYSYAVPPLHAGLASTTPEAAASCSPPALEPEAVIRANGSAGECQPRRNIVFLKTHKTASSTLLNIL

SEQ ID NO: 5718 - protein, 99 aa, Homo Sapiens
MLPPQKKPWESMAKGLVLGALFTSFLLLVYSYAVPPLHAGLASTTPEAAASCSPPALEPEAVIRANGSAGECQPRRNIVFLKTHKTASSTLLNILFRFG

SEQ ID NO: 5719 - protein, 100 aa, Homo Sapiens
MLPPQKKPWESMAKGLVLGALFTSFLLLVYSYAVPPLHAGLASTTPEAAASCSPPALEPEAVIRANGSAGECQPRRNIVFLKTHKTASSTLLNILFRFGQ

SEQ ID NO: 5720 - protein, 103 aa, Homo Sapiens
MLPPQKKPWESMAKGLVLGALFTSFLLLVYSYAVPPLHAGLASTTPEAAASCSPPALEPEAVIRANGSAGECQPRRNIVFLKTHKTASSTLLNILFRFGQKHR

SEQ ID NO: 5721 - protein, 143 aa, Homo Sapiens
MLPPQKKPWESMAKGLVLGALFTSFLLLVYSYAVPPLHAGLASTTPEAAASCSPPALEPEAVIRANGSAGECQPRRNIVFLKTHKTASSTLLNILFRFGQKHRLKFAFPNGRNDFDYPTFFARSLVQDYRPGACFNIICNHMR

SEQ ID NO: 5722 - protein, 149 aa, Homo Sapiens
MLPPQKKPWESMAKGLVLGALFTSFLLLVYSYAVPPLHAGLASTTPEAAASCSPPALEPEAVIRANGSAGECQPRRNIVFLKTHKTASSTLLNILFRFGQKHRLKFAFPNGRNDFDYPTFFARSLVQDYRPGACFNIICNHMRFHYDEV

SEQ ID NO: 5723 - protein, 170 aa, Homo Sapiens
MLPPQKKPWESMAKGLVLGALFTSFLLLVYSYAVPPLHAGLASTTPEAAASCSPPALEPEAVIRANGSAGECQPRRNIVFLKTHKTASSTLLNILFRFGQKHRLKFAFPNGRNDFDYPTFFARSLVQDYRPGACFNIICNHMRFHYDEVRGLVPTNAIFITVLRDPARLF

SEQ ID NO: 5724 - protein, 199 aa, Homo Sapiens
MLPPQKKPWESMAKGLVLGALFTSFLLLVYSYAVPPLHAGLASTTPEAAASCSPPALEPEAVIRANGSAGECQPRRNIVFLKTHKTASSTLLNILFRFGQKHRLKFAFPNGRNDFDYPTFFARSLVQDYRPGACFNIICNHMRFHYDEVRGLVPTNAIFITVLRDPARLFESSFHYFGPVVPLTWKLSAGDKLTEFLQD

SEQ ID NO: 5725 - protein, 242 aa, Homo Sapiens
MLPPQKKPWESMAKGLVLGALFTSFLLLVYSYAVPPLHAGLASTTPEAAASCSPPALEPEAVIRANGSAGECQPRRNIVFLKTHKTASSTLLNILFRFGQKHRLKFAFPNGRNDFDYPTFFARSLVQDYRPGACFNIICNHMRFHYDEVRGLVPTNAIFITVLRDPARLFESSFHYFGPVVPLTWKLSAGDKLTEFLQDPDRYYDPNGFNAHYLRNLLFFDLGYDNSLDPSSPQVQEHILEV

SEQ ID NO: 5726 - protein, 423 aa, Homo Sapiens
MLPPQKKPWESMAKGLVLGALFTSFLLLVYSYAVPPLHAGLASTTPEAAASCSPPALEPEAVIRANGSAGECQPRRNIVFLKTHKTASSTLLNILFRFGQKHRLKFAFPNGRNDFDYPTFFARSLVQDYRPGACFNIICNHMRFHYDEVRGLVPTNAIFITVLRDPARLFESSFHYFGPVVPLTWKLSAGDKLTEFLQDPDRYYDPNGFNAHYLRNLLFFDLGYDNSLDPSSPQVQEHILEVERRFHLVLLQEYFDESLVLLKDLLCWELEDVLYFKLNARRDSPVPRLSGELYGRATAWNMLDSHLYRHFNASFWRKVEAFGRERMAREVAALRHANERMRTICIDGGHAVDAAAIQDEAMQPWQPLGTKSILGYNLKKSIGQRHAQLCRRMLTPEIQYLMDLGANLWVTKLWKFIRDFLRW

SEQ ID NO: 5727 - protein, 279 aa, Homo Sapiens
MLPPQKKPWESMAKGLVLGALFTSFLLLVYSYAVPPLHAGLASTTPEAAASCSPPALEPEAVIRANGSAGECQPRRNIVFLKTHKTASSTLLNILFRFGQKHRLKFAFPNGRNDFDYPTFFARSLVQDYRPGACFNIICNHMRFHYDEVRGLVPTNAIFITVLRDPARLFESSFHYFGPVVPLTWKLSAGDKLTEFLQDPDRYYDPNGFNAHYLRNLLFFDLGYDNSLDPSSPQVQEHILEVERRFHLVLLQEYFDESLVLLKDLLCWELEDVLYFKLN

SEQ ID NO: 5728 - protein, 423 aa, Homo Sapiens; identical to SEQ ID NO: 5726

SEQ ID NO: 5729 - protein, 423 aa, Homo Sapiens; identical to SEQ ID NO: 5726

SEQ ID NO: 5730 - protein, 423 aa, Homo Sapiens; identical to SEQ ID NO: 5726

SEQ ID NO: 5731 - protein, 423 aa, Homo Sapiens; identical to SEQ ID NO: 5726

SEQ ID NO: 5732 - protein, 423 aa, Homo Sapiens; identical to SEQ ID NO: 5726

SEQ ID NO: 5733 - protein, 398 aa, Homo Sapiens
MMSMLGGLQRYFRVILLLLLALTLLLLAGFLHSDLELDTPLFGGQAEGPPVTNIMFLKTHKTASSTVLNILYRFAETHNLSVALPAGSRVHLGYPWLFLARYVEGVGSQQRFNIMCNHLRFNLPQVQKVMPNDTFYFSILRNPVFQLESSFIYYKTYAPAFRGAPSLDAFLASPRTFYNDSRHLRNVYAKNNMWFDFGFDPNAQCEEGYVRARIAEVERRFRLVLIAEHLDESLVLLRRRLRWALDDVVAFRLNSRSARSVARLSPETRERARSWCALDWRLYEHFNRTLWAQLRAELGPRRLRGEVERLRARRRELASLCLQDGGALKNHTQIRDPRLRPYQSGKADILGYNLRPGLDNQTLGVCQRLVMPELQYMARLYALQFPEKPLKNIPFLGA

SEQ ID NO: 5734 - protein, 431 aa, Homo Sapiens
MPPILQRLQQATKMMSRRKILLLVLGCSTVSLLIHQGAQLSWYPKLFPLSCPPLRNSPPRPKHMTVAFLKTHKTAGTTVQNILFRFAERHNLTVALPHPSCEHQFCYPRNFSAHFVHPATRPPHVLASHLRFDRAELERLMPPSTVYVTILREPAAMFESLFSYYNQYCPAFRRVPNASLEAFLRAPEAYYRAGEHFAMFAHNTLAYDLGGDNERSPRDDAAYLAGLIRQVEEVFSLVMIAEYFDESLVLLRRLLAWDLDDVLYAKLNARAASSRLAAIPAALARAARTWNALDAGLYDHFNATFWRHVARAGRACVEREARELREARQRLLRRCFGDEPLLRPAAQIRTKQLQPWQPSRKVDIMGYDLPGGGAGPATEACLKLAMPEVQYSNYLLRKQKRRGGARARPEPVLDNPPPRPIRVLPRGPQGP

SEQ ID NO: 5735 - protein, 431 aa, Homo Sapiens; identical to SEQ ID NO: 5734

SEQ ID NO: 5736 - protein, 62 aa, Homo Sapiens
KAMTAAAGSAGRAAVPLLLCALLAPGGAYVLDDSDGLGREFDGIGAVSGGGDWCLKVSLKGR

SEQ ID NO: 5737 - protein, 685 aa, Homo Sapiens
MAEWLLSASWQRRAKAMTAAAGSAGRAAVPLLLCALLAPGGAYVLDDSDGLGREFDGIGAVSGGGATSRLLVNYPEPYRSQILDYLFKPNFGASLHILKVEIGGDGQTTDGTEPSHMHYALDENYFRGYEWWLMKEAKKRNPNITLIGLPWSFPGWLGKGFDWPYVNLQLTAYYVVTWIVGAKRYHDLDIDYIGIWNERSYNANYIKILRKMLNYQGLQRVKIIASDNLWESISASMLLDAELFKVVDVIGAHYPGTHSAKDAKLTGKKLWSSEDFSTLNSDMGAGCWGRILNQNYINGYMTSTIAWNLVASYYEQLPYGRCGLMTAQEPWSGHYVVESPVWVSAHTTQFTQPGWYYLKTVGHLEKGGSYVALTDGLGNLTIIIETMSHKHSKCIRPFLPYFNVSQQFATFVLKGSFSEIPELQVWYTKLGKTSERFLFKQLDSLWLLDSDGSFTLSLHEDELFTLTTLTTGRKGSYPLPPKSQPFPSTYKDDFNVDYPFFSEAPNFADQTGVFEYFTNIEDPGEHHFTLRQVLNQRPITWAADASNTISIIGDYNWTNLTIKCDVYIETPDTGGVFIAGRVNKGGILIRSARGIFFWIFANGSYRVTGDLAGWIIYALGRVEVTAKKWYTLTLTIKGHFTSGMLNDKSLWTDIPVNFPKNGWAAIGTHSFEFAQFDNFLVEATR

SEQ ID NO: 5738 - protein, 211 aa, Homo Sapiens
MAEWLLSASWQRRAKAMTAAAGSAGRAAVPLLLCALLAPGGAYVLDDSDGLGREFDGIGAVSGGGATSRLLVNYPEPYRSQILDYLFKPNFGASLHILKVEIGGDGQTTDGTEPSHMHYALDENYFRGYEWWLMKEAKKRNPNITLIGLPWSFPGWLGKGFDWPYVNLQLTAYYVVTWIVGAKRYHDLDIDYIGIWNERSYNANYIKVFGE

SEQ ID NO: 5739 - protein, 112 aa, Homo Sapiens
MAEWLLSASWQRRAKAMTAAAGSAGRAAVPLLLCALLAPGGAYVLDDSDGLGREFDGIGAVSGGGATSRLLVNYPEPYRSQILDYLFKPNFGASLHILKVEIGGDGQTTDIL

SEQ ID NO: 5740 - protein, 662 aa, Homo Sapiens
MAEWLLSASWQRRAKAMTAAAGSAGRAAVPLLLCALLAPGGAYVLDDSDGLGREFDGIGAVSGGGPNFGASLHILKVEIGGDGQTTDGTEPSHMHYALDENYFRGYEWWLMKEAKKRNPNITLIGLPWSFPGWLGKGFDWPYVNLQLTAYYVVTWIVGAKRYHDLDIDYIGIWNERSYNANYIKILRKMLNYQGLQRVKIIASDNLWESISASMLLDAELFKVVDVIGAHYPGTHSAKDAKLTGKKLWSSEDFSTLNSDMGAGCWGRILNQNYINGYMTSTIAWNLVASYYEQLPYGRCGLMTAQEPWSGHYVVESPVWVSAHTTQFTQPGWYYLKTVGHLEKGGSYVALTDGLGNLTIIIETMSHKHSKCIRPFLPYFNVSQQFATFVLKGSFSEIPELQVWYTKLGKTSERFLFKQLDSLWLLDSDGSFTLSLHEDELFTLTTLTTGRKGSYPLPPKSQPFPSTYKDDFNVDYPFFSEAPNFADQTGVFEYFTNIEDPGEHHFTLRQVLNQRPITWAADASNTISIIGDYNWTNLTIKCDVYIETPDTGGVFIAGRVNKGGILIRSARGIFFWIFANGSYRVTGDLAGWIIYALGRVEVTAKKWYTLTLTIKGHFTSGMLNDKSLWTDIPVNFPKNGWAAIGTHSFEFAQFDNFLVEATR

SEQ ID NO: 5741 - protein, 589 aa, Homo Sapiens
MGFMVADLWATSRLLVNYPEPYRSQILDYLFKPNFGASLHILKVEIGGDGQTTDGTEPSHMHYALDENYFRGYEWWLMKEAKKRNPNITLIGLPWSFPGWLGKGFDWPYVNLQLTAYYVVTWIVGAKRYHDLDIDYIGIWNERSYNANYIKILRKMLNYQGLQRVKIIASDNLWESISASMLLDAELFKVVDVIGAHYPGTHSAKDAKLTGKKLWSSEDFSTLNSDMGAGCWGRILNQNYINGYMTSTIAWNLVASYYEQLPYGRCGLMTAQEPWSGHYVVESPVWVSAHTTQFTQPGWYYLKTVGHLEKGGSYVALTDGLGNLTIIIETMSHKHSKCIRPFLPYFNVSQQFATFVLKGSFSEIPELQVWYTKLGKTSERFLFKQLDSLWLLDSDGSFTLSLHEDELFTLTTLTTGRKGSYPLPPKSQPFPSTYKDDFNVDYPFFSEAPNFADQTGVFEYFTNIEDPGEHHFTLRQVLNQRPITWAADASNTISIIGDYNWTNLTIKCDVYIETPDTGGVFIAGRVNKGGILIRSARGIFFWIFANGSYRVTGDLAGWIIYALGRVEVTAKKWYTLTLTIKVAGRRKKT

SEQ ID NO: 5742 - protein, 659 aa, Homo Sapiens
MLGKSHGRATHGPLPLADLGIHLPCVKVLHQVTPEEKPAATSRLLVNYPEPYRSQILDYLFKPNFGASLHILKVEIGGDGQTTDGTEPSHMHYALDENYFRGYEWWLMKEAKKRNPNITLIGLPWSFPGWLGKGFDWPYVNLQLTAYYVVTWIVGAKRYHDLDIDYIGIWNERSYNANYIKILRKMLNYQGLQRVKIIASDNLWESISASMLLDAELFKVVDVIGAHYPGTHSAKDAKLTGKKLWSSEDFSTLNSDMGAGCWGRILNQNYINGYMTSTIAWNLVASYYEQLPYGRCGLMTAQEPWSGHYVVESPVWVSAHTTQFTQPGWYYLKTVGHLEKGGSYVALTDGLGNLTIIIETMSHKHSKCIRPFLPYFNVSQQFATFVLKGSFSEIPELQVWYTKLGKTSERFLFKQLDSLWLLDSDGSFTLSLHEDELFTLTTLTTGRKGSYPLPPKSQPFPSTYKDDFNVDYPFFSEAPNFADQTGVFEYFTNIEDPGEHHFTLRQVLNQRPITWAADASNTISIIGDYNWTNLTIKCDVYIETPDTGGVFIAGRVNKGGILIRSARGIFFWIFANGSYRVTGDLAGWIIYALGRVEVTAKKWYTLTLTIKGHFTSGMLNDKSLWTDIPVNFPKNGWAAIGTHSFEFAQFDNFLVEATR

SEQ ID NO: 5743 - protein, 434 aa, Homo Sapiens
MLNYQGLQRVKIIASDNLWESISASMLLDAELFKVVDVIGAHYPGTHSAKDAKLTGKKLWSSEDFSTLNSDMGAGCWGRILNQNYINGYMTSTIAWNLVASYYEQLPYGRCGLMTAQEPWSGHYVVESPVWVSAHTTQFTQPGWYYLKTVGHLEKGGSYVALTDGLGNLTIIIETMSHKHSKCIRPFLPYFNVSQQFATFVLKGSFSEIPELQVWYTKLGKTSERFLFKQLDSLWLLDSDGSFTLSLHEDELFTLTTLTTGRKGSYPLPPKSQPFPSTYKDDFNVDYPFFSEAPNFADQTGVFEYFTNIEDPGEHHFTLRQVLNQRPITWAADASNTISIIGDYNWTNLTIKCDVYIETPDTGGVFIAGRVNKGGILIRSARGIFFWIFANGSYRVTGDLAGWIIYALGRVEVTAKKWYTLTLTIKVAGRRKKT

SEQ ID NO: 5744 - protein, 72 aa, Homo Sapiens
  misc_feature (1)..(1): Xaa can be any naturally occurring amino acid
XKLGKTSERFLFKQLDSLWLLDSDGSFTLSLHEDELFTLTTLTTGRKGSYPLPPKSQPFPSTYKDDFNVGPI

SEQ ID NO: 5745 - protein, 404 aa, Homo Sapiens
  misc_feature (1)..(1): Xaa can be any naturally occurring amino acid
XLLSASWQRRAKAMTAAAGSAGRAAVPLLLCALLAPGGAYVLDDSDGLGREFDGIGAVSGGGATSRLLVNYPEPYRSQILDYLFKPNFGASLHILKVEIGGDGQTTDGTEPSHMHYALDENYFRGYEWWLMKEAKKRNPNITLIGLPWSFPGWLGKGFDWPYVNLQLTAYYVVTWIVGAKRYHDLDIDYIGIWNERSYNANYIKILRKMLNYQGLQRVKIIASDNLWESISASMLLDAELFKVVDVIGAHYPGTHSAKDAKLTGKKLWSSEDFSTLNSDMGAGCWGRILNQNYINGYMTSTIAWNLVASYYEQLPYGRCGLMTAQEPWSGHYVVESPVWVSAHTTQFTQPGWYYLKTVGHLEKGGSYVALTDGLGNLTIIIETMVNFCCCYWINSLLYYWKNKI

SEQ ID NO: 5746 - protein, 78 aa, Homo Sapiens
MAAVVAATRWWQLLLVLSAAGMGASGAPQPPNILLLLMDDESLPPPRAAGSPRWAPVLPDGCLCPLENAERRSGVPKV

SEQ ID NO: 5747 - protein, 116 aa, Homo Sapiens
MAAVVAATRWWQLLLVLSAAGMGASGAPQPPNILLLLMDDESLPPPRAAGSPRWAPVLPDGCLCPLENAERSDCFPEHALQRPGVRVLTAVAGPFSALSGISLLKILCFRISSFHF

SEQ ID NO: 5748 - protein, 522 aa, Homo Sapiens
MAAVVAATRWWQLLLVLSAAGMGASGAPQPPNILLLLMDDMGWGDLGVYGEPSRETPNLDRMAAEGLLFPNFYSANPLCSPSRAALLTGRLPIRNGFYTTNAHARNAYTPQEIVGGIPDSEQLLPELLKKAGYVSKIVGKWHLGHRPQFHPLKHGFDEWFGSPNCHFGPYDNKARPNIPVYRDWEMVGRYYEEFPINLKTGEANLTQIYLQEALDFIKRQARHHPFFLYWAVDATHAPVYASKPFLGTSQRGRYGDAVREIDDSIGKILELLQDLHVADNTFVFFTSDNGAALISAPEQGGSNGPFLCGKQTTFEGGMREPALAWWPGHVTAGQVSHQLGSIMDLFTTSLALAGLTPPSDRAIDGLNLLPTLLQGRLMDRPIFYYRGDTLMAATLGQHKAHFWTWTNSWENFRQGIDFCPGQNVSGVTTHNLEDHTKLPLIFHLGRDPGERFPLSFASAEYQEALSRITSVVQQHQEALVPAQPQLNVCNWAVMNWAPPGCEKLGKCLTPPESIPKKCLWSH

SEQ ID NO: 5749 - protein, 170 aa, Homo Sapiens
MTGTASSLAARAALLTGRLPIRNGFYTTNAHARNAYTPQEIVGGIPDSEQLLPELLKKAGYVSKIVGKWHLGHRPQFHPLKHGFDEWFGSPNCHFGPYDNKARPNIPVYRDWEMVGRYYEEFPINLKTGEANLTQIYLQEALDFIKRQARHHPFFLYWAVDATHAPVYAS

SEQ ID NO: 5750 - protein, 51 aa, Homo Sapiens
SAAGMGASGAPQPPNILLLLMDDMHVFRGQLLRACRCWCQAGRRQTDTFPT

SEQ ID NO: 5751 - protein, 69 aa, Homo Sapiens
SAAGMGASGAPQPPNILLLLMDDRGRHCSQDGYPSAMASTPPTPMPETPTHRRRLWAASQTRSSSCRSF

SEQ ID NO: 5752 - protein, 202 aa, Homo Sapiens
MRRKEKRLLQAVALVLAALVLLPNVGLWALYRERQPDGTPGGSGAAVAPAAGQGSHSRQKKTFFLGDGQKLKDWHDKEAIRRDAQRVGNGEQGRPYPMTDAERVDQAYRENGFNIYVSDKISLNRSLPDIRHPNCNSKRYLETLPNTSIIIPFHNEGWSSLLRTVHSVLNRSPPELVAEIVLVDDFSDRDLPTASTPSPFVC

SEQ ID NO: 5753 - protein, 541 aa, Homo Sapiens
MRRKEKRLLQAVALVLAALVLLPNVGLWALYRERQPDGTPGGSGAAVAPAAGQGSHSRQKKTFFLGDGQKLKDWHDKEAIRRDAQRVGNGEQGRPYPMTDAERVDQAYRENGFNIYVSDKISLNRSLPDIRHPNCNSKRYLETLPNTSIIIPFHNEGWSSLLRTVHSVLNRSPPELVAEIVLVDDFSDRDRIARNRKTIVCPMIDVIDHDDFRYETQAGDAMRGAFDWEMYYKRIPIPPELQKADPSDPFESPVMAGGLFAVDRKWFWELGGYDPGLEIWGGEQYEISFKVWMCGGRMEDIPCSRVGHIYRKYVPYKVPAGVSLARNLKRVAEVWMDEYAEYIYQRRPEYRHLSAGDVAVQKKLRSSLNCKSFKWFMTKIAWDLPKFYPPVEPPAAAWGEIRNVGTGLCADTKHGALGSPLRLEGCVRGRGEAAWNNMQVFTFTWREDIRPGDPQHTKKFCFDAISHTSPVTLYDCHSMKGNQLWKYRKDKTLYHPVSGSCMDCSESDHRIFMNTCNPSSLTQQWLFEHTNSTVLEKFNRN

SEQ ID NO: 5754 - protein, 603 aa, Homo Sapiens
MRRKEKRLLQAVALVLAALVLLPNVGLWALYRERQPDGTPGGSGAAVAPAAGQGSHSRQKKTFFLGDGQKLKDWHDKEAIRRDAQRVGNGEQGRPYPMTDAERVDQAYRENGFNIYVSDKISLNRSLPDIRHPNCNSKRYLETLPNTSIIIPFHNEGWSSLLRTVHSVLNRSPPELVAEIVLVDDFSDREHLKKPLEDYMALFPSVRILRTKKREGLIRTRMLGASVATGDVITFLDSHCEANVNWLPPLLDRIARNRKTIVCPMIDVIDHDDFRYETQAGDAMRGAFDWEMYYKRIPIPPELQKADPSDPFESPVMAGGLFAVDRKWFWELGGYDPGLEIWGGEQYEISFKVWMCGGRMEDIPCSRVGHIYRKYVPYKVPAGVSLARNLKRVAEVWMDEYAEYIYQRRPEYRHLSAGDVAVQKKLRSSLNCKSFKWFMTKIAWDLPKFYPPVEPPAAAWGEIRNVGTGLCADTKHGALGSPLRLEGCVRGRGEAAWNNMQVFTFTWREDIRPGDPQHTKKFCFDAISHTSPVTLYDCHSMKGNQLWKYRKDKTLYHPVSGSCMDCSESDHRIFMNTCNPSSLTQQWLFEHTNSTVLEKFNRN

SEQ ID NO: 5755 - protein, 366 aa, Homo Sapiens
MRRKEKRLLQAVALVLAALVLLPNVGLWALYRERQPDGTPGGSGAAVAPAAGQGSHSRQKKTFFLGDGQKLKDWHDKEAIRRDAQRVGNGEQGRPYPMTDAERVDQAYRENGFNIYVSDKISLNRSLPDIRHPNCNSKRYLETLPNTSIIIPFHNEGWSSLLRTVHSVLNRSPPELVAEIVLVDDFSDREHLKKPLEDYMALFPSVRILRTKKREGLIRTRMLGASVATGDVITFLDSHCEANVNWLPPLLDRIARNRKTIVCPMIDVIDHDDFRYETQAGDAMRGAFDWEMYYKRIPIPPELQKADPSDPFESPVMAGGLFAVDRKWFWELGGYDPGLEIWGGEQYEISFKVSQLSRRPVLGTAS

SEQ ID NO: 5756 - protein, 581 aa, Homo Sapiens [sequence omitted]

SEQ ID NO: 5757 - protein, 31 aa, Homo Sapiens
  misc_feature (1)..(1): Xaa can be any naturally occurring amino acid
XINIYLSDRISLHRRLPERWNPLAPEGALGQ

SEQ ID NO: 5758 - protein, 141 aa, Homo Sapiens
ALPEVRHPLCLQQHPQDSLPTASVILCFHDEAWSTLLRTVHSILDTVPRAFLKEIILVDDLSQQGSHGFPPGSSGTTQVCSQRICGQAGGGEVTQEQQEAGCHQGPDAGGHQSHRGCARLHGCPLRVPPRLAGAPPQQNSW

SEQ ID NO: 5759 - protein, 196 aa, Homo Sapiens
MERLQLQRRLGCRTFHWFLANVYPELYPSEPRPSFSGKLHNTGLGLCADCQAEGDILGCPMVLAPCSDSRQQQYLQHTSRKEIHFGSPQHLCFAVRQEQVILQNCTEEGLAIHQQHWDFQENGMIVHILSGKCMEAVVQENNKDLYLRPCDEKPASSGVLTRSMLWMNDECQCQKEKRILAIKIQLQVNLKSLYIS

SEQ ID NO: 5760 - protein, 639 aa, Homo Sapiens
MLLRKRYRHRPCRLQFLLLLLMLGCVLMMVAMLHPPHHTLHQTVTAQASKHSPEARYRLDFGESQDWVLEAEDEGEEYSPLEGLPPFISLREDQLLVAVALPQARRNQSQGRRGGSYRLIKQPRRQDKEAPKRDWGADEDGEVSEEEELTPFSLDPRGLQEALSARIPLQRALPEVRHPLCLQQHPQDSLPTASVILCFHDEAWSTLLRTVHSILDTVPRAFLKEIILVDDLSQQGQLKSALSEYVARLEGVKLLRSNKRLGAIRARMLGATRATGDVLVFMDAHCECHPGWLEPLLSRIAGDRSRVVSPVIDVIDWKTFQYYPSKDLQRGVLDWKLDFHWEPLPEHVRKALQSPISPIRSPVVPGEVVAMDRHYFQNTGAYDSLMSLRGGENLELSFKAWLCGGSVEILPCSRVGHIYQNQDSHSPLDQEATLRNRVRIAETWLGSFKETFYKHSPEAFSLSKAEKPDCMERLQLQRRLGCRTFHWFLANVYPELYPSEPRPSFSGKLHNTGLGLCADCQAEGDILGCPMVLAPCSDSRQQQYLQHTSRKEIHFGSPQHLCFAVRQEQVILQNCTEEGLAIHQQHWDFQENGMIVHILSGKCMEAVVQENNKDLYLRPCDGKARQQWRFDQINAVDER

SEQ ID NO: 5761 - protein, 617 aa, Homo Sapiens
MLLRKRYRHRPCRLQFLLLLLMLGCVLMMVAMLHPPHHTLHQTVTAQASKHSPEARYRLDFGESQDWVLEAEDEGEEYSPLEGLPPFISLREDQLLVAVALPQARRNQSQGRRGGSYRLIKQPRRQDKEAPKRDWGADEDGEVSEEEELTPFSLDPRGLQEALSARIPLQRALPEVRHPLCLQQHPQDSLPTASVILCFHDEAWSTLLRTVHSILDTVPRAFLKEIILVDDLSQQGQLKSALSEYVARLEGVKLLRSNKRLGAIRARMLGATRATGDVLVFMDAHCECHPGWLEPLLSRIAGDRSRVVSPVIDVIDWKTFQYYPSKDLQRGVLDWKLDFHWEPLPEHVRKALQSPISPIRSPVVPGEVVAMDRHYFQNTGAYDSLMSLRGGENLELSFKAWLCGGSVEILPCSRVGHIYQNQDSHSPLDQEATLRNRVRIAETWLGSFKETFYKHSPEAFSLSKAEKPDCMERLQLQRRLGCRTFHWFLANVYPELYPSEPRPSFSGKLHNTGLGLCADCQAEGDILGCPMVLAPCSDSRQQQYLQHTSRKEIHFGSPQHLCFAVRQEQVILQNCTEEGLAIHQQHWDFQEDENRANSAAAEAYQRPLTFQQIVNNG

SEQ ID NO: 5762 - protein, 571 aa, Homo Sapiens
MRRRSRMLLCFAFLWVLGIAYYMYSGGGSALAGGAGGGAGRKEDWNEIDPIKKKDLHHSNGEEKAQSMETLPPGKVRWPDFNQEAYVGGTMVRSGQDPYARNKFNQVESDKLRMDRAIPDTRHDQCQRKQWRVDLPATSVVITFHNEARSALLRTVVSVLKKSPPHLIKEIILVDDYSNDPEDGALLGKIEKVRVLRNDRREGLMRSRVRGADAAQAKVLTFLDSHCECNEHWLEPLLERVAEDRTRVVSPIIDVINMDNFQYVGASADLKGGFDWNLVFKWDYMTPEQRRSRQGNPVAPIKTPMIAGGLFVMDKFYFEELGKYDMMMDVWGGENLEISFRVWQCGGSLEIIPCSRVGHVFRKQHPYTFPGGSGTVFARNTRRAAEVWMDEYKNFYYAAVPSARNVPYGNIQSRLELRKKLSCKPFKWYLENVYPELRVPDHQDIAFGALQQGTNCLDTLGHFADGVVGVYECHNAGGNQEWALTKEKSVKHMDLCLTVVDRAPGSLIKLQGCRENDSRQKWEQIEGNSKLRHVGSNLCLDSRTAKSGGLSVEVCGPALSQQWKFTLNLQQ

SEQ ID NO: 5763 - protein, 23 aa, Homo Sapiens
MRLLRRRHMPLRLAMVGCAFVLF

SEQ ID NO: 5764 - protein, 23 aa, Homo Sapiens
MRLLRRRHMPLRLAMVGCAFVLF

SEQ ID NO: 5765 - protein, 39 aa, Homo Sapiens
MRLLRRRHMPLRLAMVGCAFVLFLFLLHRDVSSREEATE

SEQ ID NO: 5766 - protein, 55 aa, Homo Sapiens
MRLLRRRHMPLRLAMVGCAFVLFLFLLHRDVSSREEATEKPWLKSLVSRKDHVLD

SEQ ID NO: 5767 - protein, 62 aa, Homo Sapiens
MRLLRRRHMPLRLAMVGCAFVLFLFLLHRDVSSREEATEKPWLKSLVSRKDHVLDLMLEAMN

SEQ ID NO: 5768 - protein, 69 aa, Homo Sapiens
MRLLRRRHMPLRLAMVGCAFVLFLFLLHRDVSSREEATEKPWLKSLVSRKDHVLDLMLEAMNNLRDSMP

SEQ ID NO: 5769 - protein, 78 aa, Homo Sapiens
MRLLRRRHMPLRLAMVGCAFVLFLFLLHRDVSSREEATEKPWLKSLVSRKDHVLDLMLEAMNNLRDSMPKLQIRAPEA

SEQ ID NO: 5770 - protein, 123 aa, Homo Sapiens
MRLLRRRHMPLRLAMVGCAFVLFLFLLHRDVSSREEATEKPWLKSLVSRKDHVLDLMLEAMNNLRDSMPKLQIRAPEAQQTLFSINQSCLPGFYTPAELKPFWERPPQDPNAPGADGKAFQKS

SEQ ID NO: 5771 - protein, 137 aa, Homo Sapiens
MRLLRRRHMPLRLAMVGCAFVLFLFLLHRDVSSREEATEKPWLKSLVSRKDHVLDLMLEAMNNLRDSMPKLQIRAPEAQQTLFSINQSCLPGFYTPAELKPFWERPPQDPNAPGADGKAFQKSKWTPLETQEKEEGY

SEQ ID NO: 5772 - protein, 622 aa, Homo Sapiens
MRLLRRRHMPLRLAMVGCAFVLFLFLLHRDVSSREEATEKPWLKSLVSRKDHVLDLMLEAMNNLRDSMPKLQIRAPEAQQTLFSINQSCLPGFYTPAELKPFWERPPQDPNAPGADGKAFQKSKWTPLETQEKEEGYKKHCFNAFASDRISLQRSLGPDTRPPECVDQKFRRCPPLATTSVIIVFHNEAWSTLLRTVYSVLHTTPAILLKEIILVDDASTEEHLKEKLEQYVKQLQVVRVVRQEERKGLITARLLGASVAQAEVLTFLDAHCECFHGWLEPLLARIAEDKTVVVSPDIVTIDLNTFEFAKPVQRGRVHSRGNFDWSLTFGWETLPPHEKQRRKDETYPIKSPTFAGGLFSISKSYFEHIGTYDNQMEIWGGENVEMSFRVWQCGGQLEIIPCSVVGHVFRTKSPHTFPKGTSVIARNQVRLAEVWMDSYKKIFYRRNLQAAKMAQEKSFGDISERLQLREQLHCHNFSWYLHNVYPEMFVPDLTPTFYGAIKNLGTNQCLDVGENNRGGKPLIMYSCHGLGGNQYFEYTTQRDLRHNIAKQLCLHVSKGALGLGSCHFTGKNSQVPKDEEWELAQDQLIRNSGSGTCLTSQDKKPAMAPCNPSDPHQLWLFV

SEQ ID NO: 5773 - protein, 365 aa, Homo Sapiens
MRLLRRRHMPLRLAMVGCAFVLFLFLLHRDVSSREEATEKPWLKSLVSRKDHVLDLMLEAMNNLRDSMPKLQIRAPEAQQTLFSINQSCLPGFYTPAELKPFWERPPQDPNAPGADGKAFQKSKWTPLETQEKEEGYKKHCFNAFASDRISLQRSLGPDTRPPECVDQKFRRCPPLATTSVIIVFHNEAWSTLLRTVYSVLHTTPAILLKEIILVDDASTEEHLKEKLEQYVKQLQVVRVVRQEERKGLITARLLGASVAQAEVLTFLDAHCECFHGWLEPLLARIAEDKTVVVSPDIVTIDLNTFEFAKPVQRGRVHSRGNFDWSLTFGWETLPPHEKQRRKDETYPIKCGSVGASWRSSPALS

SEQ ID NO: 5774 - protein, 622 aa, Homo Sapiens; identical to SEQ ID NO: 5772

SEQ ID NO: 5775 - protein, 637 aa, Homo Sapiens
MMFWRKLPKALFIGLTLAIAVNLLLVFSSKGTLQNLFTGGLHRELPLHLNKRYGAVIKRLSHLEVELQDLKESMKLALRQQENVNSTLKRAKDEVRPLLKAMETKVNETKKHKTQMKLFPHSQLFRQWGEDLSEAQQKAAQDLFRKFGYNAYLSNQLPLNRTIPDTRDYRCLRKTYPSQLPSLSVILIFVNEALSIIQRAITSIINRTPSRLLKEIILVDDFSSNGELKVHLDEKIKLYNQKYPGLLKIIRHPERKGLAQARNTGWEAATADVVAILDAHIEVNVGWAEPILARIQEDRTVIVSPVFDNIRFDTFKLDKYELAVDGFNWELWCRYDALPQAWIDLHDVTAPVKSPSIMGILAANRHFLGEIGSLDGGMLIYGGENVELSLRVWQCGGKVEILPCSRIAHLERHHKPYALDLTAALKRNALRVAEIWMDEHKHMVYLAWNIPLQNSGIDFGDVSSRMALREKLKCKTFDWYLKNVYPLLKPLHTIVGYGRMKNLLDENVCLDQGPVPGNTPIMYYCHEFSSQNVYYHLTGELYVGQLIAEASASDRCLTDPGKAEKPTLEPCSKAAKNRLHIYWDFKPGGAVINRDTKRCLEMKKDLLGSHVLVLQTCSTQVWEIQHTVRDWGQTNSQ

SEQ ID NO: 5776 - protein, 529 aa, Homo Sapiens
MRSEKSLTLAAPGEVRGPEGEQQDAGDFPEAGGGGGCCSSERLVINISGLRFETQLRTLSLFPDTLLGDPGRRVRFFDPLRNEYFFDRNRPSFDAILYYYQSGGRLRRPVNVPLDIFLEEIRFYQLGDEALAAFREDEGCLPEGGEDEKPLPSQPFQRQVWLLFEYPESSGPARGIAIVSVLVILISIVIFCLETLPQFRVDGRGGNNGGVSRVSPVSRGSQEEEEDEDDSYTFHHGITPGEMGTGGSSSLSTLGGSFFTDPFFLVETLCIVWFTFELLVRFSACPSKPAFFRNIMNIIDLVAIFPYFITLGTELVQQQEQQPASGGGGQNGQQAMSLAILRVIRLVRVFRIFKLSRHSKGLQILGKTLQASMRELGLLIFFLFIGVILFSSAVYFAEADDDDSLFPSIPDAFWWAVVTMTTVGYGDMYPMTVGGKIVGSLCAIAGVLTIALPVPVIVSNFNYFYHRETEQEEQGQYTHVTCGQPAPDLRATDNGLGKPDFPEANRERRPSYLPTPHRAYAEKRMLTEV

SEQ ID NO: 5777 - protein, 88 aa, Homo Sapiens
  misc_feature (1)..(1): Xaa can be any naturally occurring amino acid
XENVCLDQGPVPGNTPIMYYCHEFSSQNVYYHLTGELYVGQLIAEASASDRCLTDPGKAEKPTLEPCSKAAKNRLHIYWDFKPPTITK

SEQ ID NO: 5778 - protein, 161 aa, Homo Sapiens
  misc_feature (1)..(1): Xaa can be any naturally occurring amino acid
XYPLLKPLHTIVGYGRMKNLLDENVCLDQGPVPGNTPIMYYCHEFSSQNVYYHLTGELYVGQLIAEASASDRCLTDPGKAEKPTLEPCSKAAKNRLHIYWDFKPEKCWQVVQARTSMHRILTAAGPSTSSEDENPAWHRWQASGLTPLWRPPTSSNQARKS

SEQ ID NO: 5779 - protein, 417 aa, Homo Sapiens
EHLKDKLEEYMARFSKVRIVRTKKREGLIRTRLLGASMARGEVLTFLDSHCEVNVNWLPPLLNQIALNHKTIVCPMIDVIDHNHFGYEAQAGDAMRGAFDWEMYYKRIPIPPELQRADPSDPFESPVMAGGLFAVDRKWFWELGGYDPGLEIWGGEQYEISFKVWMCGGEMFDVPCSRVGHIYRKYVPYKVPSGTSLARNLKRVAETWMDEFAEYIYQRRPEYRHLSTGDISAQKELRKQLKCKDFKWFMAAVAWDVPKYYPPVEPPPAAWGEIRNVAANLCVDSKHGATGTELRLDICVKDGSERTWSHEQLFTFGWREDIRPGEPLHTRKFCFDAISHNSPVTLYDCHGMKGNQLWGYRKDRTLFHPVSNSCMDCNPAEKKIFMARCDPLSETQQWIFEHINMTVLEKFNHHANS

SEQ ID NO: 5780 - protein, 601 aa, Homo Sapiens
MKRKQKRFLQMTLLFTVALIFLPNVGLWSLYKDKHLVKSAEPGEQQTFPLGLGDGQFYSWTDGLRRKDWHDYESIQKEAMRSGKGEHGKPYPLTEEDHDDSAYRENGFNIFVSNNIALERSLPDIRHANCKHKMYLERLPNTSIIIPFHNEGWTSLLRTIHSIINRTPGSLIAEIILVDDFSEREHLKDKLEEYMARFSKVRIVRTKKREGLIRTRLLGASMARGEVLTFLDSHCEVNVNWLPPLLNQIALNHKTIVCPMIDVIDHNHFGYEAQAGDAMRGAFDWEMYYKRIPIPPELQRADPSDPFESPVMAGGLFAVDRKWFWELGGYDPGLEIWGGEQYEISFKVWMCGGEMFDVPCSRVGHIYRKYVPYKVPSGTSLARNLKRVAETWMDEFAEYIYQRRPEYRHLSTGDISAQKELRKQLKCKDFKWFMAAVAWDVPKYYPPVEPPPAAWGEIRNVAANLCVDSKHGATGTELRLDICVKDGSERTWSHEQLFTFGWREDIRPGEPLHTRKFCFDAISHNSPVTLYDCHGMKGNQLWGYRKDRTLFHPVSNSCMDCNPAEKKIFMARCDPLSETQQWIFEHINMTVLEKFNHHANS

SEQ ID NO: 5781 - protein, 61 aa, Homo Sapiens
MKRKQKRFLQMTLLFTVALIFLPNVGLWSLYKDKHLVKSAEPGEQQVSATQRKITQGLVRQ

SEQ ID NO: 5782 - protein, 584 aa, Homo Sapiens
MRAKFRAGAGHQRNPSISADHGVHELVYQTFPLGLGDGQFYSWTDGLRRKDWHDYESIQKEAMRSGKGEHGKPYPLTEEDHDDSAYRENGFNIFVSNNIALERSLPDIRHANCKHKMYLERLPNTSIIIPFHNEGWTSLLRTIHSIINRTPGSLIAEIILVDDFSEREHLKDKLEEYMARFSKVRIVRTKKREGLIRTRLLGASMARGEVLTFLDSHCEVNVNWLPPLLNQIALNHKTIVCPMIDVIDHNHFGYEAQAGDAMRGAFDWEMYYKRIPIPPELQRADPSDPFESPVMAGGLFAVDRKWFWELGGYDPGLEIWGGEQYEISFKVWMCGGEMFDVPCSRVGHIYRKYVPYKVPSGTSLARNLKRVAETWMDEFAEYIYQRRPEYRHLSTGDISAQKELRKQLKCKDFKWFMAAVAWDVPKYYPPVEPPPAAWGEIRNVAANLCVDSKHGATGTELRLDICVKDGSERTWSHEQLFTFGWREDIRPGEPLHTRKFCFDAISHNSPVTLYDCHGMKGNQLWGYRKDRTLFHPVSNSCMDCNPAEKKIFMARCDPLSETQQWIFEHINMTVLEKFNHHANS

SEQ ID NO: 5783 - protein, 116 aa, Homo Sapiens
MAPPSVPLVLLLVLLLSLAETPASAPAHRGRGGWTLNSAGYLLGPVLHLPQMGDQDGKRETALEILDLWKAIDGLPYSHPPQPSKRNVMETFAKPEIGDLGMLSMKIPKEEDVLKS

SEQ ID NO: 5784 - protein, 49 aa, Homo Sapiens
MAPPSVPLVLLLVLLLSLAETPASAPAHRSSTFPKWVTKTERGRQPLRS

SEQ ID NO: 5785 - protein, 49 aa, Homo Sapiens; identical to SEQ ID NO: 5784

SEQ ID NO: 5786 - protein, 119 aa, Homo Sapiens
MAAVAAVAARRRRLSVSGRDENSVELTMAEGPYKIILTARPFRLDLLEDRSLLLSVNARGLLEFEHQRAPRVSFSDKVNLTLGSIWDKIKNLFSRQGSKDPAEGDGAQPEETPRDGDKA

SEQ ID NO: 5787 - protein, 852 aa, Homo Sapiens
MAAVAAVAARRRRLSVSGRDENSVELTMAEGPYKIILTARPFRLDLLEDRSLLLSVNARGLLEFEHQRAPRVSFSDKVNLTLGSIWDKIKNLFSRQGSKDPAEGDGAQPEETPRDGDKPEETQGKAEKDEPGAWEETFKTHSDSKPYGPMSVGLDFSLPGMEHVYGIPEHADNLRLKVTEGGEPYRLYNLDVFQYELYNPMALYGSVPVLLAHNPHRDLGIFWLNAAETWVDISSNTAGKTLFGKMMDYLQGSGETPQTDVRWMSETGIIDVFLLLGPSISDVFRQYASLTGTQALPPLFSLGYHQSRWNYRDEADVLEVDQGFDDHNLPCDVIWLDIEHADGKRYFTWDPSRFPQPRTMLERLASKRRKLVAIVDPHIKVDSGYRVHEELRNLGLYVKTRDGSDYEGWCWPGSAGYPDFTNPTMRAWWANMFSYDNYEGSAPNLFVWNDMNEPSVFNGPEVTMLKDAQHYGGWEHRDVHNIYGLYVHMATADGLRQRSGGMERPFVLARAFFAGSQRFGAVWTGDNTAEWDHLKISIPMCLSLGLVGLSFCGADVGGFFKNPEPELLVRWYQMGAYQPFFRAHAHLDTGRREPWLLPSQHNDIIRDALGQRYSLLPFWYTLLYQAHREGIPVMRPLWVQYPQDVTTFNIDDQYLLGDALLVHPVSDSGAHGVQVYLPGQGEVWYDIQSYQKHHGPQTLYLPVTLSSIPVFQRGGTIVPRWMRVRRSSECMKDDPITLFVALSPQGTAQGELFLDDGHTFNYQTRQEFLLRRFSFSGNTLVSSSADPEGHFETPIWIERVVIIGAGKPAAVVLQTKGSPESRLSFQHDPETSVLVLRKPGINVASDWSIHLR

SEQ ID NO: 5788 - protein, 76 aa, Homo Sapiens
MAAVAAVAARRRRSWASLVLAFLGVCLGITLAVDRSNFKTCEESSFCDREAYGQASLHTEPCWTLYSLVLIPSRSI

SEQ ID NO: 5789 - protein, 52 aa, Homo Sapiens
MAAVAAVAARRRRSWASLVLAFLGVCLGITLAVDRSNFKTCEESSFCKCCWC

SEQ ID NO: 5790 - protein, 52 aa, Homo Sapiens; identical to SEQ ID NO: 5789

SEQ ID NO: 5791 - protein, 52 aa, Homo Sapiens; identical to SEQ ID NO: 5789

SEQ ID NO: 5792 - protein, 966 aa, Homo Sapiens
MAAVAAVAARRRRSWASLVLAFLGVCLGITLAVDRSNFKTCEESSFCKRQRSIRPGLSPYRALLDSLQLGPDSLTVHLIHEVTKVLLVLELQGLQKNMTRFRIDELEPRRPRYRVPDVLVADPPIARLSVSGRDENSVELTMAEGPYKIILTARPFRLDLLEDRSLLLSVNARGLLEFEHQRAPRVSFSDKVNLTLGSIWDKIKNLFSRQGSKDPAEGDGAQPEETPRDGDKPEETQGKAEKDEPGAWEETFKTHSDSKPYGPMSVGLDFSLPGMEHVYGIPEHADNLRLKVTEGGEPYRLYNLDVFQYELYNPMALYGSVPVLLAHNPHRDLGIFWLNAAETWVDISSNTAGKTLFGKMMDYLQGSGETPQTDVRWMSETGIIDVFLLLGPSISDVFRQYASLTGTQALPPLFSLGYHQSRWNYRDEADVLEVDQGFDDHNLPCDVIWLDIEHADGKRYFTWDPSRFPQPRTMLERLASKRRKLVAIVDPHIKVDSGYRVHEELRNLGLYVKTRDGSDYEGWCWPGSAGYPDFTNPTMRAWWANMFSYDNYEGSAPNLFVWNDMNEPSVFNGPEVTMLKDAQHYGGWEHRDVHNIYGLYVHMATADGLRQRSGGMERPFVLARAFFAGSQRFGAVWTGDNTAEWDHLKISIPMCLSLGLVGLSFCGADVGGFFKNPEPELLVRWYQMGAYQPFFRAHAHLDTGRREPWLLPSQHNDIIRDALGQRYSLLPFWYTLLYQAHREGIPVMRPLWVQYPQDVTTFNIDDQYLLGDALLVHPVSDSGAHGVQVYLPGQGEVWYDIQSYQKHHGPQTLYLPVTLSSIPVFQRGGTIVPRWMRVRRSSECMKDDPITLFVALSPQGTAQGELFLDDGHTFNYQTRQEFLLRRFSFSGNTLVSSSADPEGHFETPIWIERVVIIGAGKPAAVVLQTKGSPESRLSFQHDPETSVLVLRKPGINVASDWSIHLR

SEQ ID NO: 5793 - protein, 944 aa, Homo Sapiens
MAAVAAVAARRRRSWASLVLAFLGVCLGITLAVDRSNFKTCEESSFCKRQRSIRPGLSPYRALLDSLQLGPDSLTVHLIHEVTKVLLVLELQGLQKNMTRFRIDELEPRRPRYRVPDVLVADPPIARLSVSGRDENSVELTMAEGPYKIILTARPFRLDLLEDRSLLLSVNARGLLEFEHQRAPRVSQGSKDPAEGDGAQPEETPRDGDKPEETQGKAEKDEPGAWEETFKTHSDSKPYGPMSVGLDFSLPGMEHVYGIPEHADNLRLKVTEGGEPYRLYNLDVFQYELYNPMALYGSVPVLLAHNPHRDLGIFWLNAAETWVDISSNTAGKTLFGKMMDYLQGSGETPQTDVRWMSETGIIDVFLLLGPSISDVFRQYASLTGTQALPPLFSLGYHQSRWNYRDEADVLEVDQGFDDHNLPCDVIWLDIEHADGKRYFTWDPSRFPQPRTMLERLASKRRKLVAIVDPHIKVDSGYRVHEELRNLGLYVKTRDGSDYEGWCWPGSAGYPDFTNPTMRAWWANMFSYDNYEGSAPNLFVWNDMNEPSVFNGPEVTMLKDAQHYGGWEHRDVHNIYGLYVHMATADGLRQRSGGMERPFVLARAFFAGSQRFGAVWTGDNTAEWDHLKISIPMCLSLGLVGLSFCGADVGGFFKNPEPELLVRWYQMGAYQPFFRAHAHLDTGRREPWLLPSQHNDIIRDALGQRYSLLPFWYTLLYQAHREGIPVMRPLWVQYPQDVTTFNIDDQYLLGDALLVHPVSDSGAHGVQVYLPGQGEVWYDIQSYQKHHGPQTLYLPVTLSSIPVFQRGGTIVPRWMRVRRSSECMKDDPITLFVALSPQGTAQGELFLDDGHTFNYQTRQEFLLRRFSFSGNTLVSSSADPEGHFETPIWIERVVIIGAGKPAAVVLQTKGSPESRLSFQHDPETSVLVLRKPGINVASDWSIHLR

SEQ ID NO: 5794 - protein, 847 aa, Homo Sapiens
MTRFRIDELEPRRPRYRVPDVLVADPPIARLSVSGRDENSVELTMAEGPYKIILTARPFRLDLLEDRSLLLSVNARGLLEFEHQRAPRVSQGSKDPAEGDGAQPEETPRDGDKPEETQGKAEKDEPGAWEETFKTHSDSKPYGPMSVGLDFSLPGMEHVYGIPEHADNLRLKVTEGGEPYRLYNLDVFQYELYNPMALYGSVPVLLAHNPHRDLGIFWLNAAETWVDISSNTAGKTLFGKMMDYLQGSGETPQTDVRWMSETGIIDVFLLLGPSISDVFRQYASLTGTQALPPLFSLGYHQSRWNYRDEADVLEVDQGFDDHNLPCDVIWLDIEHADGKRYFTWDPSRFPQPRTMLERLASKRRKLVAIVDPHIKVDSGYRVHEELRNLGLYVKTRDGSDYEGWCWPGSAGYPDFTNPTMRAWWANMFSYDNYEGSAPNLFVWNDMNEPSVFNGPEVTMLKDAQHYGGWEHRDVHNIYGLYVHMATADGLRQRSGGMERPFVLARAFFAGSQRFGAVWTGDNTAEWDHLKISIPMCLSLGLVGLSFCGADVGGFFKNPEPELLVRWYQMGAYQPFFRAHAHLDTGRREPWLLPSQHNDIIRDALGQRYSLLPFWYTLLYQAHREGIPVMRPLWVQYPQDVTTFNIDDQYLLGDALLVHPVSDSGAHGVQVYLPGQGEVWYDIQSYQKHHGPQTLYLPVTLSSIPVFQRGGTIVPRWMRVRRSSECMKDDPITLFVALSPQGTAQGELFLDDGHTFNYQTRQEFLLRRFSFSGNTLVSSSADPEGHFETPIWIERVVIIGAGKPAAVVLQTKGSPESRLSFQHDPETSVLVLRKPGINVASDWSIHLR

SEQ ID NO: 5795 - protein, 79 aa, Homo Sapiens
MPSPRPVLLRGARAALLLLLPPRLLARPSLLLRRSLSAASCPPISLPAAASRSSMDGAGAEEVLAPLRLAVRQQAVWNQ

SEQ ID NO: 5796 - protein, 79 aa, Homo Sapiens; identical to SEQ ID NO: 5795

SEQ ID NO: 5797 - protein, 739 aa, Homo Sapiens
MPSPRPVLLRGARAALLLLLPPRLLARPSLLLRRSLSAASCPPISLPAAASRSSMDGAGAEEVLAPLRLAVRQQGDLVRKLKEDKAPQVDVDKAVAELKARKRVLEAKELALQPKDDIVDRAKMEDTLKRRFFYDQAFAIYGGVSGLYDFGPVGCALKNNIIQTWRQHFIQEEQILEIDCTMLTPEPVLKTSGHVDKFADFMVKDVKNGECFRADHLLKAHLQKLMSDKKCSVEKKSEMESVLAQLDNYGQQELADLFVNYNVKSPITGNDLSPPVSFNLMFKTFIGPGGNMPGYLRPETAQGIFLNFKRLLEFNQGKLPFAAAQIGNSFRNEISPRSGLIRVREFTMAEIEHFVDPSEKDHPKFQNVADLHLYLYSAKAQVSGQSARKMRLGDAVEQGVINNTVLGYFIGRIYLYLTKVGISPDKLRFRQHMENEMAHYACDCWDAESKTSYGWIEIVGCADRSCYDLSCHARATKVPLVAEKPLKEPKTVNVVQFEPSKGAIGKAYKKDAKLVMEYLAICDECYITEMEMLLNEKGEFTIETEGKTFQLTKDMINVKRFQKTLYVEEVVPNVIEPSFGLGRIMYTVFEHTFHVREGDEQRTFFSFPAVVAPFKCSVLPLSQNQEFMPFVKELSEALTRHGVSHKVDDSSGSIGRRYARTDEIGVAFGVTIDFDTVNKTPHTATLRDRDSMRQIRAEISELPSIVQDLANGNITWADVEARYPLFEGQETGKKETIEE

SEQ ID NO: 5798 - protein, 77 aa, Homo Sapiens
VVQFEPSKGAIGKAYKKDAKLVMEYLAICDECYITEMEMLLNEKGEFTIETEGKTFQLTKDMINVKRFQKTLYEQIL

SEQ ID NO: 5799 - protein, 345 aa, Homo Sapiens
MVAALLGGGGEARGGTVPGAWLCLMALLQLLGSAPRGSGLAHGRRLICWQALLQCQGEPECSYAYNQYAEACAPVLAQHGGGDAPGAAAAAFPASAASFSSRWRCPSHCISALIQLNHTRRGPALEDCDCAQDENCKSTKRAIEPCLPRTSGGGAGGPGAGGVMGCTEARRRCDRDSRCNLALSRYLTYCGKVFNGLRCTDECRTVIEDMLAMPKAALLNDCVCDGLERPICESVKENMARLCFGAELGNGPGSSGSDGGLDDYYDEDYDDEQRTGGAGGEQPLDDDDGVPHPPRPGSGAAASGGRGDLPYGPGRRSSGGGGRLAPRGAWTPLASILLLLLGPLF

SEQ ID NO: 5800 - protein, 678 aa, Homo Sapiens
MAPSLSPGPAALRRAPQLLLLLLAAECALAALLPAREATQFLRPRQRRAFQVFEEAKQGHLERECVEELCSREEAREVFENDPETDYFYPRYLDCINKYGSPYTKNSGFATCVQNLPDQCTPNPCDRKGTQACQDLMGNFFCLCKAGWGGRLCDKDVNECSQENGGCLQICHNKPGSFHCSCHSGFELSSDGRTCQDIDECADSEACGEARCKNLPGSYSCLCDEGFAYSSQEKACRDVDECLQGRCEQVCVNSPGSYTCHCDGRGGLKLSQDMDTCEDILPCVPFSVAKSVKSLYLGRMFSGTPVIRLRFKRLQPTRLVAEFDFRTFDPEGILLFAGGHQDSTWIVLALRAGRLELQLRYNGVGRVTSSGPVINHGMWQTISVEELARNLVIKVNRDAVMKIAVAGDLFQPERGLYHLNLTVGGIPFHEKDLVQPINPRLDGCMRSWNWLNGEDTTIQETVKVNTRMQCFSVTERGSFYPGSGFAFYSLDYMRTPLDVGTESTWEVEVVAHIRPAADTGVLFALWAPDLRAVPLSVALVDYHSTKKLKKQLVVLAVEHTALALMEIKVCDGQEHVVTVSLRDGEATLEVDGTRGQSEVSAAQLQERLAVLERHLRSPVLTFAGGLPDVPVTSAPVTAFYRGCMTLEVNRRLLDLDEAAYKHSDITAHSCPPVEPAAA

SEQ ID NO: 5801 - protein, 101 aa, Homo Sapiens
MQRLCVYVLIFALALAAFSEASWKPRSQQPDAPLGTGANRDLELPWLEQQGPASHHRRQLGPQGPPHLVADPSKKQGPWLEEEEEAYGWMDFGRRSAEDEN

SEQ ID NO: 5802 - protein, 144 aa, Homo Sapiens
KLESIDGARYHALLIPSCPGALTDLASSGSLARILQHFHSESKPICAVGHGVAALCCATNEDRSWVFDSYSLTGPSVCELVRAPGFARLPLVVEDFVKDSGACFSGLGAAPGWGRGGKQEDRPPEEQRRAGEDFPIYQCVFIYP

SEQ ID NO: 5803 - protein, 184 aa, Homo Sapiens
MASERLPNRPACLLVASGAAEGVSAQSFLHCFTMASTAFNLQVATPGGKAMEFVDVTESNARWVQDFRLKAYASPAKLESIDEPICAVGHGVAALCCATNEDRSWVFDSYSLTGPSVCELVRAPGFARLPLVVEDFVKDSGACFSASEPDAVHVVLDRHLVTGQNASSTVPAVQNLLFLCGSRK

SEQ ID NO: 5804 - protein, 184 aa, Homo Sapiens; identical to SEQ ID NO: 5803

SEQ ID NO: 5805 - protein, 186 aa, Homo Sapiens
MASERLPNRPACLLVASGAAEGVSAQSFLHCFTMASTAFNLQVATPGGKAMEFVDVTESNARWVQDFRLKAYASPAKLESIDGARYHALLIPSCPGALTDLASSGSLARILQHFHSESKPICAVGHGVAALCCATNEDRSWVFDSYSLTGGLGLSQEPPPRSRSPLCVSSSGPPASPACRSWWRTS

SEQ ID NO: 5806 - protein, 220 aa, Homo Sapiens
MASERLPNRPACLLVASGAAEGVSAQSFLHCFTMASTAFNLQVATPGGKAMEFVDVTESNARWVQDFRLKAYASPAKLESIDGARYHALLIPSCPGALTDLASSGSLARILQHFHSESKPICAVGHGVAALCCATNEDRSWVFDSYSLTGPSVCELVRAPGFARLPLVVEDFVKDSGACFSASEPDAVHVVLDRHLVTGQNASSTVPAVQNLLFLCGSRK

SEQ ID NO: 5807 - protein, 250 aa, Homo Sapiens
MASERLPNRPACLLVASGAAEGVSAQSFLHCFTMASTAFNLQVATPGGKAMEFVDVTESNARWVQDFRLKAYASPAKLESIDGARYHALLIPSCPGALTDLASSGSLARILQHFHSESKPICAVGHGVAALCCATNEDRSWVFDSYSLTGPSVCELVRAPGFARLPLVVEDFVKDSGACFSGAAASCPKADRHWQHFPVEEIFLACGFKVAGLGAAPGWGRGGKQEDRPPEEQRRAGEDFPIYQCVFIYP

SEQ ID NO: 5808 - protein, 120 aa, Homo Sapiens
MASERLPNRPACLLVASGAAEGVSAQSFLHCFTMASTAFNLQVATPGGKAMEFVDVTESNARWVQDFRLKAYASPAKLESIDGARYHALLIPSCPGALTDLASSGSLARILQHFHSESSR

SEQ ID NO: 5809 - protein, 162 aa, Homo Sapiens
WVQDFRLKAYASPAKLESIDGARYHALLIPSCPGALTDLASSGSLARILQHFHSESKPICAVGHGVAALCCATNEDRSWVFDSYSLTGPSVCELVRAPGFARLPLVVEDFVKDSGACFSGQGLGQHQAGAEEESKRTDLQKSSGGRVRISPYTSVCSSTHEE

SEQ ID NO: 5810 - protein, 87 aa, Homo Sapiens
  misc_feature (1)..(1): Xaa can be any naturally occurring amino acid
XPSVCELVRAPGFARLPLVVEDFVKDSGACFSASEPDAVHVVLDRHLVTGQNASSTVPAVQNLLFLCGSRSSSLLPQGRPALAALSC

SEQ ID NO: 5811 - protein, 487 aa, Homo Sapiens
MEFSSPSREECPKPLSRVSIMAGSLTGLLLLQAVSWASGARPCIPKSFGYSSVVCVCNATYCDSFDPPTFPALGTFSRYESTRSGRRMELSMGPIQANHTGTGIGYNIIRVPMASCDFSIRTYTYADTPDDFQLHNFSLPEEDTKLKIPLIHRALQLAQRPVSLLASPWTSPTWLKTNGAVNGKGSLKGQPGDIYHQTWARYFVKFLDAYAEHKLQFWAVTAENEPSAGLLSGYPFQCLGFTPEHQRDFIARDLGPTLANSTHHNVRLLMLDDQRLLLPHWAKVVLTDPEAAKYVHGIAVHWYLDFLAPAKATLGETHRLFPNTMLFASEACVGSKFWEQSVRLGSWDRGMQYSHSIITNLLYHVVGWTDWNLALNPEGGPNWVRNFVDSPIIVDITKDTFYKQPMFYHLGHFSKFIPEGSQRVGLVASQKNDLDAVALMHPDGSAVVVVLNRSSKDVPLTIKDPAVGFLETISPGYSIHTYLWRRQ

SEQ ID NO: 5812 - protein, 536 aa, Homo Sapiens
MEFSSPSREECPKPLSRVSIMAGSLTGLLLLQAVSWASGARPCIPKSFGYSSVVCVCNATYCDSFDPPTFPALGTFSRYESTRSGRRMELSMGPIQANHTGTGLLLTLQPEQKFQKVKGFGGAMTDAAALNILALSPPAQNLLLKSYFSEEGIGYNIIRVPMASCDFSIRTYTYADTPDDFQLHNFSLPEEDTKLKIPLIHRALQLAQRPVSLLASPWTSPTWLKTNGAVNGKGSLKGQPGDIYHQTWARYFVKFLDAYAEHKLQFWAVTAENEPSAGLLSGYPFQCLGFTPEHQRDFIARDLGPTLANSTHHNVRLLMLDDQRLLLPHWAKVVLTDPEAAKYVHGIAVHWYLDFLAPAKATLGETHRLFPNTMLFASEACVGSKFWEQSVRLGSWDRGMQYSHSIITNLLYHVVGWTDWNLALNPEGGPNWVRNFVDSPIIVDITKDTFYKQPMFYHLGHFSKFIPEGSQRVGLVASQKNDLDAVALMHPDGSAVVVVLNRSSKDVPLTIKDPAVGFLETISPGYSIHTYLWRRQ

SEQ ID NO: 5813 - protein, 536 aa, Homo Sapiens; identical to SEQ ID NO: 5812

SEQ ID NO: 5814 - protein, 449 aa, Homo Sapiens
MELSMGPIQANHTGTGLLLTLQPEQKFQKVKGFGGAMTDAAALNILALSPPAQNLLLKSYFSEEGIGYNIIRVPMASCDFSIRTYTYADTPDDFQLHNFSLPEEDTKLKIPLIHRALQLAQRPVSLLASPWTSPTWLKTNGAVNGKGSLKGQPGDIYHQTWARYFVKFLDAYAEHKLQFWAVTAENEPSAGLLSGYPFQCLGFTPEHQRDFIARDLGPTLANSTHHNVRLLMLDDQRLLLPHWAKVVLTDPEAAKYVHGIAVHWYLDFLAPAKATLGETHRLFPNTMLFASEACVGSKFWEQSVRLGSWDRGMQYSHSIITNLLYHVVGWTDWNLALNPEGGPNWVRNFVDSPIIVDITKDTFYKQPMFYHLGHFSKFIPEGSQRVGLVASQKNDLDAVALMHPDGSAVVVVLNRSSKDVPLTIKDPAVGFLETISPGYSIHTYLWRRQ

SEQ ID NO: 5815 - protein, 54 aa, Homo Sapiens
MHRRRLALGLGFCLLAGTSLSVLWVYLENWLPVSYVPYYLPCPEIFILAAPCMV

SEQ ID NO: 5816 - protein, 160 aa, Homo Sapiens
MHRRRLALGLGFCLLAGTSLSVLWVYLENWLPVSYVPYYLPCPEIFNMKLHYKREKPLQPVVWSQYPQPKLLEHRGGSQCPRPPCCQAHTAADTHTLVGAHRLRGNLQPRASAAHLPATEPDHWGHGVCRGEVHSFHPVLPGVSRGVLHAWVPGALLHLH

SEQ ID NO: 5817 - protein, 120 aa, Homo Sapiens
MHRRRLALGLGFCLLAGTSLSVLWVYLENWLPVSYVPYYLPCPEIFNMKLHYKREKPLQPVVWSQYPQPKLLEHRPTQLLTLTPWLAPIVSEGTFNPELLQHIYQPLNLTIGVTVFAVGK

SEQ ID NO: 5818 - protein, 347 aa, Homo Sapiens
MHRRRLALGLGFCLLAGTSLSVLWVYLENWLPVSYVPYYLPCPEIFNMKLHYKREKPLQPVVWSQYPQPKLLEHRPTQLLTLTPWLAPIVSEGTFNPELLQHIYQPLNLTIGVTVFAVGKYTHFIQSFLESAEEFFMRGYRVHYYIFTDNPAAVPGVPLGPHRLLSSIPIQGHSHWEETSMRRMETISQHIAKRAHREVDYLFCLDVDMVFRNPWGPETLGDLVAAIHPSYYAVPRQQFPYERRRVSTAFVADSEGDFYYGGAVFGGQVARVYEFTRGCHMAILADKANGIMAAWREESHLNRHFISNKPSKVLSPEYLWDDRKPQPPSLKLIRFSTLDKDISCLRS

SEQ ID NO: 5819 - protein, 294 aa, Homo Sapiens
MHRRRLALGLGFCLLAGTSLSVLWVYLENWLPVSYVPYYLPCPEIFNMKLHYKREKPLQPVVWSQYPQPKLLEHRPTQLLTLTPWLAPIVSEGTFNPELLQHIYQPLNLTIGVTVFAVGNPSWSQPRSSSCVGTGCTTTSSLTTLQPFPGSRWVPTGFSAPSPSRVTPTGRRHPCAGWRPSASTLLRGLTGRWTTSSALMWTWCFGTRGALRPWETWWLPFTQATTPFPASSSPMSAGVFPLPLWQTAKGTSIMVGQSSGGRWPGYMSLLGAATWPSWRTRPMASWLPGGRKAT

SEQ ID NO: 5820 - protein, 72 aa, Homo Sapiens
MHRRRLALGLGFCLLAGTSLSVLWVYLENWLPVSYVPYYLPCPEILLEYRGVISAHCNLHLPGSSNCHASAT

SEQ ID NO: 5821 - protein, 72 aa, Homo Sapiens; identical to SEQ ID NO: 5820

SEQ ID NO: 5822 - protein, 160 aa, Homo Sapiens
MHRRRLALGLGFCLLAGTSLSVLWVYLENWLPVSYVPYYLPCPEILPMMMALSCLCHQQHEAALQEGEATPARGMVTVPSAQAAGAQAHTAADTHTLVGAHRLRGNLQPRASAAHLPATEPDHWGHGVCRGEVHSFHPVLPGVSRGVLHAWVPGALLHLH

SEQ ID NO: 5823 - protein, 330 aa, Homo Sapiens
MHRRRLALGLGFCLLAGTSLSVLWVYLENWLPVSYVPYYLPCPEILSQYPQPKLLEHRPTQLLTLTPWLAPIVSEGTFNPELLQHIYQPLNLTIGVTVFAVGKYTHFIQSFLESAEEFFMRGYRVHYYIFTDNPAAVPGVPLGPHRLLSSIPIQGHSHWEETSMRRMETISQHIAKRAHREVDYLFCLDVDMVFRNPWGPETLGDLVAAIHPSYYAVPRQQFPYERRRVSTAFVADSEGDFYYGGAVFGGQVARVYEFTRGCHMAILADKANGIMAAWREESHLNRHFISNKPSKVLSPEYLWDDRKPQPPSLKLIRFSTLDKDISCLRS

SEQ ID NO: 5824 - protein, 145 aa, Homo Sapiens
MKRVLVLLLAVAFGHALERGRDYEKNKVCKEFSHLGKEDFTSLSLVLYSRKFPSGTFEQVSQLVKEVVSLTEACCAEGADPDCYDTRTSALSAKSCESNSPFPVHPGTAECCTKEGLERKLCMAALKHQPQEFPTYVEPTNDEIC

SEQ ID NO: 5825 - protein, 474 aa, Homo Sapiens
MKRVLVLLLAVAFGHALERGRDYEKNKVCKEFSHLGKEDFTSLSLVLYSRKFPSGTFEQVSQLVKEVVSLTEACCAEGADPDCYDTRTSALSAKSCESNSPFPVHPGTAECCTKEGLERKLCMAALKHQPQEFPTYVEPTNDEICEAFRKDPKEYANQFMWEYSTNYGQAPLSLLVSYTKSYLSMVGSCCTSASPTVCFLKERLQLKHLSLLTTLSNRVCSQYAAYGEKKSRLSNLIKLAQKVPTADLEDVLPLAEDITNILSKCCESASEDCMAKELPEHTVKLCDNLSTKNSKFEDCCQEKTAMDVFVCTYFMPAAQLPELPDVELPTNKDVCDPGNTKVMDKYTFELSRRTHLPEVFLSKVLEPTLKSLGECCDVEDSTTCFNAKGPLLKKELSSFIDKGQELCADYSENTFTEYKKKLAERLKAKLPDATPTELAKLVNKHSDFASNCCSINSPPLYCDSEIDAELKNIL

SEQ ID NO: 5826 - protein, 348 aa, Homo Sapiens
MKRVLVLLLAVAFGHALERGRDYEKNKVCKEFSHLGKEDFTSLSLVLYSRKFPSGTFEQVSQLVKEVVSLTEACCAEGADPDCYDTRTSALSAKSCESNSPFPVHPGTAECCTKEGLERKLCMAALKHQPQEFPTYVEPTNDEICEAFRKDPKEYANQFMWEYSTNYGQAPLSLLVSYTKSYLSMVGSCCTSASPTVCFLKERLQLKHLSLLTTLSNRVCSQYAAYGEKKSRLSNLIKLAQKVPTADLEDVLPLAEDITNILSKCCESASEDCMAKELPEHTVKLCDNLSTKNSKFEDCCQEKTAMDVFVCTYFMPAAQLPELPDVELPTNKDVCDPGNTKVMDKALY

SEQ ID NO: 5827 - protein, 476 aa, Homo Sapiens
MKRVLVLLLAVAFGHALERGRDYEKNKVCKEFSHLGKEDFTSLSLVLYSRKFPSGTFEQVSQLVKEVVSLTEACCAEGADPDCYDTRTSALSAKSCESNSPFPVHPGTAECCTKEGLERKLCMAALKHQPQEFPTYVEPTNDEICEAFRKDPKEYANQFMWEYSTNYGQAPLSLLVSYTKSYLSMVGSCCTSASPTVCFLKERLQLKHLSLLTTLSNRVCSQYAAYGEKKSRLSNLIKLAQKVPTADLEDVLPLAEDITNILSKCCESASEDCMAKELPEHTVKLCDNLSTKNSKFEDCCQEKTAMDVFVCTYFMPAAQLPELPDVELPTNKDVCDPGNTKVMDKYTFELSRRTHLPEVFLSKVLEPTLKSLGECCDVEDSTTCFNAKGPLLKKELSSFIDKGQELCADYSENTFTEYKKKLAERLKAKLPDATPTELAKLVNKHSDFASNCCSINSPPLYCDSETRVGATQGNDL

SEQ ID NO: 5828 - protein, 493 aa, Homo Sapiens
MLWSWSEERGGAARLSGRKMKRVLVLLLAVAFGHALERGRDYEKNKVCKEFSHLGKEDFTSLSLVLYSRKFPSGTFEQVSQLVKEVVSLTEACCAEGADPDCYDTRTSALSAKSCESNSPFPVHPGTAECCTKEGLERKLCMAALKHQPQEFPTYVEPTNDEICEAFRKDPKEYANQFMWEYSTNYGQAPLSLLVSYTKSYLSMVGSCCTSASPTVCFLKERLQLKHLSLLTTLSNRVCSQYAAYGEKKSRLSNLIKLAQKVPTADLEDVLPLAEDITNILSKCCESASEDCMAKELPEHTVKLCDNLSTKNSKFEDCCQEKTAMDVFVCTYFMPAAQLPELPDVELPTNKDVCDPGNTKVMDKYTFELSRRTHLPEVFLSKVLEPTLKSLGECCDVEDSTTCFNAKGPLLKKELSSFIDKGQELCADYSENTFTEYKKKLAERLKAKLPDATPTELAKLVNKHSDFASNCCSINSPPLYCDSEIDAELKNIL

SEQ ID NO: 5829 - protein, 180 aa, Homo Sapiens
MKSIYFVAGLFVMLVQGSWQRSLQDTEEKSRSFSASQADPLSDPDQMNEDKRHSQGTFTSDYSKYLDSRRAQDFVQWLMNTKRNRNNIAKRHDEFERHAEGTFTSDVSSYLEGQAAKEFIAWLVKGRGRRDFPEEVAIVEELGRRHADGSFSDEMNTILDNLAARDFINWLIQTKITDRK

SEQ ID NO: 5830 - protein, 180 aa, Homo Sapiens; identical to SEQ ID NO: 5829

SEQ ID NO: 5831 - protein, 80 aa, Homo Sapiens
MPPCQPQRPLLLLLLLLACQPQVPSAQVMDFLFEKWKLYGDQCHHNLSLLPPPTELVCNRTFDKYSCWPDTPANTTANIS

SEQ ID NO: 5832 - protein, 477 aa, Homo Sapiens
MPPCQPQRPLLLLLLLLACQPQVPSAQVMDFLFEKWKLYGDQCHHNLSLLPPPTELVCNRTFDKYSCWPDTPANTTANISCPWYLPWHHKVQHRFVFKRCGPDGQWVRGPRGQPWRDASQCQMDGEEIEVQKEVAKMYSSFQVMYTVGYSLSLGALLLALAILGGLSKLHCTRNAIHANLFASFVLKASSVLVIDGLLRTRYSQKIGDDLSVSTWLSDGAVAGCRVAAVFMQYGIVANYCWLLVEGLYLHNLLGLATLPERSFFSLYLGIGWGAPMLFVVPWAVVKCLFENVQCWTSNDNMGFWWILRFPVFLAILINFFIFVRIVQLLVAKLRARQMHHTDYKFRLAKSTLTLIPLLGVHEVVFAFVTDEHAQGTLRSAKLFFDLFLSSFQGLLVAVLYCFLNKEVQSELRRRWHRWRLGKVLWEERNTSNHRASSSPGHGPPSKELQFGRGGGSQDSSAETPLAGGLPRLAESPF

SEQ ID NO: 5833 - protein, 523 aa, Homo Sapiens
MPPCQPQRPLLLLLLLLACQPQVPSAQVMDFLFEKWKLYGDQCHHNLSLLPPPTELVCNRTFDKYSCWPDTPANTTANISCPWYLPWHHKVQHRFVFKRCGPDGQWVRGPRGQPWRDASQCQMDGEEIEVQKEVAKMYSSFQVMYTVGYSLSLGALLLALAILGGLSKLHCTRNAIHANLFASFVLKASSVLVIDGLLRTRYSQKIGDDLSVSTWLSDGVSPPRRPQAGGWVGSQAGGHVAALTLHLYQAVAGCRVAAVFMQYGIVANYCWLLVEGLYLHNLLGLATLPERSFFSLYLGIGWGAPMLFVVPWAVVKCLFENVQCWTSNDNMGFWWILRFPVFLAILINFFIFVRIVQLLVAKLRARQMHHTDYKFRLAKSTLTLIPLLGVHEVVFAFVTDEHAQGTLRSAKLFFDLFLSSFQVPARPPAPPPGAQCATPDHPVSPGPAGGCPLLLPQQGGAVGAAAALAPLAPGQSAMGGAEHQQPQGLIFARPRPSQQGAAVWEGWWQPGFICGDPLGWWPP

SEQ ID NO: 5834 - protein, 308 aa, Homo Sapiens
MFVQLLRAIYVPQNVYCIHVDEKAPMKYKTAVQTLVNCFENVFISSKTEKVAYAGFTRLQADINCMKVLVHSKFQWNYVINLCGQDFPIKTNREIIHYIRSKWSDKNITPGVIQPLHIKSKTSQSHLEFVPKGSIYAPPNNRFKDKPPHNLTIYFGSAYYVLTRKFVEFILTDIHAKDMLQWSKDIRSPEQHYWVTLNRLKDAPGATPNAGWEGNVRAIKRKSEEGNVHDGCKGRYVEDICVYGPGDLPWLIQSPSLFANKFEPSTDPLVVTCLERRHRLQVLRQAEVPIEPHWHFQQQSHFNMRLNR

SEQ ID NO: 5835 - protein, 429 aa, Homo Sapiens
MSQLRATKSGLVVRAVICIFIFLYLRNPTPAESEEEPAQPEVVECGFYPDELCSALFEGKGAAPIAKFCKTPHKSEIHAHLHTPGNCSRISRGLHFITRPLSAEEGDFSLAYIITIHKELAMFVQLLRAIYVPQNVYCIHVDEKAPMKYKTAVQTLVNCFENVFISSKTEKVAYAGFTRLQADINCMKVLVHSKFQWNYVINLCGQDFPIKTNREIIHYIRSKWSDKNITPGVIQPLHIKSKTSQSHLEFVPKGSIYAPPNNRFKDKPPHNLTIYFGSAYYVLTRKFVEFILTDIHAKDMLQWSKDIRSPEQHYWVTLNRLKDAPGATPNAGWEGNVRAIKRKSEEGNVHDGCKGRYVEDICVYGPGDLPWLIQSPSLFANKFEPSTDPLVVTCLERRHRLQVLRQAEVPIEPHWHFQQQSHFNMRLNR

SEQ ID NO: 5836 - protein, 50 aa, Homo Sapiens
MALRVVRSVRALLCTLRAVPSPAAPCPPRPWQLGVGAVRTLRTGPALLSG

SEQ ID NO: 5837 - protein, 58 aa, Homo Sapiens
MALRVVRSVRALLCTLRAVPSPAAPCPPRPWQLGVGAVRTLRTGPALLSGSVGRCCLL

SEQ ID NO: 5838 - protein, 162 aa, Homo Sapiens
MALRVVRSVRALLCTLRAVPSPAAPCPPRPWQLGVGAVRTLRTGPALLSVRKFTEKHEWVTTENGIGTVGISNFAQEALGDVVYCSLPEVGTKLNKQDEFGALESVKAASELYSPLSGEVTEINEALAENPGLVNKSCYEDGKLLLEISQGITTTVNILSRI

SEQ ID NO: 5839 - protein, 173 aa, Homo Sapiens
MALRVVRSVRALLCTLRAVPSPAAPCPPRPWQLGVGAVRTLRTGPALLSVRKFTEKHEWVTTENGIGTVGISNFAQEALGDVVYCSLPEVGTKLNKQDEFGALESVKAASELYSPLSGEVTEINEALAENPGLVNKSCYEDGWLIKMTLSNPSELDELMSEEAYEKYIKSIEE

SEQ ID NO: 5840 - protein, 118 aa, Homo Sapiens
SVRALLCTLRAVPSPAAPCPPRPWQLGVGAVRTLRTGPALLSDEFGALESVKAASELYSPLSGEVTEINEALAENPGLVNKSCYEDGWLIKMTLSNPSELDELMSEEAYEKYIKSIEE

SEQ ID NO: 5841 - protein, 66 aa, Homo Sapiens
  misc_feature (1)..(1): Xaa can be any naturally occurring amino acid
XCTLRAVPSPAAPCPPRPWQLGVGAVRTLRTGPALLSVRKFTEKHEWVTTENGIGTVGISNFAQVG

SEQ ID NO: 5842 - protein, 100 aa, Homo Sapiens
  misc_feature (1)..(1): Xaa can be any naturally occurring amino acid
XEKHEWVTTENGIGTVGISNFAQEALGDVVYCSLPEVGTKLNKQGEVTEINEALAENPGLVNKSCYEDGWLIKMTLSNPSELDELMSEEAYEKYIKSIEE

SEQ ID NO: 5843 - protein, 105 aa, Homo Sapiens
  misc_feature (1)..(1): Xaa can be any naturally occurring amino acid
XTLRTGPALLSVRKFTEKHEWVTTENGIGTVGISNFAQEALGDVVYCSLPEVGTKLNKQDEFGALESVKAASELYSPLSGEVTEINEALAENPGLVNKSCYEDVS

SEQ ID NO: 5844 - protein, 80 aa, Homo Sapiens
  misc_feature (1)..(1): Xaa can be any naturally occurring amino acid
XVRSVRALLCTLRAVPSPAAPCPPRPWQLGVGAVRTLRTGPALLSVRKFTEKHEWVTTENGIGTVGISNFAQMSLVLWKV

SEQ ID NO: 5845 - protein, 372 aa, Homo Sapiens; identical to SEQ ID NO: 2629

SEQ ID NO: 5846 - protein, 478 aa, Homo Sapiens
MAHVPARTSPGPGPQLLLLLLPLFLLLLRDVAGSHRAPAWSALPAAADGLQGDRDLQRHPGDAAATLGPSAQDMVAVHMHRLYEKYSRQGARPGGGNTVRSFRARLEVVDQKAVYFFNLTSMQDSEMILTATFHFYSEPPRWPRALEVLCKPRAKNASGRPLPLGPPTRQHLLFRSLSQNTATQGLLRGAMALAPPPRGLWQAKDISPIVKAARRDGELLLSAQLDSEERDPGVPRPSPYAPYILVYANDLAISEPNSVAVTLQRYDPFPAGDPEPRAAPNNSADPRVRRAAQATGPLQDNELPGLDERPPRAHAQHFHKHQLWPSPFRALKPRPGRKDRRKKGQEVFMAASQVLDFDEKTMQKARRKQWDEPRVCSRRYLKVDFADIGWNEWIISPKSFDAYYCAGACEFPMPKIVRPSNHATIQSIVRAVGIIPGIPEPCCVPDKMNSLGVLFLDENRNVVLKVYPNMSVDTCACR

SEQ ID NO: 5847 - protein, 407 aa, Homo Sapiens
MVLAAPLLLGFLLLALELRPRGEAAEGPAAAAAAAAAAAAAGVGGERSSRPAPSVAPEPDGCPVCVWRQHSRELRLESIKSQILSKLRLKEAPNISREVVKQLLPKAPPLQQILDLHDFQGDALQPEDFLEEDEYHATTETVISMAQETDPAVQTDGSPLCCHFHFSPKVMFTKVLKAQLWVYLRPVPRPATVYLQILRLKPLTGEGTAGGGGGGRRHIRIRSLKIELHSRSGHWQSIDFKQVLHSWFRQPQSNWGIEINAFDPSGTDLAVTSLGPGAEGLHPFMELRVLENTKRSRRNLGLDCDEHSSESRCCRYPLTVDFEAFGWDWIIAPKRYKANYCSGQCEYMFMQKYPHTHLVQQANPRGSAGPCCTPTKMSPINMLYFNDKQQIIYGKIPGMVVDRCGCS

SEQ ID NO: 5848 - protein, 380 aa, Homo Sapiens
  misc_feature (1)..(1): Xaa can be any naturally occurring amino acid
XAAAAAAAAAAAAAGVGGERSSRPAPSVAPEPDGCPVCVWRQHSRELRLESIKSQILSKLRLKEAPNISREVVKQLLPKAPPLQQILDLHDFQGDALQPEDFLEEDEYHATTETVISMAQETDPAVQTDGSPLCCHFHFSPKVMFTKVLKAQLWVYLRPVPRPATVYLQILRLKPLTGEGTAGGGGGGRRHIRIRSLKIELHSRSGHWQSIDFKQVLHSWFRQPQSNWGIEINAFDPSGTDLAVTSLGPGAEGLHPFMELRVLENTKRSRRNLGLDCDEHSSESRCCRYPLTVDFEAFGWDWIIAPKRYKANYCSGQCEYMFMQKYPHTHLVQQANPRGSAGPCCTPTKMSPINMLYFNDKQQIIYGKIPGMVVDRCGCS

SEQ ID NO: 5849 - protein, 6 aa, Homo Sapiens
MPGQEL

SEQ ID NO: 5850 - protein, 113 aa, Homo Sapiens
MPGQELRTVNGSQMLLVLLVLSWLPHGGALSLAEASRASFPGPSELHSEDSRFRELRKRYEDLLTRLRANQSWEDSNTDLVPAPAVRILTPEVRLGSGGHLHLRISRAALPEG

SEQ ID NO: 5851 - protein, 308 aa, Homo Sapiens
MPGQELRTVNGSQMLLVLLVLSWLPHGGALSLAEASRASFPGPSELHSEDSRFRELRKRYEDLLTRLRANQSWEDSNTDLVPAPAVRILTPEVRLGSGGHLHLRISRAALPEGLPEASRLHRALFRLSPTASRSWDVTRPLRRQLSLARPQAPALHLRLSPPPSQSDQLLAESSSARPQLELHLRPQAARGRRRARARNGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 5852 - protein, 429 aa, Homo Sapiens
MCPGALWVALPLLSLLAGSLQGKPLQSWGRGSAGGNAHSPLGVPGGGLPEHTFNLKMFLENVKVDFLRSLNLSGVPSQDKTRVEPPQYMIDLYNRYTSDKSTTPASNIVRSFSMEDAISITATEDFPFQKHILLFNISIPRHEQITRAELRLYVSCQNHVDPSHDLKGSVVIYDVLDGTDAWDSATETKTFLVSQDIQDEGWETLEVSSAVKRWVRSDSTKSKNKLEVTVESHRKGCDTLDISVPPGSRNLPFFVVFSNDHSSGTKETRLELREMISHEQESVLKKLSKDGSTEAGESSHEEDTDGHVAAGSTLARRKRSAGAGSHCQKTSLRVNFEDIGWDSWIIAPKEYEAYECKGGCFFPLADDVTPTKHAIVQTLVHLKFPTKVGKACCVPTKLSPISVLYKDDMGVPTLKYHYEGMSVAECGCR

SEQ ID NO: 5853 - protein, 364 aa, Homo Sapiens
MLRFLPDLAFSFLLILALGQAVQFQEYVFLQFLGLDKAPSPQKFQPVPYILKKIFQDREAAATTGVSRDLCYVKELGVRGNVLRFLPDQGFFLYPKKISQASSCLQKLLYFNLSAIKEREQLTLAQLGLDLGPNSYYNLGPELELALFLVQEPHVWGQTTPKPGKMFVLRSVPWPQGAVHFNLLDVAKDWNDNPRKNFGLFLEILVKEDRDSGVNFQPEDTCARLRCSLHASLLVVTLNPDQCHPSRKRRAAIPVPKLSCKNLCHRHQLFINFRDLGWHKWIIAPKGFMANYCHGECPFSLTISLNSSNYAFMQALMHAVDPEIPQAVCIPTKLSPISMLYQDNNDNVILRHYEDMVVDECGCG

SEQ ID NO: 5854 - protein, 501 aa, Homo Sapiens
MRLPKLLTFLLWYLAWLDLEFICTVLGAPDLGQRPQGTRPGLAKAEAKERPPLARNVFRPGGHSYGGGATNANARAKGGTGQTGGLTQPKKDEPKKLPPRPGGPEPKPGHPPQTRQATARTVTPKGQLPGGKAPPKAGSVPSSFLLKKAREPGPPREPKEPFRPPPITPHEYMLSLYRTLSDADRKGGNSSVKLEAGLANTITSFIDKGQDDRGPVVRKQRYVFDISALEKDGLLGAELRILRKKPSDTAKPAAPGGGRAAQLKLSSCPSGRQPAALLDVRSVPGLDGSGWEVFDIWKLFRNFKNSAQLCLELEAWERGRAVDLRGLGFDRAARQVHEKALFLVFGRTKKRDLFFNEIKARSGQDDKTVYEYLFSQRRKRRAPLATRQGKRPSKNLKARCSRKALHVNFKDMGWDDWIIAPLEYEAFHCEGLCEFPLRSHLEPTNHAVIQTLMNSMDPESTPPTCCVPTRLSPISILFIDSANNVVYKQYEDMVVESCGCR

SEQ ID NO: 5855 - protein, 501 aa, Homo Sapiens; identical to SEQ ID NO: 5854

SEQ ID NO: 5856 - protein, 271 aa, Homo Sapiens [sequence omitted]

SEQ ID NO: 5857 - protein, 455 aa, Homo Sapiens
MDTPRVLLSAVFLISFLWDLPGFQQASISSSSSSAELGSTKGMRSRKEGKMQRAPRDSDAGREGQEPQPRPQDEPRAQQPRAQEPPGRGPRVVPHEYMLSIYRTYSIAEKLGINASFFQSSKSANTITSFVDRGLDDLSHTPLRRQKYLFDVSMLSDKEELVGAELRLFRQAPSAPWGPPAGPLHVQLFPCLSPLLLDARTLDPQGAPPAGWEVFDVWQGLRHQPWKQLCLELRAAWGELDAGEAEARARGPQQPPPPDLRSLGFGRRVRPPQERALLVVFTRSQRKNLFAEMREQLGSAEAAGPGAGAEGSWPPPSGAPDARPWLPSPGRRRRRTAFASRHGKRHGKKSRLRCSKKPLHVNFKELGWDDWIIAPLEYEAYHCEGVCDFPLRSHLEPTNHAIIQTLMNSMDPGSTPPSCCVPTKLTPISILYIDAGNNVVYKQYEDMVVESCGCR

SEQ ID NO: 5858 - protein, 353 aa, Homo Sapiens [sequence omitted]

SEQ ID NO: 5859 - protein, 450 aa, Homo Sapiens
MDLSAAAALCLWLLSACRPRDGLEAAAVLRAAGAGPVRSPGGGGGGGGGGRTLAQAAGAAAVPAAAVPRARAARRAAGSGFRNGSVVPHHFMMSLYRSLAGRAPAGAAAVSASGHGRADTITGFTDQATQDESAAETGQSFLFDVSSLNDADEVVGAELRVLRRGSPESGPGSWTSPPLLLLSTCPGAARAPRLLYSRAAEPLVGQRWEAFDVADAMRRHRREPRPPRAFCLLLRAVAGPVPSPLALRRLGFGWPGGGGSAAEERAVLVVSSRTQRKESLFREIRAQARALGAALASEPLPDPGTGTASPRAVIGGRRRRRTALAGTRTAQGSGGGAGRGHGRRGRSRCSRKPLHVDFKELGWDDWIIAPLDYEAYHCEGLCDFPLRSHLEPTNHAIIQTLLNSMAPDAAPASCCVPARLSPISILYIDAANNVVYKQYEDMVVEACGCR

SEQ ID NO: 5860 - protein, 454 aa, Homo Sapiens
MARPNKFLLWFCCFAWLCFPISLGSQASGGEAQIAASAELESGAMPWSLLQHIDERDRAGLLPALFKVLSVGRGGSPRLQPDSRALHYMKKLYKTYATKEGIPKSNRSHLYNTVRLFTPCTRHKQAPGDQVTGILPSVELLFNLDRITTVEHLLKSVLLYNINNSVSFSSAVKCVCNLMIKEPKSSSRTLGRAPYSFTFNSQFEFGKKHKWIQIDVTSLLQPLVASNKRSIHMSINFTCMKDQLEHPSAQNGLFNMTLVSPSLILYLNDTSAQAYHSWYSLHYKRRPSQGPDQERSLSAYPVGEEAAEDGRSSHHRHRRGQETVSSELKKPLGPASFNLSEYFRQFLLPQNECELHDFRLSFSQLKWDNWIVAPHRYNPRYCKGDCPRAVGHRYGSPVHTMVQNIIYEKLDSSVPRPSCVPAKYSPLSVLTIEPDGSIAYKEYEDMIATKCTCR

SEQ ID NO: 5861 - protein, 366 aa, Homo Sapiens
MKKLYKTYATKEGIPKSNRSHLYNTVRLFTPCTRHKQAPGDQVTGILPSVELLFNLDRITTVEHLLKSVLLYNINNSVSFSSAVKCVCNLMIKEPKSSSRTLGRAPYSFTFNSQFEFGKKHKWIQIDVTSLLQPLVASNKRSIHMSINFTCMKDQLEHPSAQNGLFNMTLVSPSLILYLNDTSAQAYHSWYSLHYKRRPSQGPDQERSLSAYPVGEEAAEDGRSSHHRHRRGQETVSSELKKPLGPASFNLSEYFRQFLLPQNECELHDFRLSFSQLKWDNWIVAPHRYNPRYCKGDCPRAVGHRYGSPVHTMVQNIIYEKLDSSVPRPSCVPAKYSPLSVLTIEPDGSIAYKEYEDMIATKCTCR

SEQ ID NO: 5862 - protein, 366 aa, Homo Sapiens; identical to SEQ ID NO: 5861

SEQ ID NO: 5863 - protein, 366 aa, Homo Sapiens; identical to SEQ ID NO: 5861

SEQ ID NO: 5864 - protein, 366 aa, Homo Sapiens; identical to SEQ ID NO: 5861

SEQ ID NO: 5865 - protein, 61 aa, Homo Sapiens
MKLWDVVAVCLVLLHTASAFPLPAANMPEDYPDQFDDVMDFIQATIKRLKRSPDKQMAVLP

SEQ ID NO: 5866 - protein, 61 aa, Homo Sapiens; identical to SEQ ID NO: 5865

SEQ ID NO: 5867 - protein, 185 aa, Homo Sapiens
MKLWDVVAVCLVLLHTASAFPLPAANMPEDYPDQFDDVMDFIQATIKRLKRSPDKQMAVLPRRERNRQAAAANPENSRGKGRRGQRGKNRGCVLTAIHLNVTDLGLGYETKEELIFRYCSGSCDAAETTYDKILKNLSRNRRLVSDKVGQACCRPIAFDDDLSFLDDNLVYHILRKHSAKRCGCI

SEQ ID NO: 5868 - protein, 185 aa, Homo Sapiens; identical to SEQ ID NO: 5867

SEQ ID NO: 5869 - protein, 211 aa, Homo Sapiens
MKLWDVVAVCLVLLHTASAFPLPAGKRPPEAPAEDRSLGRRRAPFALSSDSNMPEDYPDQFDDVMDFIQATIKRLKRSPDKQMAVLPRRERNRQAAAANPENSRGKGRRGQRGKNRGCVLTAIHLNVTDLGLGYETKEELIFRYCSGSCDAAETTYDKILKNLSRNRRLVSDKVGQACCRPIAFDDDLSFLDDNLVYHILRKHSAKRCGCI

SEQ ID NO: 5870 - protein, 159 aa, Homo Sapiens
MPEDYPDQFDDVMDFIQATIKRLKRSPDKQMAVLPRRERNRQAAAANPENSRGKGRRGQRGKNRGCVLTAIHLNVTDLGLGYETKEELIFRYCSGSCDAAETTYDKILKNLSRNRRLVSDKVGQACCRPIAFDDDLSFLDDNLVYHILRKHSAKRCGCI

SEQ ID NO: 5871 - protein, 202 aa, Homo Sapiens
MQSLPNSNGAAAGRDFKMKLWDVVAVCLVLLHTASAFPLPAANMPEDYPDQFDDVMDFIQATIKRLKRSPDKQMAVLPRRERNRQAAAANPENSRGKGRRGQRGKNRGCVLTAIHLNVTDLGLGYETKEELIFRYCSGSCDAAETTYDKILKNLSRNRRLVSDKVGQACCRPIAFDDDLSFLDDNLVYHILRKHSAKRCGCI

SEQ ID NO: 5872 - protein, 228 aa, Homo Sapiens
MQSLPNSNGAAAGRDFKMKLWDVVAVCLVLLHTASAFPLPAGKRPPEAPAEDRSLGRRRAPFALSSDSNMPEDYPDQFDDVMDFIQATIKRLKRSPDKQMAVLPRRERNRQAAAANPENSRGKGRRGQRGKNRGCVLTAIHLNVTDLGLGYETKEELIFRYCSGSCDAAETTYDKILKNLSRNRRLVSDKVGQACCRPIAFDDDLSFLDDNLVYHILRKHSAKRCGCI

SEQ ID NO: 5873 - protein, 90 aa, Homo Sapiens
MKMLPGVGVFGTGSSARVLVPLLRAEGFTVEALWGKTEEEAKQLAEEMNIAFYTSRTDDILLHQDVDLVCISIPPPLTRQISVKALESSL

SEQ ID NO: 5874 - protein, 385 aa, Homo Sapiens
MKMLPGVGVFGTGSSARVLVPLLRAEGFTVEALWGKTEEEAKQLAEEMNIAFYTSRTDDILLHQDVDLVCISIPPPLTRQISVKALGIGKNVVCEKAATSVDAFRMVTASRYYPQLMSLVGNVLRFLPAFVRMKQLISEHYVGAVMICDARIYSGSLLSPSYGWICDELMGGGGLHTMGTYIVDLLTHLTGRRAEKVHGLLKTFVRQNAAIRGIRHVTSDDFCFFQMLMGGGVCSTVTLNFNMPGAFVHEVMVVGSAGRLVARGADLYGQKNSATQEELLLRDSLAVGAGLPEQGPQDVPLLYLKGMVYMVQALRQSFQGQGDRRTWDRTPVSMAASFEDGLYMQSVVDAIKRSSRSGEWEAVEVLTEEPDTNQNLCEALQRNNL

SEQ ID NO: 5875 - protein, 112 aa, Homo Sapiens
MKMLPGVGVFGTGSSARVLVPLLRAEGFTVEALWGKTEEEAKQLAEEMNIAFYTSRTDDILLHQDVDLVCISIPPPLTRQISVKALGTPGRPQQGQIMSLPLGSPLRVTPLL

SEQ ID NO: 5876 - protein, 112 aa, Homo Sapiens; identical to SEQ ID NO: 5875

SEQ ID NO: 5877 - protein, 88 aa, Homo Sapiens
MKMLPGVGVFGTGSSARVLVPLLRAEGFTVEALWGKTEEEAKQLAEEMNIAFYTSRTDDILLHQDVDLVLGRMWFARRQQHRWMPSGW

SEQ ID NO: 5878 - protein, 103 aa, Homo Sapiens
  misc_feature (1)..(1): Xaa can be any naturally occurring amino acid
XKTEEEAKQLAEEMNIAFYTSRTDDILLHQDVDLVCISIPPPLTRQISVKALGSTCGVPEWSLDGCGGEAQVHTLPRWASTRRVLGRMWFARRQQHRWMPSGW

SEQ ID NO: 5879 - protein, 682 aa, Homo Sapiens
MCGIFAYMNYRVPRTRKEIFETLIKGLQRLEYRGYDSAGVAIDGNNHEVKERHIQLVKKRGKVKALDEELYKQDSMDLKVEFETHFGIAHTRWATHGVPSAVNSHPQRSDKGNEFVVIHNGIITNYKDLRKFLESKGYEFESETDTETIAKLIKYVFDNRETEDITFSTLVERVIQQLEGAFALVFKSVHYPGEAVATRRGSPLLIGVRSKYKLSTEQIPILYRTCTLENVKNICKTRMKRLDSSACLHAVGDKAVEFFFASDASAIIEHTNRVIFLEDDDIAAVADGKLSIHRVKRSASDDPSRAIQTLQMELQQIMKGNFSAFMQKEIFEQPESVFNTMRGRVNFETNTVLLGGLKDHLKEIRRCRRLIVIGCGTSYHAAVATRQVLEELTELPVMVELASDFLDRNTPVFRDDVCFFISQSGETADTLLALRYCKDRGALTVGVTNTVGSSISRETDCGVHINAGPEIGVASTKAYTSQFISLVMFGLMMSEDRISLQNRRQEIIRGLRSLPELIKEVLSLEEKIHDLALELYTQRSLLVMGRGYNYATCLEGALKIKEITYMHSEGILAGELKHGPLALIDKQMPVIMVIMKDPCFAKCQNALQQVTARQGRPIILCSKDDTESSKFAYKTIELPHTVDCLQGILSVIPLQLLSFHLAVLRGYDVDFPRNLAKSVTVE

SEQ ID NO: 5880 - protein, 216 aa, Homo Sapiens
MNLLLNSISLLTFLSEFVVIHNGIITNYKDLRKFLESKGYEFESETDTETIAKLIKYVFDNRETEDITFSTLVERVIQQLEGAFALVFKSVHYPGEAVATRRGSPLLIGVRSKYKLSTEQIPILYRTCTLENVKNICKTRMKRLDSSACLHAVGDKAVEFFFASDASAIIEHTNRVIFLEDDDIAAVADGKLSIHRVKRSASDDPSRAIQTLQMEL

SEQ ID NO: 5881 - protein, 179 aa, Homo Sapiens [sequence omitted]

SEQ ID NO: 5882 - protein, 464 aa, Homo Sapiens
MILANVFCLFFFLDETLRSLASPSSLQGPELHGWRPPVDCVRANELCAAESNCSSRYRTLRQCLAGRDRNTMLANKECQAALEVLQESPLYDCRCKRGMKKELQCLQIYWSIHLGLTEGEEFYEASPYEPVTSRLSDIFRLASIFSGTGADPVVSAKSNHCLDAAKACNLNDNCKKLRSSYISICNREISPTERCNRRKCHKALRQFFDRVPSEYTYRMLFCSCQDQACAERRRQTILPSCSYEDKEKPNCLDLRGVCRTDHLCRSRLADFHANCRASYQTVTSCPADNYQACLGSYAGMIGFDMTPNYVDSSPTGIVVSPWCSCRGSGNMEEECEKFLRDFTENPCLRNAIQAFGNGTDVNVSPKGPSFQATQAPRVEKTPSLPDDLSDSTSLGTSVITTCTSVQEQGLKANNSKELSMCFTELTTNIIPGSNKVIKPNSGPSRARPSAALTVLSVLMLKLAL

SEQ ID NO: 5883 - protein, 265 aa, Homo Sapiens
MILANVFCLFFFLDETLRSLASPSSLQGPELHGWRPPVDCVRANELCAAESNCSSRYRTLRQCLAGRDRNTMLANKECQAALEVLQESPLYDCRCKRGMKKELQCLQIYWSIHLGLTEGEEFYEASPYEPVTSRLSDIFRLASIFSGTGADPVVSAKSNHCLDAAKACNLNDNCKKLRSSYISICNREISPTERCNRRKCHKALRQFFDRVPSEYTYRMLFCSCQDQACAERRRQTILPSCSYEDKEKPNCLDLRGVCRTDHLCR

SEQ ID NO: 5884 - protein, 464 aa, Homo Sapiens; identical to SEQ ID NO: 5882

SEQ ID NO: 5885 - protein, 359 aa, Homo Sapiens
MILANVFCLFFFLGEEFYEASPYEPVTSRLSDIFRLASIFSGTGADPVVSAKSNHCLDAAKACNLNDNCKKLRSSYISICNREISPTERCNRRKCHKALRQFFDRVPSEYTYRMLFCSCQDQACAERRRQTILPSCSYEDKEKPNCLDLRGVCRTDHLCRSRLADFHANCRASYQTVTSCPADNYQACLGSYAGMIGFDMTPNYVDSSPTGIVVSPWCSCRGSGNMEEECEKFLRDFTENPCLRNAIQAFGNGTDVNVSPKGPSFQATQAPRVEKTPSLPDDLSDSTSLGTSVITTCTSVQEQGLKANNSKELSMCFTELTTNIIPGSNKVIKPNSGPSRARPSAALTVLSVLMLKLAL

SEQ ID NO: 5886 - protein, 62 aa, Homo Sapiens
MILANVFCLFFFLGPGPLLRRNGVQREKTCSYIQGRMMPEFSLGYEEGCPTESPWCALAKWV

SEQ ID NO: 5887 - protein, 331 aa, Homo Sapiens
MILANVFCLFFFLGTGADPVVSAKSNHCLDAAKACNLNDNCKKLRSSYISICNREISPTERCNRRKCHKALRQFFDRVPSEYTYRMLFCSCQDQACAERRRQTILPSCSYEDKEKPNCLDLRGVCRTDHLCRSRLADFHANCRASYQTVTSCPADNYQACLGSYAGMIGFDMTPNYVDSSPTGIVVSPWCSCRGSGNMEEECEKFLRDFTENPCLRNAIQAFGNGTDVNVSPKGPSFQATQAPRVEKTPSLPDDLSDSTSLGTSVITTCTSVQEQGLKANNSKELSMCFTELTTNIIPGSNKVIKPNSGPSRARPSAALTVLSVLMLKLAL

SEQ ID NO: 5888 - protein, 74 aa, Homo Sapiens
MLANKECQAALEVLQESPLYDCRCKRGMKKELQCLQIYWSIHLGLTEGEEFYEASPYEPVTSRLSDIFRLASIF

SEQ ID NO: 5889 - protein, 299 aa, Homo Sapiens
MVRCLGPALLLLLLLGSASSVGGNRCVDAAEACTADARCQRLRSEYVAQCLGRAAQGGCPRARCRRALRRFFARGPPALTHALLFCPCAGPACAERRRQTFVPSCAFSGPGPAPPSCLEPLNFCERSRVCRCARAAAGPWRGWGRGLSPAHRPPAAQASPPGLSGLVHPSAQRPRRLPAGPGRPLPARLRGPRGVPAGTAVTPNYVDNVSARVAPWCDCGASGNRREDCEAFRGLFTRNRCLDGAIQAFASGWPPVLLDQLNPQGDPEHSLLQVSSTGRALERRSLLSILPVLALPALL

SEQ ID NO: 5890 - protein, 182 aa, Homo Sapiens
MVRCLGPALLLLLLLGSASSVGGNRCVDAAEACTADARCQRLRSEYVAQCLGRAAQGGCPRARCRRALRRFFARGPPALTHALLFCPCAGPACAERRRQTFVPSCAFSGPGPAPPSCLEPLNFCERSRVCRPRLLAFQVSCTPAPSAPDGCLLDQGARCLRAYAGLVGSPQAPPSPLTTWTT

SEQ ID NO: 5891 - protein, 269 aa, Homo Sapiens
MVRCLGPALLLLLLLGSASSVGGNRCVDAAEACTADARCQRLRSEYVAQCLGRAAQGGCPRARCRRALRRFFARGPPALTHALLFCPCAGPACAERRRQTFVPSCAFSGPGPAPPSCLEPLNFCERSRVCRPRLLAFQVSCTPAPSAPDGCLLDQGARCLRAYAGLVGTAVTPNYVDNVSARVAPWCDCGASGNRREDCEAFRGLFTRNRCLDGAIQAFASGWPPVLLDQLNPQGDPEHSLLQVSSTGRALERRSLLSILPVLALPALL

SEQ ID NO: 5892 - protein, 59 aa, Homo Sapiens
MAATAVAAAVAGTESAQGPPGPAASLELWLNKATDPSMSEQDWSAIQNFCEQVNTDPNG

SEQ ID NO: 5893 - protein, 59 aa, Homo Sapiens; identical to SEQ ID NO: 5892

SEQ ID NO: 5894 - protein, 59 aa, Homo Sapiens; identical to SEQ ID NO: 5892

SEQ ID NO: 5895 - protein, 117 aa, Homo Sapiens
MAATAVAAAVAGTESAQGPPGPAASLELWLNKATDPSMSEQDWSAIQNFCEQVNTDPNGPTHAPWLLAHKIQSPQEKEALYALTPGGEPGTTGFPPSPGGPVSVQVLEMCMNHCGEK

SEQ ID NO: 5896 - protein, 613 aa, Homo Sapiens
MAATAVAAAVAGTESAQGPPGPAASLELWLNKATDPSMSEQDWSAIQNFCEQVNTDPNGPTHAPWLLAHKIQSPQEKEALYALTVLEMCMNHCGEKFHSEVAKFRFLNELIKVLSPKYLGSWATGKVKGRVIEILFSWTVWFPEDIKIRDAYQMLKKQGIIKQDPKLPVDKILPPPSPWPKSSIFDADEEKSKLLTRLLKSNHPEDLQAANRLIKNLVKEEQEKSEKVSKRVSAVEEVRSHVKVLQEMLSMYRRPGQAPPDQEALQVVYERCEKLRPTLFRLASDTTDDDDALAEILQANDLLTQGVLLYKQVMEGRVTFGNRVTSSLGDIPVSRVFQNPAGCMKTCPLIDLEVDNGPAQMGTVVPSLLHQDLAALGISDAPVTGMVSGQNCCEEKRNPSSSTLPGGGVQNPSADRNLLDLLSAQPAPCPLNYVSQKSVPKEVPPGTKSSPGWSWEAGPLAPSPSSQNTPLAQVFVPLESVKPSSLPPLIVYDRNGFRILLHFSQTGAPGHPEVQVLLLTMMSTAPQPVWDIMFQVAVPKSMRVKLQPASSSKLPAFSPLMPPAVISQMLLLDNPHKEPIRLRYKLTFNQGGQPFSEVGEVKDFPDLAVLGAA

SEQ ID NO: 5897 - protein, 223 aa, Homo Sapiens
MAATAVAAAVAGTESAQGPPGPAASLELWLNKATDPSMSEQDWSAIQNFCEQVNTDPNGPTHAPWLLAHKIQSPQEKEALYALTVLEMCMNHCGEKFHSEVAKFRFLNELIKVLSPKYLGSWATGKVKGRVIEILFSWTVWFPEDIKIRDAYQMLKKQGIIKQDPKLPVDKILPPPSPWPKSSIFDADEEKSKLLTRLLKSNHPEDLQAAVLKVAVVYGITPF

SEQ ID NO: 5898 - protein, 49 aa, Homo Sapiens
MAATAVAAAVAGTESAQGPPGPAASLELWLSDHRPKHVGTGLVSYPEFL

SEQ ID NO: 5899 - protein, 125 aa, Homo Sapiens
MVKLPFSLSLQLANSCPSPEDKATDPSMSEQDWSAIQNFCEQVNTDPNGPTHAPWLLAHKIQSPQEKEALYALTVLEMCMNHCGEKFHSEVAKFRFLNELIKVLSPKYLGSWATGKVKGRVIEIL

SEQ ID NO: 5900 - protein, 129 aa, Homo Sapiens
  misc_feature (1)..(1): Xaa can be any naturally occurring amino acid
XAVAGTESAQGPPGPAASLELWLNKATDPSMSEQDWSAIQNFCEQVNTDPNGPTHAPWLLAHKIQSPQEKEALYALTCPHRLEAGLALVPAQSPASDYQPGGEPGTTGFPPSPGGPVSVQVLEMCMNHC

SEQ ID NO: 5901 - protein, 318 aa, Homo Sapiens
MASPGCLLCVLGLLLCGAASLELSRPHGDTAKKPIIGILMQKCRNKVMKNYGRYYIAASYVKYLESAGARVVPVRLDLTEKDYEILFKSINGILFPGGSVDLRRSDYAKVAKIFYNLSIQSFDDGDYFPVWGTCLGFEELSLLISGECLLTATDTVDVAMPLNFTGGQLHSRMFQNFPTELLLSLAVEPLTANFHKWSLSVKNFTMNEKLKKFFNVLTTNTDGKIEFISTMEGYKYPVYGVQWHPEKAPYEWKNLDGISHAPNAVKTAFYLAEFFVNEARKNNHHFKSESEEEKALIYQFSPIYTGNISSFQQCYIFD

SEQ ID NO: 5902 - protein, 30 aa, Homo Sapiens
MKKKLVVLGLLAVVLVLVIVGLCLWLPSAS

SEQ ID NO: 5903 - protein, 37 aa, Homo Sapiens
MKKKLVVLGLLAVVLVLVIVGLCLWLPSASKEPDNHV

SEQ ID NO: 5904 - protein, 68 aa, Homo Sapiens
MKKKLVVLGLLAVVLVLVIVGLCLWLPSASKEPDNHVYTRAAVAADAKQCSKIGRDALRDGGSAVDAA

SEQ ID NO: 5905 - protein, 80 aa, Homo Sapiens
MKKKLVVLGLLAVVLVLVIVGLCLWLPSASKEPDNHVYTRAAVAADAKQCSKIGRDALRDGGSAVDAAIAALLCVGLMNA

SEQ ID NO: 5906 - protein, 98 aa, Homo Sapiens
MKKKLVVLGLLAVVLVLVIVGLCLWLPSASKEPDNHVYTRAAVAADAKQCSKIGRDALRDGGSAVDAAIAALLCVGLMNAHSMGIGGGLFLTIYNSTT

SEQ ID NO: 5907 - protein, 109 aa, Homo Sapiens
MKKKLVVLGLLAVVLVLVIVGLCLWLPSASKEPDNHVYTRAAVAADAKQCSKIGRDALRDGGSAVDAAIAALLCVGLMNAHSMGIGGGLFLTIYNSTTRKAEVINAREV

SEQ ID NO: 5908 - protein, 111 aa, Homo Sapiens
MKKKLVVLGLLAVVLVLVIVGLCLWLPSASKEPDNHVYTRAAVAADAKQCSKIGRDALRDGGSAVDAAIAALLCVGLMNAHSMGIGGGLFLTIYNSTTRKAEVINAREVAP

SEQ ID NO: 5909 - protein, 116 aa, Homo Sapiens
MKKKLVVLGLLAVVLVLVIVGLCLWLPSASKEPDNHVYTRAAVAADAKQCSKIGRDALRDGGSAVDAAIAALLCVGLMNAHSMGIGGGLFLTIYNSTTRKAEVINAREVAPRLAFA

SEQ ID NO: 5910 - protein, 120 aa, Homo Sapiens
MKKKLVVLGLLAVVLVLVIVGLCLWLPSASKEPDNHVYTRAAVAADAKQCSKIGRDALRDGGSAVDAAIAALLCVGLMNAHSMGIGGGLFLTIYNSTTRKAEVINAREVAPRLAFATMFN

SEQ ID NO: 5911 - protein, 126 aa, Homo Sapiens
MKKKLVVLGLLAVVLVLVIVGLCLWLPSASKEPDNHVYTRAAVAADAKQCSKIGRDALRDGGSAVDAAIAALLCVGLMNAHSMGIGGGLFLTIYNSTTRKAEVINAREVAPRLAFATMFNSSEQSQ

SEQ ID NO: 5912 - protein, 126 aa, Homo Sapiens; identical to SEQ ID NO: 5911

SEQ ID NO: 5913 - protein, 127 aa, Homo Sapiens
MKKKLVVLGLLAVVLVLVIVGLCLWLPSASKEPDNHVYTRAAVAADAKQCSKIGRDALRDGGSAVDAAIAALLCVGLMNAHSMGIGGGLFLTIYNSTTRKAEVINAREVAPRLAFATMFNSSEQSQK

SEQ ID NO: 5914 - protein, 174 aa, Homo Sapiens
MKKKLVVLGLLAVVLVLVIVGLCLWLPSASKEPDNHVYTRAAVAADAKQCSKIGRDALRDGGSAVDAAIAALLCVGLMNAHSMGIGGGLFLTIYNSTTRKAEVINAREVAPRLAFATMFNSSEQSQKGGLSVAVPGEIRGYELAHQRHGRLPWARLFQPSIQLARQGFPVGKGL

SEQ ID NO: 5915 - protein, 569 aa, Homo Sapiens
MKKKLVVLGLLAVVLVLVIVGLCLWLPSASKEPDNHVYTRAAVAADAKQCSKIGRDALRDGGSAVDAAIAALLCVGLMNAHSMGIGGGLFLTIYNSTTRKAEVINAREVAPRLAFATMFNSSEQSQKGGLSVAVPGEIRGYELAHQRHGRLPWARLFQPSIQLARQGFPVGKGLAAALENKRTVIEQQPVLCEVFCRDRKVLREGERLTLPQLADTYETLAIEGAQAFYNGSLTAQIVKDIQAAGGIVTAEDLNNYRAELIEHPLNISLGDVVLYMPSAPLSGPVLALILNILKGYNFSRESVESPEQKGLTYHRIVEAFRFAYAKRTLLGDPKFVDVTEVVRNMTSEFFAAQLRAQISDDTTHPISYYKPEFYTPDDGGTAHLSVVAEDGSAVSATSTINLYFGSKVRSPVSGILFNNEMDDFSSPSITNEFGVPPSPANFIQPGKQPLSSMCPTIMVGQDGQVRMVVGAAGGTQITTATALAIIYNLWFGYDVKRAVEEPRLHNQLLPNVTTVERNIDQAVTAALETRHHHTQIASTFIAVVQAIVRTAGGWAAASDSRKGGEPAGY

SEQ ID NO: 5916 - protein, 366 aa, Homo Sapiens
MKKKLVVLGLLAVVLVLVIVGLCLWLPSASKEPDNHVYTRAAVAADAKQCSKIGRDALRDGGSAVDAAIAALLCVGLMNAHSMGIGGGLFLTIYNSTTRKAEVINAREVAPRLAFATMFNSSEQSQKGGLSVAVPGEIRGYELAHQRHGRLPWARLFQPSIQLARQGFPVGKGLAAALENKRTVIEQQPVLCEVFCRDRKVLREGERLTLPQLADTYETLAIEGAQAFYNGSLTAQIVKDIQAAGGIVTAEDLNNYRAELIEHPLNISLGDVVLYMPSAPLSGPVLALILNILKGYNFSRESVESPEQKGLTYHRIVEAFRFAYAKRTLLGDPKFVDVTEASSGVSAGGPQHDLRVLRCPAPGPDL

SEQ ID NO: 5917 - protein, 463 aa, Homo Sapiens
MKKKLVVLGLLAVVLVLVIVGLCLWLPSASKEPDNHVYTRAAVAADAKQCSKIGRDALRDGGSAVDAAIAALLCVGLMNAHSMGIGGGLFLTIYNSTTRKAEVINAREVAPRLAFATMFNSSEQSQKGGLSVAVPGEIRGYELAHQRHGRLPWARLFQPSIQLARQGFPVGKGLAAALENKRTVIEQQPVLCEVFCRDRKVLREGERLTLPQLADTYETLAIEGAQAFYNGSLTAQIVKDIQAAGGIVTAEDLNNYRAELIEHPLNISLGDVVLYMPSAPLSGPVLALILNILKGYNFSRESVESPEQKGLTYHRIVEAFRFAYAKRTLLGDPKFVDVTEVVRNMTSEFFAAQLRAQISDDTTHPISYYKPEFYTPDDGGTAHLSVVAEDGSAVSATSTINLYFGSKVRSPVSGILFNNEMDDFSSPSITNEFGVPPSPANFIQPGKQPLSSMCPTIMVGQDG

SEQ ID NO: 5918 - protein, 569 aa, Homo Sapiens; identical to SEQ ID NO: 5915

SEQ ID NO: 5919 - protein, 569 aa, Homo Sapiens; identical to SEQ ID NO: 5915

SEQ ID NO: 5920 - protein, 218 aa, Homo Sapiens
MTSEFFAAQLRAQISDDTTHPISYYKPEFYTPDDGGTAHLSVVAEDGSAVSATSTINLYFGSKVRSPVSGILFNNEMDDFSSPSITNEFGVPPSPANFIQPGKQPLSSMCPTIMVGQDGQPPSHADHTPMPQAIIYNLWFGYDVKRAVEEPRLHNQLLPNVTTVERNIDQAVTAALETRHHHTQIASTFIAVVQAIVRTAGGWAAASDSRKGGEPAGY

SEQ ID NO: 5921 - protein, 225 aa, Homo Sapiens
MTSEFFAAQLRAQISDDTTHPISYYKPEFYTPDDGGTAHLSVVAEDGSAVSATSTINLYFGSKVRSPVSGILFNNEMDDFSSPSITNEFGVPPSPANFIQPGKQPLSSMCPTIMVGQDGQVRMVVGAAGGTQITTATALAIIYNLWFGYDVKRAVEEPRLHNQLLPNVTTVERNIDQAVTAALETRHHHTQIASTFIAVVQAIVRTAGGWAAASDSRKGGEPAGY

SEQ ID NO: 5922 - protein, 225 aa, Homo Sapiens; identical to SEQ ID NO: 5921

SEQ ID NO: 5923 - protein, 225 aa, Homo Sapiens; identical to SEQ ID NO: 5921

SEQ ID NO: 5924 - protein, 252 aa, Homo Sapiens
MTSEFFAAQLRAQISDDTTHPISYYKPEFYTPDDGGTAHLSVVAEDGSAVSATSTINLYFGSKVRSPVSGILFNNEMDDFSSPSITNEFGVPPSPANFIQPGKQPLSSMCPTIMVGQDGQVRMVVGAAGGTQITTATALVCVTPFLPGRAHPAQPPSHADHTPMPQAIIYNLWFGYDVKRAVEEPRLHNQLLPNVTTVERNIDQAVTAALETRHHHTQIASTFIAVVQAIVRTAGGWAAASDSRKGGEPAGY

SEQ ID NO: 5925 - protein, 554 aa, Homo Sapiens
MARGYGATVSLVLLGLGLALAVIVLAVVLSRHQAPCGPQAFAHAAVAADSKVCSDIGRAILQQQGSPVDATIAALVCTSVVNPQSMGLGGGVIFTIYNVTTGAQWIGVPGELRGYAEAHRRHGRLPWAQLFQPTIALLRGGHVVAPVLSRFLHNSILRPSLQASTLRQLFFNGTEPLRPQDPLPWPALATTLETVATEGVEVFYTGRLGQMLVEDIAKEGSQLTLQDLAKFQPEVVDALEVPLGDYTLYSPPPPAGGAILSFILNVLRGFNFSTESMARPEGRVNVYHHLVETLKFAKGQRWRLGDPRSHPKLQNASRDLLGETLAQLIRQQIDGRGDHQLSHYSLAEAWGHGTGTSHVSVLGEDGSAVAATSTINTPFGAMVYSPRTGIILNNELLDLCERCPRGSGTTPSPVSGDRVGGAPGRCWPPVPGERSPSSMVPSILINKAQGSKLVIGGAGGELIISAVAQAIMSKLWLGFDLRAAIAAPILHVNSKGCVEYEPNFSQEVQRGLQDRGQNQTQRPFFLNVVQAVSQEGACVYAVSDLRKSGEAAGY

SEQ ID NO: 5926 - protein, 586 aa, Homo Sapiens
MARGYGATVSLVLLGLGLALAVIVLAVVLSRHQAPCGPQAFAHAAVAADSKVCSDIGRAILQQQGSPVDATIAALVCTSVVNPQSMGLGGGVIFTIYNVTTGKVEVINARETVPASHAPSLLDQCAQALPLGTGAQWIGVPGELRGYAEAHRRHGRLPWAQLFQPTIALLRGGHVVAPVLSRFLHNSILRPSLQASTLRQLFFNGTEPLRPQDPLPWPALATTLETVATEGVEVFYTGRLGQMLVEDIAKEGSQLTLQDLAKFQPEVVDALEVPLGDYTLYSPPPPAGGAILSFILNVLRGFNFSTESMARPEGRVNVYHHLVETLKFAKGQRWRLGDPRSHPKLQNASRDLLGETLAQLIRQQIDGRGDHQLSHYSLAEAWGHGTGTSHVSVLGEDGSAVAATSTINTPFGAMVYSPRTGIILNNELLDLCERCPRGSGTTPSPVSGDRVGGAPGRCWPPVPGERSPSSMVPSILINKAQGSKLVIGGAGGELIISAVAQAIMSKLWLGFDLRAAIAAPILHVNSKGCVEYEPNFSQEVQRGLQDRGQNQTQRPFFLNVVQAVSQEGACVYAVSDLRKSGEAAGY

SEQ ID NO: 5927 - protein, 587 aa, Homo Sapiens
MARGYGATVSLVLLGLGLALAVIVLAVVLSRHQAPCGPQAFAHAAVAADSKVCSDIGRAILQQQGSPVDATIAALVCTSVVNPQSMGLGGGVIFTIYNVTTGKVEVINARETVPASHAPSLLDQCAQALPLGTGAQWIGVPGELRGYAEAHRRHGRLPWAQLFQPTIALLRGGHVVAPVLSRFLHNSILRPSLQASTLRQLFFNGTEPLRPQDPLPWPALATTLETVATEGVEVFYTGRLGQMLVEDIAKEGSQLTLQDLAKFQPEVVDALEVPLGDYTLYSPPPPAGGAILSFILNVLRGFNFSTESMARPEGRVNVYHHLVETLKFAKGQRWRLGDPRSHPKLQNASRDLLGETLAQLIRQQIDGRGDHQLSHYSLAEAWGHGTGTSHVSVLGEDGSAVAATSTINTPFGAMVYSPRTGIILNNELLDLCERCPRGSGTTPSPAVSGDRVGGAPGRCWPPVPGERSPSSMVPSILINKAQGSKLVIGGAGGELIISAVAQAIMSKLWLGFDLRAAIAAPILHVNSKGCVEYEPNFSQEVQRGLQDRGQNQTQRPFFLNVVQAVSQEGACVYAVSDLRKSGEAAGY

SEQ ID NO: 5928 - protein, 73 aa, Homo Sapiens
MARGYGATVSLVLLGLGLALAVIVLAVVLSRHQAPCGPQAFAHAAVAADSKVCSDIGRGPVDRGARGAPWLCR

SEQ ID NO: 5929 - protein, 220 aa, Homo Sapiens
  misc_feature (1)..(1): Xaa can be any naturally occurring amino acid
XSAVAATSTINTPFGAMVYSPRTGIILNNELLDLCERCPRGSGTTPSPVSGDRVGGAPGRCWPPVPGERSPSSMVPSILINKAQGSKLVIGGAGGELIISAVAQAIMSKLWLGFDLRAAIAAPILHVNSKGCVEYEPNFSQKQDLAALPRLVSNSWPQVILLPQPPKLLALQEVQRGLQDRGQNQTQRPFFLNVVQAVSQEGACVYAVSDLRKSGEAAGY

SEQ ID NO: 5930 - protein, 30 aa, Homo Sapiens
MATEAGRWQPPDWADLQADLQQVRHKLTQR

SEQ ID NO: 5931 - protein, 217 aa, Homo Sapiens
MATGSRTSLLLAFGLLCLPWLQEGSAFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 5932 - protein, 177 aa, Homo Sapiens
MATGSRTSLLLAFGLLCLPWLQEGSAFPTIPLSRLFDNAMLRAHRLHQLAFDTYQEFNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 5933 - protein, 202 aa, Homo Sapiens
MATGSRTSLLLAFGLLCLPWLQEGSAFPTIPLSRLFDNAMLRAHRLHQLAFDTYQEFNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 5934 - protein, 122 aa, Homo Sapiens
MATGSRTSLLLAFGLLCLPWLQEGSAFPTIPLSRLFDNAMLRAHRLHQLAFDTYQEFRLEDGSPRTGQIFKQTYSKFDTNSHNDDALLKNYGLLYCFRKDMDKVETFLRIVQCRSVEGSCGF

SEQ ID NO: 5935 - protein, 245 aa, Homo Sapiens
MAAGSRTSLLLAFGLLCLSWLQEGSAFPTIPLSRLFDNAMLRARRLYQLAYDTYQEFEEAYILKEQKYSFLQNPQTSLCFSESIPTPSNRVKTQQKSNLELLRISLLLIQSWLEPVQLLRSVFANSLVYGASDSNVYRHLKDLEEGIQTLIGWKMAAPGLGRSSISPTASLTQNRTTMTHCSRTTGCSTASGRTWTRSRHSCASCSAALWRAAVASSCPGGIPVTPPQCLSWSWKVLLQCPPALS

SEQ ID NO: 5936 - protein, 217 aa, Homo Sapiens
MAAGSRTSLLLAFGLLCLSWLQEGSAFPTIPLSRLFDNAMLRARRLYQLAYDTYQEFEEAYILKEQKYSFLQNPQTSLCFSESIPTPSNRVKTQQKSNLELLRISLLLIQSWLEPVQLLRSVFANSLVYGASDSNVYRHLKDLEEGIQTLMWRLEDGSPRTGQIFNQSYSKFDTKSHNDDALLKNYGLLYCFRKDMDKVETFLRIVQCRSVEGSCGF

SEQ ID NO: 5937 - protein, 256 aa, Homo Sapiens
MAAGSRTSLLLAFGLLCLSWLQEGSAFPTIPLSRLFDNAMLRARRLYQLAYDTYQEFEEAYILKEQKYSFLQNPQTSLCFSESIPTPSNRVKTQQKSNLELLRISLLLIQSWLEPVQLLRSVFANSLVYGASDSNVYRHLKDLEEGIQTLMWVRVAPGIPNPGAPLASRDWGEKHCCPLFSSQALTQENSPYSSFPLVNPPGLSLQPGGEGGKWMNERGREQCPSAWPLLLFLHFAEAGRWQPPDWADLQSVLQQV

SEQ ID NO: 5938 - protein, 177 aa, Homo Sapiens
MAAGSRTSLLLAFGLLCLSWLQEGSAFPTIPLSRLFDNAMLRARRLYQLAYDTYQEFNLELLRISLLLIQSWLEPVQLLRSVFANSLVYGASDSNVYRHLKDLEEGIQTLMWRLEDGSPRTGQIFNQSYSKFDTKSHNDDALLKNYGLLYCFRKDMDKVETFLRIVQCRSVEGSCGF

SEQ ID NO: 5939 - protein, 202 aa, Homo Sapiens
MAAGSRTSLLLAFGLLCLSWLQEGSAFPTIPLSRLFDNAMLRARRLYQLAYDTYQEFNPQTSLCFSESIPTPSNRVKTQQKSNLELLRISLLLIQSWLEPVQLLRSVFANSLVYGASDSNVYRHLKDLEEGIQTLMWRLEDGSPRTGQIFNQSYSKFDTKSHNDDALLKNYGLLYCFRKDMDKVETFLRIVQCRSVEGSCGF

SEQ ID NO: 5940 - protein, 130 aa, Homo Sapiens
MLLWPLLLLLLLLPTLALLRQQRSQDARLSWLAGLQHRVAWGALVWAATWQRRRLEQSTLHVHQSQQQALRWCLQGAQRPHCSLRRSTDISTFRNHLPLTKASQTQQEDSGEQPLPPTSNQDLGEASLQA

SEQ ID NO: 5941 - protein, 146 aa, Homo Sapiens
MLLWPLLLLLLLLPTLALLRQQRSQDARLSWLAGLQHRVAWGALVWAATWQRRRLEQSTLHVHQSQQQALRWCLQGAQRPHCSLRRSTDISTFRNHLPLTKASQTQQEDSGEQPLPPTSNQDLGEASLQATLLGLAALNKAYPEVL

SEQ ID NO: 5942 - protein, 530 aa, Homo Sapiens
MLLWPLLLLLLLLPTLALLRQQRSQDARLSWLAGLQHRVAWGALVWAATWQRRRLEQSTLHVHQSQQQALRWCLQGAQRPHCSLRRSTDISTFRNHLPLTKASQTQQEDSGEQPLPPTSNQDLGEASLQATLLGLAALNKAYPEVLAQGRTARVTLTSPWPRPLPWPGNTLGQVGTPGTKDPRALLLDALRSPGLRALEAGTAVELLDVFLGLETDGEELAGAIAAGNPGAPLRERAAELREALEQGPRGLALRLWPKLQVVVTLDAGGQAEAVAALGALWCQGLAFFSPAYAASGGVLGLNLQPEQPHGLYLLPPGAPFIELLPVKEGTQEEAASTLLLAEAQQGKEYELVLTDRASLTRCRLGDVVRVVGAYNQCPVVRFICRLDQTLSVRGEDIGEDLFSEALGRAVGQWAGAKLLDHGCVESSILDSSAGSAPHYEVFVALRGLRNLSEENRDKLDHCLQEASPRYKSLRFWGSVGPARVHLVGQGAFRALRAALAACPSSPFPPAMPRVLRHRHLAQCLQERVVS

SEQ ID NO: 5943 - protein, 474 aa, Homo Sapiens
MLLWPLLLLLLLLPTLALLRQQRSQDARLSWLAGLQHRVAWGALVWAATWQRRRLEQSTLHVHQSQQQALRWCLQGAQRPHCSLRRSTDISTFRNHLPLTKASQTQQEDSGEQPLPPTSNQDLGEASLQATLLGLAALNKAYPEVLAQGRTARVTLTSPWPRPLPWPGNTLGQVGTPGTKDPRALLLDALRSPGLRALEAGTAVELLDVFLGLETDGEELAGAIAAGNPGAPLRERAAELREALEQGPRGLALRLWPKLQVVVTLDAGGQAEAVAALGALWCQGLAFFSPAYAASGGVLGLNLQPEQPHGLYLLPPGAPFIELLPVKEGTQEEAASTLLLAEAQQGKEYELVLTDRASLTRCRLGDVVRVVGAYNQCPVVRFICRLDQTLSVRGEDIGEDLFSEALGRAVGQWAGAKLLDHGCVESSILEWGRTDRAEDTRLGSCPFTGSMCAHGVYSQIPLRALLPTTRCLWR

SEQ ID NO: 5944 - protein, 474 aa, Homo Sapiens; identical to SEQ ID NO: 5943

SEQ ID NO: 5945 - protein, 530 aa, Homo Sapiens; identical to SEQ ID NO: 5942

SEQ ID NO: 5946 - protein, 479 aa, Homo Sapiens
MLLWPLLLLLLLLPTLALLRQQRSQDARLSWLAGLQHRVAWGALVWAATWQRRRLEQSTLHVHQSQQQALRWCLQGAQRPHCSLRRSTDISTFRNHLPLTKASQTQQEDSGEQPLPPTSNQDLGEASLQATLLGLAALNKAYPEVLAQGRTARVTLTSPWPRPLPWPGNTLGQVGTPGTKDPRALLLDALRSPGLRALEAGTAVELLDVFLGLETDGEELAGAIAAGNPGAPLRERAAELREALEQGPRGLALRLWPKLQVVVTLDAGGQAEAVAALGALWCQGLAFFSPAYAASGGVLGLNLQPEQPHGLYLLPPGAPFIELLPVKEGTQEEAASTLLLAEAQQGKEYELVLTDRASLTRCRLGDVVRVVGAYNQCPVVRFICRLDQTLSVRGEDIGEDLFSEALGRAVGQWAGAKLLDHGCVESSILDSSAGSAPHYEVFVALRGLRNLSEENRDKILASGSALGKREWTPAQPFPH

SEQ ID NO: 5947 - protein, 112 aa, Homo Sapiens
MLLWPLLLLLLLLPTLALLRQQRSQDARLSWLAGLQHRVAWGALVWAATWQRRRLEQSTLHVHQSQQQALRWCLQGAQRPHCSLRRSTGSHQSCLKLLGNWLPEAFLLSLGL

SEQ ID NO: 5948 - protein, 107 aa, Homo Sapiens
MPLWVFFFVILTLSNSSHCSPPPPLTLRMRRYADAIFTNSYRKVLGQLSARKLLQDIMSRQQGESNQERGARARLGRQVDSMWAEQKQMELESILVALLQKHRNSQG

SEQ ID NO: 5949 - protein, 108 aa, Homo Sapiens
MPLWVFFFVILTLSNSSHCSPPPPLTLRMRRYADAIFTNSYRKVLGQLSARKLLQDIMSRQQGESNQERGARARLGRQVDSMWAEQKQMELESILVALLQKHSRNSQG

SEQ ID NO: 5950 - protein, 108 aa, Homo Sapiens; identical to SEQ ID NO: 5949

SEQ ID NO: 5951 - protein, 207 aa, Homo Sapiens
MAMGEGAGQVGERGGSMQGLCGRLPFRHHDQLQLAVGRSRLPELPPGLHLPQLKESLLVAGSRWLGAARALHWHVGELQTGLRGHRVLGPGRHLPLLVDHQRAHCPLGRGELWAFSQYYPHPGEETGASSGQPPYPVSVLASLQVDTFPDPTLWNSLHHLQLPARQCWPGHPPPPGAGTGFLPGIRRLGLRCRFLGRSFDCQPPRGS

SEQ ID NO: 5952 - protein, 423 aa, Homo Sapiens
MDRRMWGAHVFCVLSPLPTVLGHMHPECDFITQLREDESACLQAAEEMPNTTLGCPATWDGLLCWPTAGSGEWVTLPCPDFFSHFSSESGAVKRDCTITGWSEPFPPYPVACPVPLELLAEEESYFSTVKIIYTVGHSISIVALFVAITILVALRRLHCPRNYVHTQLFTTFILKAGAVFLKDAALFHSDDTDHCSFSTVLCKVSVAASHFATMTNFSWLLAEAVYLNCLLASTSPSSRRAFWWLVLAGWGLPVLFTGTWVSCKLAFEDIACWDLDDTSPYWWIIKGPIVLSVGVNFGLFLNIIRILVRKLEPAQGSLHTQSQYWRLSKSTLFLIPLFGIHYIIFNFLPDNAGLGIRLPLELGLGSFQGFIVAILYCFLNQEVRTEISRKWHGHDPELLPAWRTRAKWTTPSRSAAKVLTSMC

SEQ ID NO: 5953 - protein, 151 aa, Homo Sapiens
MLPFSTATTLTTAASPLAARALHWHVGELQTGLRGHRVLGPGRHLPLLVDHQRAHCPLGRGELWAFSQYYPHPGEETGASSGQPPYPVSVLASLQVDTFPDPTLWNSLHHLQLPARQCWPGHPPPPGAGTGFLPGLHCCHPLLLPQPRGED

SEQ ID NO: 5954 - protein, 145 aa, Homo Sapiens
MVPGTPSPLLGRGKELWLESLACLPGAVKRDCTITGWSEPFPPYPVACPVPLELLAEEESYFSTVKIIYTVGHSISIVALFVAITILVALRRLHCPRNYVHTQLFTTFILKAGAVFLKDAALFHSDDTDHCSFSTGCPCSSLARG

SEQ ID NO: 5955 - protein, 359 aa, Homo Sapiens
MVPGTPSPLLGRGKELWLESLACLPGAVKRDCTITGWSEPFPPYPVACPVPLELLAEEESYFSTVKIIYTVGHSISIVALFVAITILVALRRLHCPRNYVHTQLFTTFILKAGAVFLKDAALFHSDDTDHCSFSTVLCKVSVAASHFATMTNFSWLLAEAVYLNCLLASTSPSSRRAFWWLVLAGWGLPVLFTGTWVSCKLAFEDIACWDLDDTSPYWWIIKGPIVLSVGVNFGLFLNIIRILVRKLEPAQGSLHTQSQYWRLSKSTLFLIPLFGIHYIIFNFLPDNAGLGIRLPLELGLGSFQGFIVAILYCFLNQEVRTEISRKWHGHDPELLPAWRTRAKWTTPSRSAAKVLTSMC

SEQ ID NO: 5956 - protein, 68 aa, Homo Sapiens
MVPGTPSPLLGRGKELWLESLACLPGAVKRDCTITGWSEPFPPYPVACPVPLELLAEEGCPCSSLARG

SEQ ID NO: 5957 - protein, 66 aa, Homo Sapiens
MFTCWWSYLRSTLAAVPGEASRVQFNAPFDVGIKLSGVQYQQHSQALGKFLQDILWEEAKEAPADK

SEQ ID NO: 5958 - protein, 105 aa, Homo Sapiens
MFTCWWSYLRSTLAAVPGEASRVQQRKESKKPPAKLQPRALAGWLRPEDGGQAEGAEDELEVRFNAPFDVGIKLSGVQYQQHSQALGKFLQDILWEEAKEAPADK

SEQ ID NO: 5959 - protein, 104 aa, Homo Sapiens
MFTCWWSYLRSTLAAVPGEASRVQRKESKKPPAKLQPRALAGWLRPEDGGQAEGAEDELEVRFNAPFDVGIKLSGVQYQQHSQALGKFLQDILWEEAKEAPADK

SEQ ID NO: 5960 - protein, 40 aa, Homo Sapiens
MFTCWWSYLRSTLAAVPGEASRVQRPQPTSDRPQALLTSL

SEQ ID NO: 5961 - protein, 33 aa, Homo Sapiens
MPSPGTVCSLLLLGMLWLDLAMAGSSFLSPEHQ

SEQ ID NO: 5962 - protein, 117 aa, Homo Sapiens
MPSPGTVCSLLLLGMLWLDLAMAGSSFLSPEHQRVQQRKESKKPPAKLQPRALAGWLRPEDGGQAEGAEDELEVRFNAPFDVGIKLSGVQYQQHSQALGKFLQDILWEEAKEAPADK

SEQ ID NO: 5963 - protein, 117 aa, Homo Sapiens; identical to SEQ ID NO: 5962

SEQ ID NO: 5964 - protein, 117 aa, Homo Sapiens; identical to SEQ ID NO: 5962

SEQ ID NO: 5965 - protein, 91 aa, Homo Sapiens
MPSPGTVCSLLLLGMLWLDLAMAGSSFLSPEHQRVQQRKESKKPPAKLQPRALAGWLRPEDGGQAEGAEDELEVRRPQPTSDRPQALLTSL

SEQ ID NO: 5966 - protein, 116 aa, Homo Sapiens
MPSPGTVCSLLLLGMLWLDLAMAGSSFLSPEHQRVQRKESKKPPAKLQPRALAGWLRPEDGGQAEGAEDELEVRFNAPFDVGIKLSGVQYQQHSQALGKFLQDILWEEAKEAPADK

SEQ ID NO: 5967 - protein, 116 aa, Homo Sapiens; identical to SEQ ID NO: 5966

SEQ ID NO: 5968 - protein, 48 aa, Homo Sapiens
MAWFALYLLSLLWATAGTSTQTQSSCCEYDVFPRRSGKQLPWGRGCDL

SEQ ID NO: 5969 - protein, 417 aa, Homo Sapiens
MAWFALYLLSLLWATAGTSTQTQSSCSVPSAQEPLVNGIQVLMENSVTSSAYPNPSILIAMNLAGAYNLKAQKLLTYQLMSSDNNDLTIGQLGLTIMALTSSCRDPGDKVSILQRQMENWAPSSPNAEASAFYGPSLAILALCQKNSEATLPIAVRFAKTLLANSSPFNVDTGAMATLALTCMYNKIPVGSEEGYRSLFGQVLKDIVEKISMKIKDNGIIGDIYSTGLAMQALSVTPEPSKKEWNCKKTTDMILNEIKQGKFHNPMSIAQILPSLKGKTYLDVPQVTCSPDHEVQPTLPSNPGPGPTSASNITVIYTINNQLRGVELLFNETINVSVKSGSVLLVVLEEAQRKNPMFKFETTMTSWGLVVSSINNIAENVNHKTYWQFLSGVTPLNEGVADYIPFNHEHITANFTQY

SEQ ID NO: 5970 - protein, 153 aa, Homo Sapiens
MVATKTFALLLLSLFLAVGLGEKKEGHFSALPSLPVGSHAKVSSPQPRGPRYAEGTFISDYSIAMDKIHQQDFVNWLLAQKGKKNDWKHNITQREARALELASQANRKEEEAVEPQSSPAKNPSDEDLLRDLLIQELLACLLDQTNLCRLRSR

SEQ ID NO: 5971 - protein, 199 aa, Homo Sapiens
MLAYSSVHCFREDKMKFTIVFAGLLGVFLAPALANYNINVNDDNNNAGSGQQSVSVNNEHNVANVDNNNGWDSWNSIWDYGNGFAATRLFQKKTCIVHKMNKEVMPSIQSLDALVKEKKLQGKGPGGPPPKGLMYSVNPNKVDDLSKFGKNIANMCRGIPTYMAEEMQEASLFFYSGTCYTTSVLWIVDISFCGDTVEN

SEQ ID NO: 5972 - protein, 184 aa, Homo Sapiens
MKILVAFLVVLTIFGIQSHGYEVFNIISPSNNGGNVQETVTIDNEKNTAIINIHAGSCSSTTIFDYKHGYIASRVLSRRACFILKMDHQNIPPLNNLQWYIYEKQALDNMFSSKYTWVKYNPLESLIKDVDWFLLGSPIEKLCKHIPLYKGEVVENTHNVGAGGCAKAGLLGILGISICADIHV

SEQ ID NO: 5973 - protein, 161 aa, Homo Sapiens
MKILVAFLVVLTIFGIQSHGYEVFNIISPSNNGGNVQETVTIDNEKNTAIINIHAGSCSSTTIFDYKHGYIASRVLSRRACFILKMDHQNIPPLNNLQWYIYEKQALDNMFSSKYTWVKYNPLESLIKDVDWFLLGSPIEKLCKHIPLYKGEVVENTREYQ

SEQ ID NO: 5974 - protein, 429 aa, Homo Sapiens
MQLRNPELHLGCALALRFLALVSWDIPGARALDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSLKDLL

SEQ ID NO: 5975 - protein, 222 aa, Homo Sapiens
MQLRNPELHLGCALALRFLALVSWDIPGARALDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKSSTLFGSIC

SEQ ID NO: 5976 - protein, 84 aa, Homo Sapiens
MFEIDYSRDSFLKDGQPFRYISGSIHYSRVPRFYWKDRLLKMKMAGLNAIQTLPGSCGQVVGSPSAQDEASPLSEWRASYNSAG

SEQ ID NO: 5977 - protein, 102 aa, Homo Sapiens
MFEIDYSRDSFLKDGQPFRYISGSIHYSRVPRFYWKDRLLKMKMAGLNAIQTYVPWNFHEPWPGQYQFSEDHDVEYFLRLAHELGLLVILRPGPYICAEWEM

SEQ ID NO: 5978 - protein, 647 aa, Homo Sapiens
MFEIDYSRDSFLKDGQPFRYISGSIHYSRVPRFYWKDRLLKMKMAGLNAIQTYVPWNFHEPWPGQYQFSEDHDVEYFLRLAHELGLLVILRPGPYICAEWEMGGLPAWLLEKESILLRSSDPDYLAAVDKWLGVLLPKMKPLLYQNGGPVITVQVENEYGSYFACDFDYLRFLQKRFRHHLGDDVVLFTTDGAHKTFLKCGALQGLYTTVDFGTGSNITDAFLSQRKCEPKGPLINSEFYTGWLDHWGQPHSTIKTEAVASSLYDILARGASVNLYMFIGGTNFAYWNGANSPYAAQPTSYDYDAPLSEAGDLTEKYFALRNIIQKFEKVPEGPIPPSTPKFAYGKVTLEKLKTVGAALDILCPSGPIKSLYPLTFIQVKQHYGFVLYRTTLPQDCSNPAPLSSPLNGVHDRAYVAVDGIPQGVLERNNVITLNITGKAGATLDLLVENMGRVNYGAYINDFKGLVSNLTLSSNILTDWTIFPLDTEDAVCSHLGGWGHRDSGHHDEAWAHNSSNYTLPAFYMGNFSIPSGIPDLPQDTFIQFPGWTKGQVWINGFNLGRYWPARGPQLTLFVPQHILMTSAPNTITVLELEWAPCSSDDPELCAVTFVDRPVIGSSVTYDHPSKPVEKRLMPPPPQKNKDSWLDHV

SEQ ID NO: 5979 - protein, 114 aa, Homo Sapiens
MGGLPAWLLEKESILLRSSDPDYLAAVDKWLGVLLPKMKPLLYQNGGPVITVQVENEYGSYFACDFDYLRFLQKRFRHHLGDDVVLFTTDGAHKTFLKCGALQGLYTTVDFGTG

SEQ ID NO: 5980 - protein, 41 aa, Homo Sapiens
MPGFLVRILPLLLVLLLLGPTRGLRITWQLWTSGWESFCPR

SEQ ID NO: 5981 - protein, 546 aa, Homo Sapiens
MPGFLVRILPLLLVLLLLGPTRGLRNATQRMFEIDYSRDSFLKDGQPFRYISGSIHYSRVPRFYWKDRLLKMKMAGLNAIQTLPGSCGQVVGSPSAQDEASPLSEWRASYNSAGSNITDAFLSQRKCEPKGPLINSEFYTGWLDHWGQPHSTIKTEAVASSLYDILARGASVNLYMFIGGTNFAYWNGANSPYAAQPTSYDYDAPLSEAGDLTEKYFALRNIIQKFEKVPEGPIPPSTPKFAYGKVTLEKLKTVGAALDILCPSGPIKSLYPLTFIQVKQHYGFVLYRTTLPQDCSNPAPLSSPLNGVHDRAYVAVDGIPQGVLERNNVITLNITGKAGATLDLLVENMGRVNYGAYINDFKGLVSNLTLSSNILTDWTIFPLDTEDAVCSHLGGWGHRDSGHHDEAWAHNSSNYTLPAFYMGNFSIPSGIPDLPQDTFIQFPGWTKGQVWINGFNLGRYWPARGPQLTLFVPQHILMTSAPNTITVLELEWAPCSSDDPELCAVTFVDRPVIGSSVTYDHPSKPVEKRLMPPPPQKNKDSWLDHV

SEQ ID NO: 5982 - protein, 677 aa, Homo Sapiens
MPGFLVRILPLLLVLLLLGPTRGLRNATQRMFEIDYSRDSFLKDGQPFRYISGSIHYSRVPRFYWKDRLLKMKMAGLNAIQTYVPWNFHEPWPGQYQFSEDHDVEYFLRLAHELGLLVILRPGPYICAEWEMGGLPAWLLEKESILLRSSDPDYLAAVDKWLGVLLPKMKPLLYQNGGPVITVQVENEYGSYFACDFDYLRFLQKRFRHHLGDDVVLFTTDGAHKTFLKCGALQGLYTTVDFGTGSNITDAFLSQRKCEPKGPLINSEFYTGWLDHWGQPHSTIKTEAVASSLYDILARGASVNLYMFIGGTNFAYWNGANSPYAAQPTSYDYDAPLSEAGDLTEKYFALRNIIQKFEKVPEGPIPPSTPKFAYGKVTLEKLKTVGAALDILCPSGPIKSLYPLTFIQVKQHYGFVLYRTTLPQDCSNPAPLSSPLNGVHDRAYVAVDGIPQGVLERNNVITLNITGKAGATLDLLVENMGRVNYGAYINDFKGLVSNLTLSSNILTDWTIFPLDTEDAVCSHLGGWGHRDSGHHDEAWAHNSSNYTLPAFYMGNFSIPSGIPDLPQDTFIQFPGWTKGQVWINGFNLGRYWPARGPQLTLFVPQHILMTSAPNTITVLELEWAPCSSDDPELCAVTFVDRPVIGSSVTYDHPSKPVEKRLMPPPPQKNKDSWLDHV

SEQ ID NO: 5983 - protein, 147 aa, Homo Sapiens
MPGFLVRILPLLLVLLLLGPTRGLRSRFLPWAFHLPRQAPKSQLPLHKRGTKTAPNEHASSNRSGRRRRRQQWNATQRMFEIDYSRDSFLKDGQPFRYISGSIHYSRVPRFYWKDRLLKMKMAGLNAIQTYVPWNFHEPWPGQYQFS

SEQ ID NO: 5984 - protein, 185 aa, Homo Sapiens
MPGFLVRILPLLLVLLLLGPTRGLRVENEYGSYFACDFDYLRFLQKRFRHHLGDDVVLFTTDGAHKTFLKCGALQGLYTTVDFGTGSNITDAFLSQRKCEPKGPLINSEFYTGWLDHWGQPHSTIKTEAVASSLYDILARGASVNLYMFIGGTNFAYWNGANSPYAAQPTSYDYDAPLSEAGDLT

SEQ ID NO: 5985 - protein, 9 aa, Homo Sapiens
MAPKKLSCL

SEQ ID NO: 5986 - protein, 26 aa, Homo Sapiens
MAPKKLSCLRSLLLPLSLTLLLPQAD

SEQ ID NO: 5987 - protein, 114 aa, Homo Sapiens
MAPKKLSCLRSLLLPLSLTLLLPQADTRSFVVDRGHDRFLLDGAPFRYVSGSLHYFRVPRVLWADRLLKMRWSGLNAIQFYVPWNYHEPQPGVYNFNGSRDLIAFLNEAALANL

SEQ ID NO: 5988 - protein, 564 aa, Homo Sapiens
MAPKKLSCLRSLLLPLSLTLLLPQADTRSFVVDRGHDRFLLDGAPFRYVSGSLHYFRVPRVLWADRLLKMRWSGLNAIQFYVPWNYHEPQPGVYNFNGSRDLIAFLNEAALANLLVILRPGPYICAEWEMGGLPSWLLRKPEIHLRTSDPADNMTKIFTLLRKYEPHGPLVNSEYYTGWLDYWGQNHSTRSVSAVTKGLENMLKLGASVNMYMFHGGTNFGYWNGADKKGRFLPITTSYDYDAPISEAGDPTPKLFALRDVISKFQEVPLGPLPPPSPKMMLGPVTLHLVGHLLAFLDLLCPRGPIHSILPMTFEAVKQDHGFMLYRTYMTHTIFEPTPFWVPNNGVHDRAYVMVDGVFQGVVERNMRDKLFLTGKLGSKLDILVENMGRLSFGSNSSDFKGLLKPPILGQTILTQWMMFPLKIDNLVKWWFPLQLPKWPYPQAPSGPTFYSKTFPILGSVGDTFLYLPGWTKGQVWINGFNLGRYWTKQGPQQTLYVPRFLLFPRGALNKITLLELEDVPLQPQVQFLDKPILNSTSTLHRTHINSLSADTLSASEPMELSGH

SEQ ID NO: 5989 - protein, 654 aa, Homo Sapiens
MAPKKLSCLRSLLLPLSLTLLLPQADTRSFVVDRGHDRFLLDGAPFRYVSGSLHYFRVPRVLWADRLLKMRWSGLNAIQFYVPWNYHEPQPGVYNFNGSRDLIAFLNEAALANLLVILRPGPYICAEWEMGGLPSWLLRKPEIHLRTSDPDFLAAVDSWFKVLLPKIYPWLYHNGGNIISIQVENEYGSYRACDFSYMRHLAGLFRALLGEKILLFTTDGPEGLKCGSLRGLYTTVDFGPADNMTKIFTLLRKYEPHGPLVNSEYYTGWLDYWGQNHSTRSVSAVTKGLENMLKLGASVNMYMFHGGTNFGYWNGADKKGRFLPITTSYDYDAPISEAGDPTPKLFALRDVISKFQEVPLGPLPPPSPKMMLGPVTLHLVGHLLAFLDLLCPRGPIHSILPMTFEAVKQDHGFMLYRTYMTHTIFEPTPFWVPNNGVHDRAYVMVDGVFQGVVERNMRDKLFLTGKLGSKLDILVENMGRLSFGSNSSDFKGLLKPPILGQTILTQWMMFPLKIDNLVKWWFPLQLPKWPYPQAPSGPTFYSKTFPILGSVGDTFLYLPGWTKGQVWINGFNLGRYWTKQGPQQTLYVPRFLLFPRGALNKITLLELEDVPLQPQVQFLDKPILNSTSTLHRTHINSLSADTLSASEPMELSGH

SEQ ID NO: 5990 - protein, 654 aa, Homo Sapiens; identical to SEQ ID NO: 5989

SEQ ID NO: 5991 - protein, 50 aa, Homo Sapiens
MAPKKLSCLRSLLLPLSLTLLLPQTGPRSAMCLAACTTFGYRGCFGPTGF

SEQ ID NO: 5992 - protein, 185 aa, Homo Sapiens
  misc_feature (1)..(1): Xaa can be any naturally occurring amino acid
XKMRWSGLNAIQFYVPWNYHEPQPGVYNFNGSRDLIAFLNEAALANLLVILRPGPYICAEWEMGGLPSWLLRKPEIHLRTSDPDFLAAVDSWFKVLLPKIYPWLYHNGGNIISIQVENEYGSYRACDFSYMRHLAGLFRALLGEKILLFTTDGPEGLKCGSLRGLYTTVDFGPGLKQGLGVESGE

SEQ ID NO: 5993 - protein, 636 aa, Homo Sapiens
MTTWSLRRRPARTLGLLLLVVLGFLVLRRLDWSTLVPLRLRHRQLGLQAKGWNFMLEDSTFWIFGGSIHYFRVPREYWRDRLLKMKACGLNTLTTYVPWNLHEPERGKFDFSGNLDLEAFVLMAAEIGLWVILRPGPYICSEMDLGGLPSWLLQDPGMRLRTTYKGFTEAVDLYFDHLMSRVVPLQYKRGGPIIAVQVENEYGSYNKDPAYMPYVKKALEDRGIVELLLTSDNKDGLSKGIVQGVLATINLQSTHELQLLTTFLFNVQGTQPKMVMEYWTGWFDSWGGPHNILDSSEVLKTVSAIVDAGSSINLYMFHGGTNFGFMNGAMHFHDYKSDVTSYDYDAVLTEAGDYTAKYMKLRDFFGSISGIPLPPPPDLLPKMPYEPLTPVLYLSLWDALKYLGEPIKSEKPINMENLPVNGGNGQSFGYILYETSITSSGILSGHVHDRGQVFVNTVSIGFLDYKTTKIAVPLIQGYTVLRILVENRGRVNYGENIDDQRKGLIGNLYLNDSPLKNFRIYSLDMKKSFFQRFGLDKWSSLPETPTLPAFFLGSLSISSTPCDTFLKLEGWEKGVVFINGQNLGRYWNIGPQKTLYLPGPWLSSGINQVIVFEETMAGPALQFTETPHLGRNQYIK

SEQ ID NO: 5994 - protein, 636 aa, Homo Sapiens; identical to SEQ ID NO: 5993

SEQ ID NO: 5995 - protein, 553 aa, Homo Sapiens
MNHVAKQQSEEAFPQEQQKAPPVVGGFNSNVGSKVLGLKYEEIDCLINDEHTIKGRREGNEVFLPFTWVEKYFDVYGKVVQYDGYDRFEFSHSYSKVYAQRAPYHPDGVFMSFEGYNVEVRDRVKCISGVEGVPLSTQWGPQGYFYPIQIAQYGLSHYSKNLTEKPPHIEVYETAEDRDKNKPNDWTVPKGCFMANVADKSRFTNVKQFIAPETSEGVSLQLGNTKDFIISFDLKFLTNGSVSVVLETTEKNQLFTIHYVSNAQLIAFKERDIYYGIGPRTSWSTVTRDLVTDLRKGVGLSNTKAVKPTKIMPKKVVRLIAKGKGFLDNITISTTAHMAAFFAASDWLVRNQDEKGGWPIMVTRKLGEGFKSLEPGWYSAMAQGQAISTLVRAYLLTKDHIFLNSALRATAPYKFLSEQHGVKAVFMNKHDWYEEYPTTPSSFVLNGFMYSLIGLYDLKETAGEKLGKEARSLYERGMESLKAMLPLYDTGSGTIYDLRHFMLGIAPNLARWDYHTTHINQLQLLSTIDESPVFKEFVKRWKSYLKGSRAKHN

SEQ ID NO: 5996 - protein, 617 aa, Homo Sapiens
MRCLAARVNYKTLIIICALFTLVTVLLWNKCSSDKAIQFPRRSSSGFRVDGFEKRAAASESNNYMNHVAKQQSEEAFPQEQQKAPPVVGGFNSNVGSKVLGLKYEEIDCLINDEHTIKGRREGNEVFLPFTWVEKYFDVYGKVVQYDGYDRFEFSHSYSKVYAQRAPYHPDGVFMSFEGYNVEVRDRVKCISGVEGVPLSTQWGPQGYFYPIQIAQYGLSHYSKNLTEKPPHIEVYETAEDRDKNKPNDWTVPKGCFMANVADKSRFTNVKQFIAPETSEGVSLQLGNTKDFIISFDLKFLTNGSVSVVLETTEKNQLFTIHYVSNAQLIAFKERDIYYGIGPRTSWSTVTRDLVTDLRKGVGLSNTKAVKPTKIMPKKVVRLIAKGKGFLDNITISTTAHMAAFFAASDWLVRNQDEKGGWPIMVTRKLGEGFKSLEPGWYSAMAQGQAISTLVRAYLLTKDHIFLNSALRATAPYKFLSEQHGVKAVFMNKHDWYEEYPTTPSSFVLNGFMYSLIGLYDLKETAGEKLGKEARSLYERGMESLKAMLPLYDTGSGTIYDLRHFMLGIAPNLARWDYHTTHINQLQLLSTIDESPVFKEFVKRWKSYLKGSRAKHN

SEQ ID NO: 5997 - protein, 1192 aa, Homo Sapiens
MAACGRVRRMFRLSAALHLLLLFAAGAEKLPGQGVHSQGQGPGANFVSFVGQAGGGGPAGQQLPQLPQSSQLQQQQQQQQQQQQPQPPQPPFPAGGPPARRGGAGAGGGWKLAEEESCREDVTRVCPKHTWSNNLAVLECLQDVRELLWNYKLNLTTDPKFESVAREVCKSTITEIKECADEPVGKGYMVSCLVDHRGNITEYQCHQYITKMTAIIFSDYRLICGFMDDCKNDINILKCGSIRLGEKDAHSQGEVVSCLEKGLVKEAEEREPKIQVSELCKKAILRVAELSSDDFHLDRHLYFACRDDRERFCENTQAGEGRVYKCLFNHKFEESMSEKCREALTTRQKLIAQDYKVSYSLAKSCKSDLKKYRCNVENLPRSREARLSYLLMCLESAVHRGRQVSSECQGEMLDYRRMLMEDFSLSPEIILSCRGEIEHHCSGLHRKGRTLHCLMKVVRGEKGNLGMNCQQALQTLIQETDPGADYRIDRALNEACESVIQTACKHIRSGDPMILSCLMEHLYTEKMVEDCEHRLLELQYFISRDWKLDPVLYRKCQGDASRLCHTHGWNETSEFMPQGAVFSCLYRHAYRTEEQGRRLSRECRAEVQRILHQRAMDVKLDPALQDKCLIDLGKWCSEKTETGQELECLQDHLDDLVVECRDIVGNLTELESEDIQIEALLMRACEPIIQNFCHDVADNQIDSGDLMECLIQNKHQKDMNEKCAIGVTHFQLVQMKDFRFSYKFKMACKEDVLKLCPNIKKKVDVVICLSTTVRNDTLQEAKEHRVSLKCRRQLRVEELEMTEDIRLEPDLYEACKSDIKNFCSAVQYGNAQIIECLKENKKQLSTRCHQKVFKLQETEMMDPELDYTLMRVCKQMIKRFCPEADSKTMLQCLKQNKNSELMDPKCKQMITKRQITQNTDYRLNPMLRKACKADIPKFCHGILTKAKDDSELEGQVISCLKLRYADQRLSSDCEDQIRIIIQESALDYRLDPQLQLHCSDEISSLCAEEAAAQEQTGQVEECLKVNLLKIKTELCKKEVLNMLKESKADIFVDPVLHTACALDIKHHCAAITPGRGRQMSCLMEALEDKRVRLQPECKKRLNDRIEMWSYAAKVAPADGFSDLAMQVMTSPSKNYILSVISGSICILFLIGLMCGRITKRVTRELKDRLQYRSETMAYKGLVWSQDVTGSPA

SEQ ID NO: 5998 - protein, 1203 aa, Homo Sapiens
MAACGRVRRMFRLSAALHLLLLFAAGAEKLPGQGVHSQGQGPGANFVSFVGQAGGGGPAGQQLPQLPQSSQLQQQQQQQQQQQQPQPPQPPFPAGGPPARRGGAGAGGGWKLAEEESCREDVTRVCPKHTWSNNLAVLECLQDVREPENEISSDCNHLLWNYKLNLTTDPKFESVAREVCKSTITEIKECADEPVGKGYMVSCLVDHRGNITEYQCHQYITKMTAIIFSDYRLICGFMDDCKNDINILKCGSIRLGEKDAHSQGEVVSCLEKGLVKEAEEREPKIQVSELCKKAILRVAELSSDDFHLDRHLYFACRDDRERFCENTQAGEGRVYKCLFNHKFEESMSEKCREALTTRQKLIAQDYKVSYSLAKSCKSDLKKYRCNVENLPRSREARLSYLLMCLESAVHRGRQVSSECQGEMLDYRRMLMEDFSLSPEIILSCRGEIEHHCSGLHRKGRTLHCLMKVVRGEKGNLGMNCQQALQTLIQETDPGADYRIDRALNEACESVIQTACKHIRSGDPMILSCLMEHLYTEKMVEDCEHRLLELQYFISRDWKLDPVLYRKCQGDASRLCHTHGWNETSEFMPQGAVFSCLYRHAYRTEEQGRRLSRECRAEVQRILHQRAMDVKLDPALQDKCLIDLGKWCSEKTETGQELECLQDHLDDLVVECRDIVGNLTELESEDIQIEALLMRACEPIIQNFCHDVADNQIDSGDLMECLIQNKHQKDMNEKCAIGVTHFQLVQMKDFRFSYKFKMACKEDVLKLCPNIKKKVDVVICLSTTVRNDTLQEAKEHRVSLKCRRQLRVEELEMTEDIRLEPDLYEACKSDIKNFCSAVQYGNAQIIECLKENKKQLSTRCHQKVFKLQETEMMDPELDYTLMRVCKQMIKRFCPEADSKTMLQCLKQNKNSELMDPKCKQMITKRQITQNTDYRLNPMLRKACKADIPKFCHGILTKAKDDSELEGQVISCLKLRYADQRLSSDCEDQIRIIIQESALDYRLDPQLQLHCSDEISSLCAEEAAAQEQTGQVEECLKVNLLKIKTELCKKEVLNMLKESKADIFVDPVLHTACALDIKHHCAAITPGRGRQMSCLMEALEDKRVRLQPECKKRLNDRIEMWSYAAKVAPADGFSDLAMQVMTSPSKNYILSVISGSICILFLIGLMCGRITKRVTRELKDRLQYRSETMAYKGLVWSQDVTGSPA

SEQ ID NO: 5999 - protein, 1179 aa, Homo Sapiens
MAACGRVRRMFRLSAALHLLLLFAAGAEKLPGQGVHSQGQGPGANFVSFVGQAGGGGPAGQQLPQLPQSSQLQQQQQQQQQQQQPQPPQPPFPAGGPPARRGGAGAGGGWKLAEEESCREDVTRVCPKHTWSNNLAVLECLQDVREPENEISSDCNHLLWNYKLNLTTDPKFESVAREVCKSTITEIKECADEPVGKGYMVSCLVDHRGNITEYQCHQYITKMTAIIFSDYRLICGFMDDCKNDINILKCGSIRLGEKDAHSQGEVVSCLEKGLVKEAEEREPKIQVSELCKKAILRVAELSSDDFHLDRHLYFACRDDRERFCENTQAGEGRVYKCLFNHKFEESMSEKCREALTTRQKLIAQDYKVSYSLAKSCKSDLKKYRCNVENLPRSREARLSYLLMCLESAVHRGRQVSSECQGEMLDYRRMLMEDFSLSPEIILSCRGEIEHHCSGLHRKGRTLHCLMKVVRGEKGNLGMNCQQALQTLIQETDPGADYRIDRALNEACESVIQTACKHIRSGDPMILSCLMEHLYTEKMVEDCEHRLLELQYFISRDWKLDPVLYRKCQGDASRLCHTHGWNETSEFMPQGAVFSCLYRHAYRTEEQGRRLSRECRAEVQRILHQRAMDVKLDPALQDKCLIDLGKWCSEKTETGQELECLQDHLDDLVVECRDIVGNLTELESEDIQIEALLMRACEPIIQNFCHDVADNQIDSGDLMECLIQNKHQKDMNEKCAIGVTHFQLVQMKDFRFSYKFKMACKEDVLKLCPNIKKKVDVVICLSTTVRNDTLQEAKEHRVSLKCRRQLRVEELEMTEDIRLEPDLYEACKSDIKNFCSAVQYGNAQIIECLKENKKQLSTRCHQKVFKLQETEMMDPELDYTLMRVCKQMIKRFCPEADSKTMLQCLKQNKNSELMDPKCKQMITKRQITQNTDYRLNPMLRKACKADIPKFCHGILTKAKDDSELEGQVISCLKLRYADQRLSSDCEDQIRIIIQESALDYRLDPQLQLHCSDEISSLCAEEAAAQEQTGQVEECLKVNLLKIKTELCKKEVLNMLKESKADIFVDPVLHTACALDIKHHCAAITPGRGRQMSCLMEALEDKRVRLQPECKKRLNDRIEMWSYAAKVAPADGFSDLAMQVMTSPSKNYILSVISGSICILFLIGLMCGRITKRVTRELKDR

SEQ ID NO: 6000 - protein, 698 aa, Homo Sapiens
MAACGRVRRMFRLSAALHLLLLFAAGAEKLPGQGVHSQGQGPGANFVSFVGQAGGGGPAGQQLPQLPQSSQLQQQQQQQQQQQQPQPPQPPFPAGGPPARRGGAGAGGGWKLAEEESCREDVTRVCPKHTWSNNLAVLECLQDVREPENEISSDCNHLLWNYKLNLTTDPKFESVAREVCKSTITEIKECADEPVGKGYMVSCLVDHRGNITEYQCHQYITKMTAIIFSDYRLICGFMDDCKNDINILKCGSIRLGEKDAHSQGEVVSCLEKGLVKEAEEREPKIQVSELCKKAILRVAELSSDDFHLDRHLYFACRDDRERFCENTQAGEGRVYKCLFNHKFEESMSEKCREALTTRQKLIAQDYKVSYSLAKSCKSDLKKYRCNVENLPRSREARLSYLLMCLESAVHRGRQVSSECQGEMLDYRRMLMEDFSLSPEIILSCRGEIEHHCSGLHRKGRTLHCLMKVVRGEKGNLGMNCQQALQTLIQETDPGADYRIDRALNEACESVIQTACKHIRSGDPMILSCLMEHLYTEKMVEDCEHRLLELQYFISRDWKLDPVLYRKCQGDASRLCHTHGWNETSEFMPQGAVFSCLYRHAYRTEEQGRRLSRECRAEVQRILHQRAMDVKLDPALQDKCLIDLGKWCSEKTETGQELECLQDHLDDLVVECRDIVGNLTELESEAEREYVFKNLPFKV

SEQ ID NO: 6001 - protein, 305 aa, Homo Sapiens
MAACGRVRRMFRLSAALHLLLLFAAGAEKLPGQGVHSQGQGPGANFVSFVGQAGGGGPAGQQLPQLPQSSQLQQQQQQQQQQQQPQPPQPPFPAGGPPARRGGAGAGGGWKLAEEESCREDVTRVCPKHTWSNNLAVLECLQDVREPENEISSDCNHLLWNYKLNLTTDPKFESVAREVCKSTITEIKECADEPVGKGYMVSCLVDHRGNITEYQCHQYITKMTAIIFSDYRLICGFMDDCKNDINILKCGSIRLGEKDAHSQDTPTALRNREGGSHGSAELKSKGSYTSVPWMSSWILPSRISA

SEQ ID NO: 6002 - protein, 698 aa, Homo Sapiens; identical to SEQ ID NO: 6000

SEQ ID NO: 6003 - protein, 152 aa, Homo Sapiens
MAACGRVRRMFRLSAALHLLLLFAAGAEKLPGQGVHSQGQGPGANFVSFVGQPPFPAGGPPARRGGAGAGGGWKLAEEESCREDVTRVCPKHTWSNNLAVLECLQDVREPENEISSDCNHLLWNYKLNLTTDPKFESVAREVCKSTITEIKE

SEQ ID NO: 6004 - protein, 74 aa, Homo Sapiens
MVSCLVDHRGNITEYQCHQYITKMTAIIFSDYRLICGFMDDCKNDINILKCGSIRLGEKDAHSQGEVVSCLEKG

SEQ ID NO: 6005 - protein, 148 aa, Homo Sapiens
MRVTLATIAWMVSFVSNYSHTANILPDIENEDFIKDCVRIHNKFRSEVKPTASDMLYMTWDPALAQIAKAWASNCQFSHNTRLKPPHKLHPNFTSLGENIWTGSVPIFSVSSAITNWYDEIQDYDFKTRICKKVCGHYTQRELPNLAI

SEQ ID NO: 6006 - protein, 238 aa, Homo Sapiens
MRVTLATIAWMVSFVSNYSHTANILPDIENEDFIKDCVRIHNKFRSEVKPTASDMLYMTWDPALAQIAKAWASNCQFSHNTRLKPPHKLHPNFTSLGENIWTGSVPIFSVSSAITNWYDEIQDYDFKTRICKKVCGHYTQVSQERGRDPNPKRGFLNLARENPGLFGQIVTKLAAQFNFALKFLALTLFPMEHILYATTDQEGITQLGHIREEPPAVPAPIMTSVWTISVLTDSETKS

SEQ ID NO: 6007 - protein, 266 aa, Homo Sapiens
MRVTLATIAWMVSFVSNYSHTANILPDIENEDFIKDCVRIHNKFRSEVKPTASDMLYMTWDPALAQIAKAWASNCQFSHNTRLKPPHKLHPNFTSLGENIWTGSVPIFSVSSAITNWYDEIQDYDFKTRICKKVCGHYTQVVWADSYKVGCAVQFCPKVSGFDALSNGAHFICNYGPGGNYPTWPYKRGATCSACPNNDKCLDNLCVNRQRDQVKRYYSVVYPGWPIYPRNRYTSLFLIVNSVILILSVIITILVQHKYPNLVLLD

SEQ ID NO: 6008 - protein, 89 aa, Homo Sapiens
MTKSRTMTSRLGYAKKSVATTLRLFGQIVTKLAAQFNFALKFLALTLFPMEHILYATTDQEGITQLGHIREEPPAVPAPIMTSVWTISV

SEQ ID NO: 6009 - protein, 233 aa, Homo Sapiens
MALKNKFSCLWILGLCLVATTSSKIPSITDPHFIDNCIEAHNEWRGKVNPPAADMKYMIWDKGLAKMAKAWANQCKFEHNDCLDKSYKCYAAFEYVGENIWLGGIKSFTPRHAITAWYNETQFYDFDSLSCSRVCGHYTQLVWANSFYVGCAVAMCPNLGGASTAIFVCNYGPAGNFANMPPYVRGESCSLCSKEEKCVKNLCKNPFLKPTGRAPQQTAFNPFSLGFLLLRIF

SEQ ID NO: 6010 - protein, 242 aa, Homo Sapiens
MALKNKFSCLWILGLCLVATTSSKIPSITDPHFIDNCIEAHNEWRGKVNPPAADMKYMIWDKGLAKMAKAWANQCKFEHNDCLDKSYKCYAAFEYVGENIWLGGIKSFTPRHAITAWYNETQFYDFDSLSCSRVCGHYTQLVWANSFYVGCAVAMCPNLGGASTAIFVCNYGPAGNFANMPPYVRGESCSLCSKEEKCVKNLCRTPQLIIPNQNPFLKPTGRAPQQTAFNPFSLGFLLLRIF

SEQ ID NO: 6011 - protein, 57 aa, Homo Sapiens
MSLLKLILLRVPCRATACQKGLTTQTFPLSPQSPKGQLAACSNKMSFLFRAEEKIHF

SEQ ID NO: 6012 - protein, 39 aa, Homo Sapiens
  misc_feature (1)..(1): Xaa can be any naturally occurring amino acid
XLSPQSPKGQLAACSNKMSFLFRAEEGLHNLLYLTKIHF

SEQ ID NO: 6013 - protein, 56 aa, Homo Sapiens
MMVQRLGLISPPASQVSTACNQISPSLQRAMNAANLNIPPSDTRKCGKHGKVPSTK

SEQ ID NO: 6014 - protein, 89 aa, Homo Sapiens
MMVQRLGLISPPASQVSTACNQISPSLQRAMNAANLNIPPSDTRSLISRESLASTTLSLTESQSASSMKQEWSQGYRALPSLSNHGSQN

SEQ ID NO: 6015 - protein, 89 aa, Homo Sapiens; identical to SEQ ID NO: 6014

SEQ ID NO: 6016 - protein, 89 aa, Homo Sapiens; identical to SEQ ID NO: 6014

SEQ ID NO: 6017 - protein, 775 aa, Homo Sapiens
MMVQRLGLISPPASQVSTACNQISPSLQRAMNAANLNIPPSDTRSLISRESLASTTLSLTESQSASSMKQEWSQGYRALPSLSNHGSQNGLDLGDLLSLPPGTSMSSNSVSNSLPSYLFGTESSHSPYPSPRHSSTRSHSARSKKRALSLSPLSDGIGIDFNTIIRTSPTSLVAYINGSRASPANLSPQPEVYGHFLGVRGSCIPQPRPVPGSQKGVLVAPGGLALPAYGEDGALEHERMQQLEHGGLQPGLVNHMVVQHGLPGPDSQSAGLFKTERLEEFPGSTVDLPPAPPLPPLPPPPGPPPPYHAHAHLHHPELGPHAQQLALPQATLDDDGEMDGIGGKHCCRWIDCSALYDQQEELVRHIEKVHIDQRKGEDFTCFWAGCPRRYKPFNARYKLLIHMRVHSGEKPNKCTFEGCEKAFSRLENLKIHLRSHTGEKPYLCQHPGCQKAFSNSSDRAKHQRTHLDTKPYACQIPGCTKRYTDPSSLRKHVKAHSSKEQQARKKLRSSTELHPDLLTDCLTVQSLQPATSPRDAAAEGTVGRSPGPGPDLYSAPIFSSNYSSRSGTAAGAVPPPHPVSHPSPGHNVQGSPHNPSSQLPPLTAVDAGAERFAPSAPSPHHISPRRVPAPSSILQRTQPPYTQQPSGSHLKSYQPETNSSFQPNGIHVHGFYGQLQKFCPPHYPDSQRIVPPVSSCSVVPSFEDCLVPTSMGQASFDVFHRAFSTHSGITVYDLPSSSSSLFGESLRSGAEDATFLQISTVDRCPSQLSSVYTEG

SEQ ID NO: 6018 - protein, 244 aa, Homo Sapiens
MNGRSCSMSLHRTSGTPQGPRMVSGHHIPAIRAHSGTPGPSPCGSTSSPTMASLANNLHLKMPSGGGMAPQNNVAESRIHLPALSPRRQMLTNGKPRFQVTQAGGMSGSHTLKPKQQEFGSPFPPNPGKGALGFGPQCKSIGKGSCNNLVVTSSPMMVQRLGLISPPASQVSTACNQISPSLQRAMNAANLNIPPSDTRSLISRESLASTTLSLTESQSASSMKQEWSQGYRALPSLSNHGSQN

SEQ ID NO: 6019 - protein, 244 aa, Homo Sapiens; identical to SEQ ID NO: 6018

SEQ ID NO: 6020 - protein, 930 aa, Homo Sapiens
MNGRSCSMSLHRTSGTPQGPRMVSGHHIPAIRAHSGTPGPSPCGSTSSPTMASLANNLHLKMPSGGGMAPQNNVAESRIHLPALSPRRQMLTNGKPRFQVTQAGGMSGSHTLKPKQQEFGSPFPPNPGKGALGFGPQCKSIGKGSCNNLVVTSSPMMVQRLGLISPPASQVSTACNQISPSLQRAMNAANLNIPPSDTRSLISRESLASTTLSLTESQSASSMKQEWSQGYRALPSLSNHGSQNGLDLGDLLSLPPGTSMSSNSVSNSLPSYLFGTESSHSPYPSPRHSSTRSHSARSKKRALSLSPLSDGIGIDFNTIIRTSPTSLVAYINGSRASPANLSPQPEVYGHFLGVRGSCIPQPRPVPGSQKGVLVAPGGLALPAYGEDGALEHERMQQLEHGGLQPGLVNHMVVQHGLPGPDSQSAGLFKTERLEEFPGSTVDLPPAPPLPPLPPPPGPPPPYHAHAHLHHPELGPHAQQLALPQATLDDDGEMDGIGGKHCCRWIDCSALYDQQEELVRHIEKVHIDQRKGEDFTCFWAGCPRRYKPFNARYKLLIHMRVHSGEKPNKCTFEGCEKAFSRLENLKIHLRSHTGEKPYLCQHPGCQKAFSNSSDRAKHQRTHLDTKPYACQIPGCTKRYTDPSSLRKHVKAHSSKEQQARKKLRSSTELHPDLLTDCLTVQSLQPATSPRDAAAEGTVGRSPGPGPDLYSAPIFSSNYSSRSGTAAGAVPPPHPVSHPSPGHNVQGSPHNPSSQLPPLTAVDAGAERFAPSAPSPHHISPRRVPAPSSILQRTQPPYTQQPSGSHLKSYQPETNSSFQPNGIHVHGFYGQLQKFCPPHYPDSQRIVPPVSSCSVVPSFEDCLVPTSMGQASFDVFHRAFSTHSGITVYDLPSSSSSLFGESLRSGAEDATFLQISTVDRCPSQLSSVYTEG

SEQ ID NO: 6021 - protein, 142 aa, Homo Sapiens
MNGRSCSMSLHRTSGTPQGPRMVSGHHIPAIRAHSGTPGPSPCGSTSSPTMASLANNLHLKMPSGGGMAPQNNVAESRIHLPALSPRRQMLTNGKPRFQVTQAGGMSGSHTLKPKQQEFGSPFPPNPGKGPLFRVSLWRPRP

SEQ ID NO: 6022 - protein, 75 aa, Homo Sapiens
FNLTFGASTGPGYWDQHYLSWSMLLGVGFPPVDGLSPLVLGIMAVALGAPGLMLLGGGLVLLLHHKKYSEYQSIN

SEQ ID NO: 6023 - protein, 320 aa, Homo Sapiens
MRGSVECTWGWGHCAPSPLLLWTLLLFAAPFGLLGEKTRQLLEFDSTNVSDTAAKPLGRPYPPYSLADFSWNNITDSLDPATLSATFQGHPMNDPTRTFANGSLAFRVQAFSRSSRPAQPPRLLHTADTCQLEVALIGASPRGNRSLFGLEVATLGQGPDCPSMQEQHSIDDEYAPAVFQLDQLLWGSLPSGFAQWRPVAYSQKPGGRESALPCQASPLHPALAYSLPQSPIVRAFFGSQNNFCAFNLTFGASTGPGYWDQHYLSWSMLLGVGFPPVDGLSPLVLGIMAVALGAPGLMLLGGGLVLLLHHKKYSEYQSIN

SEQ ID NO: 6024 - protein, 183 aa, Homo Sapiens [sequence omitted]

SEQ ID NO: 6025 - protein, 89 aa, Homo Sapiens
MRGSVECTWGWGHCAPSPLLLWTLLLFAAPFGLLGEKTRQVRRLGENQGEECRGESSSQLEGGTKDWGKAFGKTISSILLGRFLLEQHH

SEQ ID NO: 6026 - protein, 130 aa, Homo Sapiens
MRGSVECTWGWGHCAPSPLLLWTLLLFAAPFGLLGEKTRQVSLEVIPNWLGPLQNLLHIRAVGTNSTLHYVWSSLGPLAVVMVATNTPHSTLSVNWSLLLSPEPDGGLMVLPKDSIQFSSALVFTRGSCC

SEQ ID NO: 6027 - protein, 406 aa, Homo Sapiens
MRGSVECTWGWGHCAPSPLLLWTLLLFAAPFGLLGEKTRQVSLEVIPNWLGPLQNLLHIRAVGTNSTLHYVWSSLGPLAVVMVATNTPHSTLSVNWSLLLSPEPDGGLMVLPKDSIQFSSALVFTRLLEFDSTNVSDTAAKPLGRPYPPYSLADFSWNNITDSLDPATLSATFQGHPMNDPTRTFANGSLAFRVQAFSRSSRPAQPPRLLHTADTCQLEVALIGASPRGNRSLFGLEVATLGQGPDCPSMQEQHSIDDEYAPAVFQLDQLLWGSLPSGFAQWRPVAYSQKPGGRESALPCQASPLHPALAYSLPQSPIVRAFFGSQNNFCAFNLTFGASTGPGYWDQHYLSWSMLLGVGFPPVDGLSPLVLGIMAVALGAPGLMLLGGGLVLLLHHKKYSEYQSIN

SEQ ID NO: 6028 - protein, 331 aa, Homo Sapiens
MRGSVECTWGWGHCAPSPLLLWTLLLFAAPFGLLGEKTRQVSLEVIPNWLGPLQNLLHIRAVGTNSTLHYVWSSLGPLAVVMVATNTPHSTLSVNWSLLLSPEPDGGLMVLPKDSIQFSSALVFTRLLEFDSTNVSDTAAKPLGRPYPPYSLADFSWNNITDSLDPATLSATFQGHPMNDPTRTFANGSLAFRVQAFSRSSRPAQPPRLLHTADTCQLEVALIGASPRGNRSLFGLEVATLGQGPDCPSMQEQHSIDDEYAPAVFQVDAPGCGLPSSGRLVPTSPGHHGSGPGCPRAHAARGRLGSAAAPQEVLRVPVHKLRPALWREGHY

SEQ ID NO: 6029 - protein, 325 aa, Homo Sapiens
MVATNTPHSTLSVNWSLLLSPEPDGGLMVLPKDSIQFSSALVFTRLLEFDSTNVSDTAAKPLGRPYPPYSLADFSWNNITDSLDPATLSATFQGHPMNDPTRTFANGSLAFRVQAFSRSSRPAQPPRLLHTADTCQLEVALIGASPRGNRSLFGLEVATLGQGPDCPSMQEQHSIDDEYAPAVFQLDQLLWGSLPSGFAQWRPVAYSQKPGGRESALPCQASPLHPALAYSLPQSPIVRAFFGSQNNFCAFNLTFGASTGPGYWDQHYLSWSMLLGVGFPPVDGLSPLVLGIMAVALGAPGLMLLGGGLVLLLHHKKYSEYQSIN

SEQ ID NO: 6030 - protein, 111 aa, Homo Sapiens
  misc_feature (1)..(1): Xaa can be any naturally occurring amino acid
XPSMQEQHSIDDEYAPAVFQSPIVRAFFGSQNNFCAFNLTFGASTGPGYWDQHYLSWSMLLGVGFPPVDGLSPLVLGIMAVALGAPGLMLLGGGLVLLLHHKKYSEYQSIN

SEQ ID NO: 6031 - protein, 46 aa, Homo Sapiens
MKFLLTTAFLILISLWVEEAYSKEKSSKKGKGKKKQYLCPSERLYH

SEQ ID NO: 6032 - protein, 46 aa, Homo Sapiens; identical to SEQ ID NO: 6031

SEQ ID NO: 6033 - protein, 56 aa, Homo Sapiens
MKFLLTTAFLILISLWVEEAYSKEKSSKKGKGKKKQYLCPSLVRPDAKKFVLLSLI

SEQ ID NO: 6034 - protein, 497 aa, Homo Sapiens
MKFLLTTAFLILISLWVEEAYSKEKSSKKGKGKKKQYLCPSQQSAEDLARVPANSTSNILNRLLVSYDPRIRPNFKGIPVDVVVNIFINSFGSIQETTMDYRVNIFLRQKWNDPRLKLPSDFRGSDALTVDPTMYKCLWKPDLFFANEKSANFHDVTQENILLFIFRDGDVLVSMRLSITLSCPLDLTLFPMDTQRCKMQLESFGYTTDDLRFIWQSGDPVQLEKIALPQFDIKKEDIEYGNCTKYYKGTGYYTCVEVIFTLRRQVGFYMMGVYAPTLLIVVLSWLSFWINPDASAARVPLGIFSVLSLASECTTLAAELPKVSYVKALDVWLIACLLFGFASLVEYAVVQVMLNNPKRVEAEKARIAKAEQADGKGGNVAKKNTVNGTGTPVHISTLQVGETRCKKVCTSKSDLRSNDFSIVGSLPRDFELSNYDCYGKPIEVNNGLGKSQAKNNKKPPPAKPVIPTAAKRIDLYARALFPFCFLFFNVIYWSIYL

SEQ ID NO: 6035 - protein, 497 aa, Homo Sapiens; identical to SEQ ID NO: 6034

SEQ ID NO: 6036 - protein, 303 aa, Homo Sapiens
MKFLLTTAFLILISLWVEEAYSKEKSSKKGKGKKKQYLCPSQQSAEDLARVPANSTSNILNRLLVSYDPRIRPNFKGIPVDVVVNIFINSFGSIQETTMDYRVNIFLRQKWNDPRLKLPSDFRGSDALTVDPTMYKCLWKPDLFFANEKSANFHDVTQENILLFIFRDGDVLVSMRLSITLSCPLDLTLFPMDTQRCKMQLESFGYTTDDLRFIWQSGDPVQLEKIALPQFDIKKEDIEYGNCTKYYKGTGYYTCVEVIFTLRRQVGFYMMGVYAPTLLIVVLSWLSFWINPDASAARVPLGW

SEQ ID NO: 6037 - protein, 182 aa, Homo Sapiens
AKSGVAGGILLVVPNVMGMMCWSPPLDKMGNSVKGIHFCHDLVSLCNFHNYDNLRHFAKKLDPRREGGDQRVKSVINLLFAAYTGDVSALRRFALSAMDMEQRDYDSRTALHVAAAEGGITLPWMKHCTLDTMMYLKFSKNTKSSTHLKEILTTGRKIKPSIRILMDCCNGLKSQDLNHLPI

SEQ ID NO: 6038 - protein, 114 aa, Homo Sapiens
ESAKKQSGGKVADYIPQLAKFSPDLWGVSVCTVDGQRHSTGDTKVPFCLQSCVKPLKYAIAVNDLGTEYVHRYVGKEPSGLRFNKLFLNEDDKPHNPMVNAGAIVVTSLIKDWW

SEQ ID NO: 6039 - protein, 169 aa, Homo Sapiens
MAATLANGGFCPITGERVLSPEAVRNTLSLMHSCGMYDFSGQFAFHVGLPAKSGVAGGILLVVPNVMGMMCWSPPLDKMGNSVKGIHFCHDLVSLCNFHNYDNLRHFAKKLDPRREGGDQRHSFGPLDYESLQQELALKETVWKKVSPESNEDISTTVVYRMESLGEKS

SEQ ID NO: 6040 - protein, 164 aa, Homo Sapiens
MAATLANGGFCPITGERVLSPEAVRNTLSLMHSCGMYDFSGQFAFHVGLPAKSGVAGGILLVVPNVMGMMCWSPPLDKMGNSVKGIHFCHDLVSLCNFHNYDNLRHFAKKLDPRREGGDQRVKSVINLLFAAYTGDVSALRRFALSAMDMEQRDYDSRTALHVA

SEQ ID NO: 6041 - protein, 103 aa, Homo Sapiens
MGMMCWSPPLDKMGNSVKGIHFCHDLVSLCNFHNYDNLRHFAKKLDPRREGGDQRHSFGPLDYESLQQELALKETVWKKVSPESNEDISTTVVYRMESLGEKS

SEQ ID NO: 6042 - protein, 174 aa, Homo Sapiens
MGMMCWSPPLDKMGNSVKGIHFCHDLVSLCNFHNYDNLRHFAKKLDPRREGGDQRVKSVINLLFAAYTGDVSALRRFALSAMDMEQRDYDSRTALHVAAAEGHVEVVKFLLEACKVNPFPKDRWNNTPMDEALHFGHHDVFKILQEYQVQYTPQGDSDNGKENQTVHKNLDGLL

SEQ ID NO: 6043 - protein, 669 aa, Homo Sapiens
MMRLRGSGMLRDLLLRSPAGVSATLRRAQPLVTLCRRPRGGGRPAAGPAAAARLHPWWGGGGWPAEPLARGLSSSPSEILQELGKGSTHPQPGVSPPAAPAAPGPKDGPGETDAFGNSEGKELVASGENKIKQGLLPSLEDLLFYTIAEGQEKIPVHKFITALKSTGLRTSDPRLKECMDMLRLTLQTTSDGVMLDKDLFKKCVQSNIVLLTQAFRRKFVIPDFMSFTSHIDELYESAKKQSGGKVADYIPQLAKFSPDLWGVSVCTVDGQRHSTGDTKVPFCLQSCVKPLKYAIAVNDLGTEYVHRYVGKEPSGLRFNKLFLNEDDKPHNPMVNAGAIVVTSLIKQGVNNAEKFDYVMQFLNKMAGNEYVGFSNATFQSERESGDRNFAIGYYLKEKKCFPEGTDMVGILDFYFQLCSIEVTCESASVMAATLANGGFCPITGERVLSPEAVRNTLSLMHSCGMYDFSGQFAFHVGLPAKSGVAGGILLVVPNVMGMMCWSPPLDKMGNSVKGIHFCHDLVSLCNFHNYDNLRHFAKKLDPRREGGDQRVKSVINLLFAAYTGDVSALRRFALSAMDMEQRDYDSRTALHVAAAEGHVEVVKFLLEACKVNPFPKDRWNNTPMDEALHFGHHDVFKILQEYQVQYTPQGDSDNGKENQTVHKNLDGLL

SEQ ID NO: 6044 - protein, 598 aa, Homo Sapiens
MMRLRGSGMLRDLLLRSPAGVSATLRRAQPLVTLCRRPRGGGRPAAGPAAAARLHPWWGGGGWPAEPLARGLSSSPSEILQELGKGSTHPQPGVSPPAAPAAPGPKDGPGETDAFGNSEGKELVASGENKIKQGLLPSLEDLLFYTIAEGQEKIPVHKFITALKSTGLRTSDPRLKECMDMLRLTLQTTSDGVMLDKDLFKKCVQSNIVLLTQAFRRKFVIPDFMSFTSHIDELYESAKKQSGGKVADYIPQLAKFSPDLWGVSVCTVDGQRHSTGDTKVPFCLQSCVKPLKYAIAVNDLGTEYVHRYVGKEPSGLRFNKLFLNEDDKPHNPMVNAGAIVVTSLIKQGVNNAEKFDYVMQFLNKMAGNEYVGFSNATFQSERESGDRNFAIGYYLKEKKCFPEGTDMVGILDFYFQLCSIEVTCESASVMAATLANGGFCPITGERVLSPEAVRNTLSLMHSCGMYDFSGQFAFHVGLPAKSGVAGGILLVVPNVMGMMCWSPPLDKMGNSVKGIHFCHDLVSLCNFHNYDNLRHFAKKLDPRREGGDQRHSFGPLDYESLQQELALKETVWKKVSPESNEDISTTVVYRMESLGEKS

SEQ ID NO: 6045 - protein, 276 aa, Homo Sapiens
MNSKRMLLLVLFAFSLMLVERYFRNHQVEELRLSDWFHPRKRPDVITKTDWLAPVLWEGTFDRRVLEKHYRRRNITVGLAVFATGRFAEEYLRPFLHSANKHFMTGYRVIFYIMVDAFFKLPDIEPSPLRTFKAFKVGTERWWLDGPLVHVKSLGEHIASHIQDEVDFLFSMAANQVFQNEFGVETLGPLVAQLHAWWYFRNTKNFPYERRPTSAACIPFGQGDFYYGNLMVGGTPHNILDFIKEYLNGVIHDIKNGLNSTYEKHLNKYFYLNKPT

SEQ ID NO: 6046 - protein, 307 aa, Homo Sapiens
MNSKRMLLLVLFAFSLMLVERYFRNHQVEELRLSDWFHPRKRPDVITKTDWLAPVLWEGTFDRRVLEKHYRRRNITVGLAVFATGRFAEEYLRPFLHSANKHFMTGYRVIFYIMVDAFFKLPDIEPSPLRTFKAFKVGTERWWLDGPLVHVKSLGEHIASHIQDEVDFLFSMAANQVFQNEFGVETLGPLVAQLHAWWYFRNTKNFPYERRPTSAACIPFGQGDFYYGNLMVGGTPHNILDFIKEYLNGVIHDIKNGLNSTYEKHLNKYFYLNKPTLLSPAYSWDLAFSPPPQIQYVKVAHDSQRKL

SEQ ID NO: 6047 - protein, 291 aa, Homo Sapiens
MGVAARPPALRHWFSHSIPLAIFALLLLYLSVRSLGARSGCGPRAQPCVPGETAPFQVRQESGTLEAPERKQPPCLGPRGMLGRMMRRFHASLKPEGDVGLSPYLAGWRALVEFLTPLGSVFAFATREAFTKVTDLEARVHGPDAEHYWSLVAMAAWERRAGLLEQPGAAPRDPTRSSGSRTLLLLHRALRWSQLCLHRVATGALGGPDAGVQCSDAYRAALGPHHPWLVRQTARLAFLAFPGRRRLLELACPGATEAEARAALVRAAGTLEDVYNRTQSLLAERGLLQLA

SEQ ID NO: 6048 - protein, 558 aa, Homo Sapiens
MYRYLGEALLLSRAGPAALGSASADSAALLGWARGQPAAAPQPGLALAARRHYSEAVADREDDPNFFKMVEGFFDRGASIVEDKLVEDLRTRESEEQKRNRVRGILRIIKPCNHVLSLSFPIRRDDGSWEVIEGYRAQHSQHRTPCKGGIRYSTDVSVDEVKALASLMTYKCAVVDVPFGGAKAGVKINPKNYTDNELEKITRRFTMELAKKGFIGPGIDVPAPDMSTGEREMSWIADTYASTIGHYDINAHACVTGKPISQGGIHGRISATGRGVFHGIENFINEASYMSILGMTPGFGDKTFVVQGFGNVGLHSMRYLHRFGAKCIAVGESDGSIWNPDGIDPKELEDFKLQHGSILGFPKAKPYEGSILEADCDILIPAASEKQLTKSNAPRVKAKIIAEGANGPTTPEADKIFLERNIMVIPDLYLNAGGVTVSYFEWLKNLNHVSYGRLTFKYERDSNYHLLMSVQESLERKFGKHGGTIPIVPTAEFQDRISGASEKDIVHSGLAYTMERSARQIMRTAMKYNLGLDLRTAAYVNAIEKVFKVYNEAGVTFT

SEQ ID NO: 6049 - protein, 193 aa, Homo Sapiens
MQSLMQAPLLIALGLLLAAPAQAHLKKPSQLSSFSWDNCDEGKDPAVIRSLTLEPDPIIVPGNVTLSVMGSTSVPLSSPLKVDLVLEKEVAGLWIKIPCTDYIGSCTFEHFCDVLDMLIPTGEPCPEPLRTYGLPCHCPFKEGTYSLPKSEFVVPDLELPSWLTTGNYRIESVLSSSGKRLGCIKIAASLKGI

SEQ ID NO: 6050 - protein, 146 aa, Homo Sapiens
MSWVEAAGVSSTALEDRIVAKHEEVPEVSVQYEEKFQNHHKLPSQLSSFSWDNCDEGKDPAVIRSLTLEPDPIIVPGNVTLSVMGSTSVPLSSPLKVDLVLEKEVAGLWIKIPCTDYIGSCTFEHFCDVLDMLIPTGEPCPEPLRT

SEQ ID NO: 6051 - protein, 104 aa, Homo Sapiens
  misc_feature (1)..(1): Xaa can be any naturally occurring amino acid
XKDPAVIRSLTLEPDPIIVPGNVTLSVMGSTSVPLSSPLKVDLVLEKEVAGLWIKIPCTDYIGSCTFEHFCDVLDMLIPTGEPCPEPLRTYGLPCHCPFKEVST

SEQ ID NO: 6052 - protein, 118 aa, Homo Sapiens
MLLFALLLAMELPLVAASATMRAQWTYSLRCHDCAVINDFNCPNIRVCPYHIRRCMTISIQLSSGDRAAVCPGPHPTFFQPGAWIPTQVTDSKHQPLPAHLTRRHPLHGPGNILPSAI

SEQ ID NO: 6053 - protein, 158 aa, Homo Sapiens
MLLFALLLAMELPLVAASATMRAQWTYSLRCHDCAVINDFNCPNIRVCPYHIRRCMTISIRINSRELLVYKNCTNNCTFVYAAEQPPEAPGKIFKTNSFYWVCCCNSMVCNAGGPTNLERDMLPDEVTEEELPEGTVRLGVSKLLLSFASIIVSNILP

SEQ ID NO: 6054 - protein, 625 aa, Homo Sapiens
MARPVDPQRSPDPTFRSSTRHSGKLEPMEATAHLLRKQCPSRLNSPAWEASGLHWSSLDSPVGSMQALRPSAQHSWSPEPSVVPDQAWEDTALHQKKLCPLSLTSLPREAAVNFSYRSQTLLQEAQVLQGSPELLPRSPKPSGLQRLAPEEATALPLRRLCHLSLMEKDLGTTAHPRGFPELSHKSTAAASSRQSRPRVRSASLPPRTRLPSGSQAPSAAHPKRLSDLLLTSRAAAPGWRSPDPRSRLAAPPLGSTTLPSTWTAPQSRLTARPSRSPEPQIRESEQRDPQLRRKQQRWKEPLMPRREEKYPLRGTDPLPPGQPQRIPLPGQPLQPQPILTPGQPQKIPTPGQHQPILTPGHSQPIPTPGQPLPPQPIPTPGRPLTPQPIPTPGRPLTPQPIQMPGRPLRLPPPLRLLRPGQPMSPQLRQTQGLPLPQPLLPPGQPKSAGRPLQPLPPGPDARSISDPPAPRSRLPIRLLRGLLARLPGGASPRAAAAAACTTMKGWPAATMTPAETSPTMGPPDASAGFSIGEIAAAESPSATYSATFSCKPSGAASVDLRVPSPKPRALSRSRRYPWRRSADRCAKKPWRSGPRSAQRRNAVSSSTNNSRTKRWATCVRTACCF

SEQ ID NO: 6055 - protein, 245 aa, Homo Sapiens
MDRRSRAQQWRRARHNYNDLCPPIGRRAATALLWLSCSIALLRALATSNARAQQRAAAQQRRSFLNAHHRSGAQVFPESPESESDHEHEEADLELSLPECLEYEEEFDYETESETESEIESETDFETEPETAPTTEPETEPEDDRGPVVPKHSTFGQSLTQRLHALKLRSPDASPSRAPPSTQEPQSPREGEELKPEDKDPRDPEESKEPKEEKQRRRCKPKKPTRRDASPESPSKKGPIPIRRH

SEQ ID NO: 6056 - protein, 245 aa, Homo Sapiens; identical to SEQ ID NO: 6055

SEQ ID NO: 6057 - protein, 245 aa, Homo Sapiens; identical to SEQ ID NO: 6055

SEQ ID NO: 6058 - protein, 158 aa, Homo Sapiens
MGCLGNSKTEDQRNEEKAQREANKKIEKQLQEALNLFKSIWNNRWLRTISVILFLNKQDLLAEKVLAGKSKIEDYFPEFARYTTPEDATPEPGEDPRVTRAKYFIRDEFLRISTASGDGRHYCYPHFTCAVDTENIRRVFNDCRDIIQRMHLRQYELL

SEQ ID NO: 6059 - protein, 379 aa, Homo Sapiens
MGCLGNSKTEDQRNEEKAQREANKKIEKQLQKDKQVYRATHRLLLLGAGESGKSTIVKQMRILHVNGFNGDEKATKVQDIKNNLKEAIETIVAAMSNLVPPVELANPENQFRVDYILSVMNVPDFDFPPEFYEHAKALWEDEGVRACYERSNEYQLIDCAQYFLDKIDVIKQADYVPSDQDLLRCRVLTSGIFETKFQVDKVNFHMFDVGGQRDERRKWIQCFNDVTAIIFVVASSSYNMVIREDNQTNRLQEALNLFKSIWNNRWLRTISVILFLNKQDLLAEKVLAGKSKIEDYFPEFARYTTPEDATPEPGEDPRVTRAKYFIRDEFLRISTASGDGRHYCYPHFTCAVDTENIRRVFNDCRDIIQRMHLRQYELL

SEQ ID NO: 6060 - protein, 380 aa, Homo Sapiens
MGCLGNSKTEDQRNEEKAQREANKKIEKQLQKDKQVYRATHRLLLLGAGESGKSTIVKQMRILHVNGFNGDSEKATKVQDIKNNLKEAIETIVAAMSNLVPPVELANPENQFRVDYILSVMNVPDFDFPPEFYEHAKALWEDEGVRACYERSNEYQLIDCAQYFLDKIDVIKQADYVPSDQDLLRCRVLTSGIFETKFQVDKVNFHMFDVGGQRDERRKWIQCFNDVTAIIFVVASSSYNMVIREDNQTNRLQEALNLFKSIWNNRWLRTISVILFLNKQDLLAEKVLAGKSKIEDYFPEFARYTTPEDATPEPGEDPRVTRAKYFIRDEFLRISTASGDGRHYCYPHFTCAVDTENIRRVFNDCRDIIQRMHLRQYELL

SEQ ID NO: 6061 - protein, 394 aa, Homo Sapiens
MGCLGNSKTEDQRNEEKAQREANKKIEKQLQKDKQVYRATHRLLLLGAGESGKSTIVKQMRILHVNGFNGEGGEEDPQAARSNSDGEKATKVQDIKNNLKEAIETIVAAMSNLVPPVELANPENQFRVDYILSVMNVPDFDFPPEFYEHAKALWEDEGVRACYERSNEYQLIDCAQYFLDKIDVIKQADYVPSDQDLLRCRVLTSGIFETKFQVDKVNFHMFDVGGQRDERRKWIQCFNDVTAIIFVVASSSYNMVIREDNQTNRLQEALNLFKSIWNNRWLRTISVILFLNKQDLLAEKVLAGKSKIEDYFPEFARYTTPEDATPEPGEDPRVTRAKYFIRDEFLRISTASGDGRHYCYPHFTCAVDTENIRRVFNDCRDIIQRMHLRQYELL

SEQ ID NO: 6062 - protein, 87 aa, Homo Sapiens
MGCLGNSKTEDQRNEEKAQREANKKIEKQLQKDKQVYRATHRLLLLGAGESGKSTIVKQMRILHVNGFNGEGGEEDPQAARSNSDGI

SEQ ID NO: 6063 - protein, 395 aa, Homo Sapiens
MGCLGNSKTEDQRNEEKAQREANKKIEKQLQKDKQVYRATHRLLLLGAGESGKSTIVKQMRILHVNGFNGEGGEEDPQAARSNSDGSEKATKVQDIKNNLKEAIETIVAAMSNLVPPVELANPENQFRVDYILSVMNVPDFDFPPEFYEHAKALWEDEGVRACYERSNEYQLIDCAQYFLDKIDVIKQADYVPSDQDLLRCRVLTSGIFETKFQVDKVNFHMFDVGGQRDERRKWIQCFNDVTAIIFVVASSSYNMVIREDNQTNRLQEALNLFKSIWNNRWLRTISVILFLNKQDLLAEKVLAGKSKIEDYFPEFARYTTPEDATPEPGEDPRVTRAKYFIRDEFLRISTASGDGRHYCYPHFTCAVDTENIRRVFNDCRDIIQRMHLRQYELL

SEQ ID NO: 6064 - protein, 1023 aa, Homo Sapiens
MGVRNCLYGNNMSGQRDIPPEIGEQPEQPPLEAPGAAAPGAGPSPAEEMETEPPHNEPIPVENDGEACGPPEVSRPNFQVLNPAFREAGAHGSYSPPPEEAMPFEAEQPSLGGFWPTLEQPGFPSGVHAGLEAFGPALMEPGAFSGARPGLGGYSPPPEEAMPFEFDQPAQRGCSQLLLQVPDLAPGGPGAAGVPGAPPEEPQALRPAKAGSRGGYSPPPEETMPFELDGEGFGDDSPPPGLSRVIAQVDGSSQFAAVAASSAVRLTPAANAPPLWVPGAIGSPSQEAVRPPSNFTGSSPWMEISGPPFEIGSAPAGVDDTPVNMDSPPIALDGPPIKVSGAPDKRERAERPPVEEEAAEMEGAADAAEGGKVPSPGYGSPAAGAASADTAARAAPAAPADPDSGATPEDPDSGTAPADPDSGAFAADPDSGAAPAAPADPDSGAAPDAPADPDSGAAPDAPADPDAGAAPEAPAAPAAAETRAAHVAPAAPDAGAPTAPAASATRAAQVRRAASAAPASGARRKIHLRPPSPEIQAADPPTPRPTRASAWRGKSESSRGRRVYYDEGVASSDDDSSGDESDDGTSGCLRWFQHRRNRRRRKPQRNLLRNFLVQAFGGCFGRSESPQPKASRSLKVKKVPLAEKRRQMRKEALEKRAQKRAEKKRSKLIDKQLQDEKMGYMCTHRLLLLGAGESGKSTIVKQMRILHVNGFNGDSEKATKVQDIKNNLKEAIETIVAAMSNLVPPVELANPENQFRVDYILSVMNVPDFDFPPEFYEHAKALWEDEGVRACYERSNEYQLIDCAQYFLDKIDVIKQADYVPSDQDLLRCRVLTSGIFETKFQVDKVNFHMFDVGGQRDERRKWIQCFNDVTAIIFVVASSSYNMVIREDNQTNRLQEALNLFKSIWNNRWLRTISVILFLNKQDLLAEKVLAGKSKIEDYFPEFARYTTPEDATPEPGEDPRVTRAKYFIRDEFLRISTASGDGRHYCYPHFTCAVDTENIRRVFNDCRDIIQRMHLRQYELL

SEQ ID NO: 6065 - protein, 720 aa, Homo Sapiens [sequence omitted]

SEQ ID NO: 6066 - protein, 1037 aa, Homo Sapiens
MGVRNCLYGNNMSGQRDIPPEIGEQPEQPPLEAPGAAAPGAGPSPAEEMETEPPHNEPIPVENDGEACGPPEVSRPNFQVLNPAFREAGAHGSYSPPPEEAMPFEAEQPSLGGFWPTLEQPGFPSGVHAGLEAFGPALMEPGAFSGARPGLGGYSPPPEEAMPFEFDQPAQRGCSQLLLQVPDLAPGGPGAAGVPGAPPEEPQALRPAKAGSRGGYSPPPEETMPFELDGEGFGDDSPPPGLSRVIAQVDGSSQFAAVAASSAVRLTPAANAPPLWVPGAIGSPSQEAVRPPSNFTGSSPWMEISGPPFEIGSAPAGVDDTPVNMDSPPIALDGPPIKVSGAPDKRERAERPPVEEEAAEMEGAADAAEGGKVPSPGYGSPAAGAASADTAARAAPAAPADPDSGATPEDPDSGTAPADPDSGAFAADPDSGAAPAAPADPDSGAAPDAPADPDSGAAPDAPADPDAGAAPEAPAAPAAAETRAAHVAPAAPDAGAPTAPAASATRAAQVRRAASAAPASGARRKIHLRPPSPEIQAADPPTPRPTRASAWRGKSESSRGRRVYYDEGVASSDDDSSGDESDDGTSGCLRWFQHRRNRRRRKPQRNLLRNFLVQAFGGCFGRSESPQPKASRSLKVKKVPLAEKRRQMRKEALEKRAQKRAEKKRSKLIDKQLQDEKMGYMCTHRLLLLGAGESGKSTIVKQMRILHVNGFNGEGGEEDPQAARSNSDGEKATKVQDIKNNLKEAIETIVAAMSNLVPPVELANPENQFRVDYILSVMNVPDFDFPPEFYEHAKALWEDEGVRACYERSNEYQLIDCAQYFLDKIDVIKQADYVPSDQDLLRCRVLTSGIFETKFQVDKVNFHMFDVGGQRDERRKWIQCFNDVTAIIFVVASSSYNMVIREDNQTNRLQEALNLFKSIWNNRWLRTISVILFLNKQDLLAEKVLAGKSKIEDYFPEFARYTTPEDATPEPGEDPRVTRAKYFIRDEFLRISTASGDGRHYCYPHFTCAVDTENIRRVFNDCRDIIQRMHLRQYELL

SEQ ID NO: 6067 - protein, 120 aa, Homo Sapiens
MRILHVNGFNGEGGEEDPQAARSNSDGEKATKVQDIKNNLKEAIETIVAAMSNLVPPVELANPENQFRVDYILSVMNVPDFDFPPEFYEHAKALWEDEGVRACYERSNEYQLIDCAQYFL

SEQ ID NO: 6068 - protein, 160 aa, Homo Sapiens
MRILHVNGFNGEGGEEDPQAARSNSDGEKATKVQDIKNNLKEAIETIVAAMSNLVPPVELANPENQFRVDYILSVMNVPDFDFPPEFYEHAKALWEDEGVRACYERSNEYQLIDCAQYFLDKIDVIKQADYVPSDQDLLRCRVLTSGIFETKFQVDKVNF

SEQ ID NO: 6069 - protein, 166 aa, Homo Sapiens
PESESDHEHEEADLELSLPECLEYEEEFDYETESETESEIESETDFETEPETAPTTEPETEPEDDRGPVVPKHSTFGQSLTQRLHALKLRSPDASPSRAPPSTQEPQSPREGEELKPEDKDPRDPEESKEPKEEKQRRRCKPKKPTRRDASPESPSKKGPIPIRRH

SEQ ID NO: 6070 - protein, 193 aa, Homo Sapiens
PKASRSLKVKKVPLAEKRRQMRKEALEKRAQKRAEKKRSKLIDKQLQDEKMGYMCTHRLLLLGAGESGKSTIVKQMRILHVNGFNGEGGEEDPQAARSNSDGSEKATKVQDIKNNLKEAIETIVAAMSNLVPPVELANPENQFRVDYILSVMNVPDFDFPPEFYEHAKALWEDEGVRACYERSNEYQLIDCAQ

SEQ ID NO: 6071 - protein, 61 aa, Homo Sapiens
QRNEEKAQREANKKIEKQLQKDKQVYRATHRLLLLGAGESGKSTIVKQMRILHVNGFNGEI

SEQ ID NO: 6072 - protein, 199 aa, Homo Sapiens
  misc_feature (1)..(1): Xaa can be any naturally occurring amino acid
XAFGGCFGRSESPQPKASRSLKVKKVPLAEKRRQMRKEALEKRAQKRAEKKRSKLIDKQLQDEKMGYMCTHRLLLLGAGESGKSTIVKQMRILHVNGFNGDEKATKVQDIKNNLKEAIETIVAAMSNLVPPVELANPENQFRVDYILSVMNVPDFDFPPEFYEHAKALWEDEGVRACYERSNEYQLIDCAQYFLDKIDV

SEQ ID NO: 6073 - protein, 184 aa, Homo Sapiens
  misc_feature (1)..(1): Xaa can be any naturally occurring amino acid
XGRRVYYDEGVASSDDDSSGDESDDGTSGCLRWFQHRRNRRRRKPQRNLLRNFLVQAFGGCFGRSESPQPKASRSLKVKKVPLAEKRRQMRKEALEKRAQKRAEKKRSKLIDKQLQDEKMGYMCTHRLLLLGRKVVPSDTEGRFRLDRPAPATVSWTGRGFSVSSLLIRSPNPPAFTVEKPDTQ

SEQ ID NO: 6074 - protein, 113 aa, Homo Sapiens
  misc_feature (1)..(1): Xaa can be any naturally occurring amino acid
XTTEPETEPEDDRGPVVPKHSTFGQSLTQRLHALKLRSPDASPSRAPPSTQEPQSPREGEELKPEDKDPRDPEESKEPKEEKQRRRCKPKKPTRRDASPESPSKKGPIPIRRH

SEQ ID NO: 6075 - protein, 93 aa, Homo Sapiens
  misc_feature (1)..(1): Xaa can be any naturally occurring amino acid
XVPLAEKRRQMRKEALEKRAQKRAEKKRSKLIDKQLQDEKMGYMCTHRLLLLGAGESGKSTIVKQMRILHVNGFNGEGGEEDPQAARSNSDGI

SEQ ID NO: 6076 - protein, 172 aa, Homo Sapiens
MATWALLLLAAMLLGNPGLEVSVSPKGKNTSGRESGFGWAIWMEGLVFSRLSPEYYDLARAHLRDEEKSCPCLAQEGPQGDLLTKTQELGRDYRTCLTIVQKLKKMVDKPTQRSVSNAATRVCRTGRSRWRDVCRNFMRRYQSRVTQGLVAGETAQQICEDLRLCIPSTGPL

SEQ ID NO: 6077 - protein, 145 aa, Homo Sapiens
MATWALLLLAAMLLGNPGLVFSRLSPEYYDLARAHLRDEEKSCPCLAQEGPQGDLLTKTQELGRDYRTCLTIVQKLKKMVDKPTQRSVSNAATRVCRTGRSRWRDVCRNFMRRYQSRVTQGLVAGETAQQICEDLRLCIPSTGPL

SEQ ID NO: 6078 - protein, 130 aa, Homo Sapiens
MEGLVFSRLSPEYYDLARAHLRDEEKSCPCLAQEGPQGDLLTKTQELGRDYRTCLTIVQKLKKMVDKPTQRSVSNAATRVCRTGRSRWRDVCRNFMRRYQSRVTQGLVAGETAQQICEDLRLCIPSTGPL

SEQ ID NO: 6079 - protein, 187 aa, Homo Sapiens
  misc_feature (1)..(1): Xaa can be any naturally occurring amino acid
XHLRDEEKSCPCLAQEGPQGDLLTKTQELGRDYRTCLTIVQKLKKMVDKPTQRSVSNAATRVCRTGRSRWRDVCRNFMRRYQSRVTQGLVAGETAQQICEDLRLCIPSTGPTTCSGCRLASRMCLWVPSEPSHLVLWKKHRLLSSDPGNLSNLCRLLASSIQNPLSSLPPLTPSAVLPSHENKVSSK

SEQ ID NO: 6080 - protein, 76 aa, Homo Sapiens
MAAGLARLLLLLGLSAGGPAPAGAAKMKVVEEPNAFGVNNPFLPQASRLQAKRDPSPVSETGFHRVSQDGLDLLTS

SEQ ID NO: 6081 - protein, 76 aa, Homo Sapiens; identical to SEQ ID NO: 6080

SEQ ID NO: 6082 - protein, 61 aa, Homo Sapiens
MAAGLARLLLLLGLSAGGPAPAGAAKMKVVEEPNAFGVNNPFLPQASRLQAKRDPSPVSGE

SEQ ID NO: 6083 - protein, 305 aa, Homo Sapiens
MAAGLARLLLLLGLSAGGPAPAGAAKMKVVEEPNAFGVNNPFLPQASRLQAKRDPSPVSGPVHLFRLSGKCFSLVESTYKYEFCPFHNVTQHEQTFRWNAYSGILGIWHEWEIANNTFTGMWMRDGDACRSRSRQSKVELACGKSNRLAHVSEPSTCVYALTFETPLVCHPHALLVYPTLPEALQRQWDQVEQDLADELITPQGHEKLLRTLFEDAGYLKTPEENEPTQLEGGPDSLGFETLENCRKAHKELSKEIKRLKGLLTQHGIPYTRPTETSNLEHLGHETPRAKSPEQLRGDPGLRGSL

SEQ ID NO: 6084 - protein, 185 aa, Homo Sapiens
  misc_feature (1)..(1): Xaa can be any naturally occurring amino acid
XRLLLLLGLSAGGEWPGRPRPQAPRALCTPASPLTVSLPVGPAPAGAAKMKVVEEPNAFGVNNPFLPQASRLQAKRDPSPVSGPVHLFRLSGKCFSLVESTYKYEFCPFHNVTQHEQTFRWNAYSGILGIWHEWEIANNTFTGMWMRDGDACRSRSRQSKVELACGKSNRLAHVSEPSTCVYALT

SEQ ID NO: 6085 - protein, 92 aa, Homo Sapiens
MKPIQKLLAGLILLTWCVEGCSSQHWSYGLRPGGKRDAENLIDSFQEIVKEVGQLAETQRFECTTHQPRSPLRDLKGALESLIEEETGQKKI

SEQ ID NO: 6086 - protein, 92 aa, Homo Sapiens; identical to SEQ ID NO: 6085

SEQ ID NO: 6087 - protein, 113 aa, Homo Sapiens
MASSRRGLLLLLLLTAHLGPSEAQHWSHGWYPGGKRALSSAQDPQNALRPPAGSPVQTAHGLPSDALAPLDDSMPWEGRTTAQWSLHRKRHLARTLLTAAREPRPAPPSSNKV

SEQ ID NO: 6088 - protein, 113 aa, Homo Sapiens; identical to SEQ ID NO: 6087

SEQ ID NO: 6089 - protein, 120 aa, Homo Sapiens
MASSRRGLLLLLLLTAHLGPSEAQHWSHGWYPGGKRALSSAQDPQNALRPPGRALDTAAGSPVQTAHGLPSDALAPLDDSMPWEGRTTAQWSLHRKRHLARTLLTAAREPRPAPPSSNKV

SEQ ID NO: 6090 - protein, 112 aa, Homo Sapiens
MASSRRGLLLLLLLTAHLGPSEAQHWSHGWYPGGKRALSSAQDPQNALRPPGSPVQTAHGLPSDALAPLDDSMPWEGRTTAQWSLHRKRHLARTLLTAAREPRPAPPSSNKV

SEQ ID NO: 6091 - protein, 496 aa, Homo Sapiens
MDNYLLLQTPLKKTKALIGEMGMTFSSAYVPSALCCPSRASILTGKYPHNHHVVNNTLEGNCSSKSWQKIQEPNTFPAILRSMCGYQTFFAGKYLNEYGAPDAGGLEHVPLGWSYWYALEKNSKYYNYTLSINGKARKHGENYSVDYLTDVLANVSLDFLDYKSNFEPFFMMIATPAPHSPWTAAPQYQKAFQNVFAPRNKNFNIHGTNKHWLIRQAKTPMTNSSIQFLDNAFRKRWQTLLSVDDLVEKLVKRLEFTGELNNTYIFYTSDNGYHTGQFSLPIDKRQLYEFDIKVPLLVRGPGIKPNQTSKMLVANIDLGPTILDIAGYDLNKTQMDGMSLLPILRGASNLTWRSDVLVEYQGEGRNVTDPTCPSLSPGVSQCFPDCVCEDAYNNTYACVRTMSALWNLQYCEFDDQEVFVEVYNLTADPDQITNIAKTIDPELLGKMNYRLMMLQSCSGPTCRTPGVFDPGYRFDPRLMFSNRGSVRTRRFSKHLL

SEQ ID NO: 6092 - protein, 248 aa, Homo Sapiens
MGMTFSSAYVPSALCCPSRASILTGKYPHNHHVVNNTLEGNCSSKSWQKIQEPNTFPAILRSMCGYQTFFAGKYLNEYGAPDAGGLEHVPLGWSYWYALEKNSKYYNYTLSINGKARKHGENYSVDYLTDVLANVSLDFLDYKSNFEPFFMMIATPAPHSPWTAAPQYQKAFQNVFAPRNKNFNIHGTNKHWLIRQAKTPMTNSSIQFLDNAFRKRWQTLLSVDDLVEKLVKRLEFTGELNNTYIFYT

SEQ ID NO: 6093 - protein, 584 aa, Homo Sapiens
MRLLPLAPGRLRRGSPRHLPSCSPALLLLVLGGCLGVFGVAAGTRRPNVVLLLTDDQDEVLGGMAFSEYSTTNCQTGLQGEELGQEHLRTYLEPSRTPLKKTKALIGEMGMTFSSAYVPSALCCPSRASILTGKYPHNHHVVNNTLEGNCSSKSWQKIQEPNTFPAILRSMCGYQTFFAGKYLNEYGAPDAGGLEHVPLGWSYWYALEKNSKYYNYTLSINGKARKHGENYSVDYLTDVLANVSLDFLDYKSNFEPFFMMIATPAPHSPWTAAPQYQKAFQNVFAPRNKNFNIHGTNKHWLIRQAKTPMTNSSIQFLDNAFRKRWQTLLSVDDLVEKLVKRLEFTGELNNTYIFYTSDNGYHTGQFSLPIDKRQLYEFDIKVPLLVRGPGIKPNQTSKMLVANIDLGPTILDIAGYDLNKTQMDGMSLLPILRGASNLTWRSDVLVEYQGEGRNVTDPTCPSLSPGVSQCFPDCVCEDAYNNTYACVRTMSALWNLQYCEFDDQEVFVEVYNLTADPDQITNIAKTIDPELLGKMNYRLMMLQSCSGPTCRTPGVFDPGYRFDPRLMFSNRGSVRTRRFSKHLL

SEQ ID NO: 6094 - protein, 552 aa, Homo Sapiens
MRLLPLAPGRLRRGSPRHLPSCSPALLLLVLGGCLGVFGVAAGTRRPNVVLLLTDDQDEVLGGMTPLKKTKALIGEMGMTFSSAYVPSALCCPSRASILTGKYPHNHHVVNNTLEGNCSSKSWQKIQEPNTFPAILRSMCGYQTFFAGKYLNEYGAPDAGGLEHVPLGWSYWYALEKNSKYYNYTLSINGKARKHGENYSVDYLTDVLANVSLDFLDYKSNFEPFFMMIATPAPHSPWTAAPQYQKAFQNVFAPRNKNFNIHGTNKHWLIRQAKTPMTNSSIQFLDNAFRKRWQTLLSVDDLVEKLVKRLEFTGELNNTYIFYTSDNGYHTGQFSLPIDKRQLYEFDIKVPLLVRGPGIKPNQTSKMLVANIDLGPTILDIAGYDLNKTQMDGMSLLPILRGASNLTWRSDVLVEYQGEGRNVTDPTCPSLSPGVSQCFPDCVCEDAYNNTYACVRTMSALWNLQYCEFDDQEVFVEVYNLTADPDQITNIAKTIDPELLGKMNYRLMMLQSCSGPTCRTPGVFDPGYRFDPRLMFSNRGSVRTRRFSKHLL

SEQ ID NO: 6095 - protein, 532 aa, Homo Sapiens
MRLLPLAPGRLRRGSPRHLPSCSPALLLLVLGGCLGVFGVAAGTRRPNVVLLLTDDQDEVLGGMYVPSALCCPSRASILTGKYPHNHHVVNNTLEGNCSSKSWQKIQEPNTFPAILRSMCGYQTFFAGKYLNEYGAPDAGGLEHVPLGWSYWYALEKNSKYYNYTLSINGKARKHGENYSVDYLTDVLANVSLDFLDYKSNFEPFFMMIATPAPHSPWTAAPQYQKAFQNVFAPRNKNFNIHGTNKHWLIRQAKTPMTNSSIQFLDNAFRKRWQTLLSVDDLVEKLVKRLEFTGELNNTYIFYTSDNGYHTGQFSLPIDKRQLYEFDIKVPLLVRGPGIKPNQTSKMLVANIDLGPTILDIAGYDLNKTQMDGMSLLPILRGASNLTWRSDVLVEYQGEGRNVTDPTCPSLSPGVSQCFPDCVCEDAYNNTYACVRTMSALWNLQYCEFDDQEVFVEVYNLTADPDQITNIAKTIDPELLGKMNYRLMMLQSCSGPTCRTPGVFDPGYRFDPRLMFSNRGSVRTRRFSKHLL

SEQ ID NO: 6096 - protein, 303 aa, Homo Sapiens
  misc_feature (1)..(1): Xaa can be any naturally occurring amino acid
XYNYTLSINGKARKHGENYSVDYLTDVLANVSLDFLDYKSNFEPFFMMIATPAPHSPWTAAPQYQKAFQNVFAPRNKNFNIHGTNKHWLIRQAKTPMTNSSIQFLDNAFRKRWQTLLSVDDLVEKLVKRLEFTGELNNTYIFYTSDNGYHTGQFSLPIDKRQLYEFDIKVPLLVRGPGIKPNQTSKRGASNLTWRSDVLVEYQGEGRNVTDPTCPSLSPGVSQCFPDCVCEDAYNNTYACVRTMSALWNLQYCEFDDQEVFVEVYNLTADPDQITNIAKTIDPELLGKMNYRLMMLQSCSGPT

SEQ ID NO: 6097 - protein, 80 aa, Homo Sapiens
MMGLGNGRRSMKSPPLVLAALVACIIVLGFNYWIASSRSVDLQTRIMELEGRVRRAAAERGAVELKKNEFQGELEKQREQ

SEQ ID NO: 6098 - protein, 121 aa, Homo Sapiens
MMGLGNGRRSMKSPPLVLAALVACIIVLGFNYWIASSRSVDLQTRIMELEGRVRRAAAERGAVELKKNEFQGELEKQREQLDKIQSSHNFQLESVNKLYQDEKAVLVNNITTGERLIRVLQ

SEQ ID NO: 6099 - protein, 401 aa, Homo Sapiens
MMGLGNGRRSMKSPPLVLAALVACIIVLGFNYWIASSRSVDLQTRIMELEGRVRRAAAERGAVELKKNEFQGELEKQREQLDKIQSSHNFQLESVNKLYQDEKAVLVNNITTGERLIRVLQDQLKTLQRNYGRLQQDVLQFQKNQTNLERKFSYDLSQCINQMKEVKEQCEERIEEVTKKGNEAVASRDLSENNDQRQQLQALSEPQPRLQAAGLPHTEVPQGKGNVLGNSKSQTPAPSSEVVLDSKRQVEKEETNEIQVVNEEPQRDRLPQEPGREQVVEDRPVGGRGFGGAGELGQTPQVQAALSVSQENPEMEGPERDQLVIPDGQEEEQEAAGEGRNQQKLRGEDDYNMDENEAESETDKQAALAGNDRNIDVFNVEDQKRDTINLLDQREKRNHTL

SEQ ID NO: 6100 - protein, 401 aa, Homo Sapiens; identical to SEQ ID NO: 6099

SEQ ID NO: 6101 - protein, 105 aa, Homo Sapiens
MMGLGNGRRSMKSPPLVLAALVACIIVLGFNYWIASSRSVDLQTRIMELEGRVRRAAAERGAVELKKNEFQGELEKQREQLDKIQSSHNFQLESVNKLYQDEKTS

SEQ ID NO: 6102 - protein, 246 aa, Homo Sapiens
MSWAAVLAVAAARFGHFWGCRWPGPMAQGWAGFSEEELRRLKQTKDPFEPQRRLPAKKSRQQLQREKALVEQSQKLGLQDGSTSLLPEQLLSAPKQRVNVQKPPFSSPTLPSHFTLTSPVGDGQPQGIESQPKELGLENSHDGHNNVEILPPKPDCKLEKKKVELQEKSRWEVLQQEQRLMEEKNKRKKALLAKAIAERSKRTQAETMKLKRIQKELQALDDMVSADIGILRNRIDQASLDYSYAR

SEQ ID NO: 6103 - protein, 394 aa, Homo Sapiens
MSWAAVLAVAAARFGHFWGCRWPGPMAQGWAGFSEEELRRLKQTKDPFEPQRRLPAKKSRQQLQREKALVEQSQKLGLQDGSTSLLPEQLLSAPKQRVNVQKPPFSSPTLPSHFTLTSPVGDGQPQGIESQPKELGLENSHDGHNNVEILPPKPDCKLEKKKVELQEKSRWEVLQQEQRLMEEKNKRKKALLAKAIAERSKRTQAETMKLKRIQKELQALDDMVSADIGILRNRIDQASLDYSYARKRFDRAEAEYIAAKLDIQRKTEIKEQLTEHLCTIIQQNELRKAKKLEELMQQLDVEADEETLELEVEVERLLHEQEVESRRPVVRLERPFQPAEESVTLEFAKENRKCQEQAVSPKVDDQCGNSSSIPFLSPNCPNQEGNDISAALAT

SEQ ID NO: 6104 - protein, 126 aa, Homo Sapiens
  misc_feature (1)..(1): Xaa can be any naturally occurring amino acid
XSWAAVLAVAAARFGHFWGCRWPGPMAQGWAGFSEEELRRLKQTKGYKCPGLWSDSSRLMRRQTTKLCDSRYCKNLLQRQEEPHSAGDWMELGKISQSLCVSRGAFSRTKEKSTKDMNRYFLEKEI

SEQ ID NO: 6105 - protein, 59 aa, Homo Sapiens
MALLHSGRVLPGIAAAFHPGLAAAASARARQRPRLPQKIWTRNTCPLGDWLNFARHLQN

SEQ ID NO: 6106 - protein, 430 aa, Homo Sapiens
MALLHSGRVLPGIAAAFHPGLAAAASARASSWWTHVEMGPPDPILGVTEAFKRDTNSKKMNLGVGAYRDDNGKPYVLPSVRKAEAQIAAKNLDKEYLPIGGLAEFCKASAELALGENSEVLKSGRFVTVQTISGTGALRIGASFLQRFFKFSRDVFLPKPTWGNHTPIFRDAGMQLQGYRYYDPKTCGFDFTGAVEDISKIPEQSVLLLHACAHNPTGVDPRPEQWKEIATVVKKRNLFAFFDMAYQGFASGDGDKDAWAVRHFIEQGINVCLCQSYAKNMGLYGERVGAFTMVCKDADEAKRVESQLKILIRPMYSNPPLNGARIAAAILNTPDLRKQWLQEVKVMADRIIGMRTQLVSNLKKEGSTHNWQHITDQIGMFCFTGLKPEQVERLIKEFSIYMTKDGRISVAGVTSSNVGYLAHAIHQVTK

SEQ ID NO: 6107 - protein, 387 aa, Homo Sapiens
MALLHSGRVLPGIAAAFHPGLAAAASARASSWWTHVEMGPPDPILGVTEAFKRDTNSKKMNLGVGAYRDDNGKPYVLPSVRKFVTVQTISGTGALRIGASFLQRFFKFSRDVFLPKPTWGNHTPIFRDAGMQLQGYRYYDPKTCGFDFTGAVEDISKIPEQSVLLLHACAHNPTGVDPRPEQWKEIATVVKKRNLFAFFDMAYQGFASGDGDKDAWAVRHFIEQGINVCLCQSYAKNMGLYGERVGAFTMVCKDADEAKRVESQLKILIRPMYSNPPLNGARIAAAILNTPDLRKQWLQEVKVMADRIIGMRTQLVSNLKKEGSTHNWQHITDQIGMFCFTGLKPEQVERLIKEFSIYMTKDGRISVAGVTSSNVGYLAHAIHQVTK

SEQ ID NO: 6108 - protein, 145 aa, Homo Sapiens
MPHLMERMVGSGLLWLALVSCILTQASAVQRDPSTVEDKCEKACRPEEECLALNSTWGCFCRQDLNSSDVHSLQPQLDCGPREIKVKVDKCLLGGLGLGEEVIAYLRDPNCSSILQTEERNWVSVTSPVQASACRNILERNQTHA

SEQ ID NO: 6109 - protein, 387 aa, Homo Sapiens
MPHLMERMVGSGLLWLALVSCILTQASAVQRDPSTVEDKCEKACRPEEECLALNSTWGCFCRQDLNSSDVHSLQPQLDCGPREIKVKVDKCLLGGLGLGEEVIAYLRDPNCSSILQTEERNWVSVTSPVQASACRNILERNQTHAIYKNTLSLVNDFIIRDTILNINFQCAYPLDMKVSLQAALQPIVSSLNVSVDGNGEFIVRMALFQDQNYTNPYEGDAVELSVESVLYVGAILEQGDTSRFNLVLRNCYATPTEDKADLVKYFIIRNSCSNQRDSTIHVEENGQSSESRFSVQMFMFAGHYDLVFLHCEIHLCDSLNEQCQPSCSRSQVRSEVPAIDLARVLDLGPITRRGAQSPGVMNGTPSTAGFLVAWPMVLLTVLLAWLF

SEQ ID NO: 6110 - protein, 163 aa, Homo Sapiens
MPHLMERMVGSGLLWLALVSCILTQASAVQRGEGGVRMSETCVQVHRCQTDAPMWLNGTHPALGDGITNHTACAHWSGNCCFWKTEVLVKACPGGYHVYRLEGTPWCNLRYCTDPSTVEDKCEKACRPEEECLALNSTWGCFCRQDLNSSDVHSLQPQLDCGP

SEQ ID NO: 6111 - protein, 128 aa, Homo Sapiens
MPHLMERMVGSGLLWLALVSCILTQASAVQRGYGNPIEASSYGLDLDCGAPGTPEAHVCFDPCQNYTLLDEPFRSTENSAGSQGCDKNMSGWYRFVGEGGVRMSETCVQVHRCQTDAPMWLNGTHPAL

SEQ ID NO: 6112 - protein, 534 aa, Homo Sapiens
MPHLMERMVGSGLLWLALVSCILTQASAVQRGYGNPIEASSYGLDLDCGAPGTPEAHVCFDPCQNYTLLDEPFRSTENSAGSQGCDKNMSGWYRFVGEGGVRMSETCVQVHRCQTDAPMWLNGTHPALGDGITNHTACAHWSGNCCFWKTEVLVKACPGGYHVYRLEGTPWCNLRYCTDPSTVEDKCEKACRPEEECLALNSTWGCFCRQDLNSSDVHSLQPQLDCGPREIKVKVDKCLLGGLGLGEEVIAYLRDPNCSSILQTEERNWVSVTSPVQASACRNILERNQTHAIYKNTLSLVNDFIIRDTILNINFQCAYPLDMKVSLQAALQPIVSSLNVSVDGNGEFIVRMALFQDQNYTNPYEGDAVELSVESVLYVGAILEQGDTSRFNLVLRNCYATPTEDKADLVKYFIIRNSCSNQRDSTIHVEENGQSSESRFSVQMFMFAGHYDLVFLHCEIHLCDSLNEQCQPSCSRSQVRSEVPAIDLARVLDLGPITRRGAQSPGVMNGTPSTAGFLVAWPMVLLTVLLAWLF

SEQ ID NO: 6113 - protein, 537 aa, Homo Sapiens
MPHLMERMVGSGLLWLALVSCILTQASAVQRGYGNPIEASSYGLDLDCGAPGTPEAHVCFDPCQNYTLLDEPFRSTENSAGSQGCDKNMSGWYRFVGEGGVRMSETCVQVHRCQTDAPMWLNGTHPALGDGITNHTACAHWSGNCCFWKTEVLVKACPGGYHVYRLEGTPWCNLRYCTVPRDPSTVEDKCEKACRPEEECLALNSTWGCFCRQDLNSSDVHSLQPQLDCGPREIKVKVDKCLLGGLGLGEEVIAYLRDPNCSSILQTEERNWVSVTSPVQASACRNILERNQTHAIYKNTLSLVNDFIIRDTILNINFQCAYPLDMKVSLQAALQPIVSSLNVSVDGNGEFIVRMALFQDQNYTNPYEGDAVELSVESVLYVGAILEQGDTSRFNLVLRNCYATPTEDKADLVKYFIIRNSCSNQRDSTIHVEENGQSSESRFSVQMFMFAGHYDLVFLHCEIHLCDSLNEQCQPSCSRSQVRSEVPAIDLARVLDLGPITRRGAQSPGVMNGTPSTAGFLVAWPMVLLTVLLAWLF

SEQ ID NO: 6114 - protein, 390 aa, Homo Sapiens
MPHLMERMVGSGLLWLALVSCILTQASAVQRVPRDPSTVEDKCEKACRPEEECLALNSTWGCFCRQDLNSSDVHSLQPQLDCGPREIKVKVDKCLLGGLGLGEEVIAYLRDPNCSSILQTEERNWVSVTSPVQASACRNILERNQTHAIYKNTLSLVNDFIIRDTILNINFQCAYPLDMKVSLQAALQPIVSSLNVSVDGNGEFIVRMALFQDQNYTNPYEGDAVELSVESVLYVGAILEQGDTSRFNLVLRNCYATPTEDKADLVKYFIIRNSCSNQRDSTIHVEENGQSSESRFSVQMFMFAGHYDLVFLHCEIHLCDSLNEQCQPSCSRSQVRSEVPAIDLARVLDLGPITRRGAQSPGVMNGTPSTAGFLVAWPMVLLTVLLAWLF

SEQ ID NO: 6115 - protein, 141 aa, Homo Sapiens
MSGWYRFVGEGGVRMSETCVQVHRCQTDAPMWLNGTHPALGDGITNHTACAHWSGNCCFWKTEVLVKACPGGYHVYRLEGTPWCNLRYCTDPSTVEDKCEKACRPEEECLALNSTWGCFCRQDLNSSDVHSLQPQLDCGPR

SEQ ID NO: 6116 - protein, 42 aa, Homo Sapiens
  misc_feature (1)..(1): Xaa can be any naturally occurring amino acid
XERMVGSGLLWLALVSCILTQASAVQRGKYSAHLASQMSRKT

SEQ ID NO: 6117 - protein, 117 aa, Homo Sapiens
MKRSLAGRYRCSYQNGSLWSLPSDQLELVATGVFAKPSLSAQPGPAVSSGGDVTLQCQTRYGFDQFALYKEGDPAPYKNPERWYRASFPIITVTAAHSGTYRCYSFSSRDPYLWSAP

SEQ ID NO: 6118 - protein, 321 aa, Homo Sapiens
MSPSPTALFCLGLCLGRVPAQSGPLPKPSLQALPSSLVPLEKPVTLRCQGPPGVDLYRLEKLSSSRYQDQAVLFIPAMKRSLAGRYRCSYQNGSLWSLPSDQLELVATGVFAKPSLSAQPGPAVSSGGDVTLQCQTRYGFDQFALYKEGDPAPYKNPERWYRASFPIITVTAAHSGTYRCYSFSSRDPYLWSAPSDPLELVVTEFSEATAELTVSFTNEVFTTETSRSITASPKESDSPAGPARQYYTKGNLVRICLGAVILIILAGFLAEDWHSRRKRLRHRGRAVQRPLPPLPPLPLTRKSNGGQDGGRQDVHSRGLCS

SEQ ID NO: 6119 - protein, 620 aa, Homo Sapiens
MSPSPTALFCLGLCLGRVPAQSGPLPKPSLQALPSSLVPLEKPVTLRCQGPPGVDLYRLEKLSSSRYQDQAVLFIPAMKRSLAGRYRCSYQNGSLWSLPSDQLELVATGVFAKPSLSAQPGPAVSSGGDVTLQCQTRYGFDQFALYKEGDPAPYKNPERWYRASFPIITVTAAHSGTYRCYSFSSRDPYLWSAPSDPLELVVTGTSVTPSRLPTEPPSPVAEFSEATAELTVSFTNEVFTTETSRSITASPKESDSPAGESCPPVLHQGQPGPDMPRGCDPNNPGGVSGRGLAQPEEAPAAQGQGCAEAASAPPAPPADPEIKRGSGWRPTGCSQPRVMFMTAEPQARSYPREGSWHGRRLKDWRVWSVEAGGQRLQLWKRGHAASSWCSIREPFGQCLSVCLPLCLRAPSIWDGRNLWRPHPPPCTLWMTWYPGWTTYWPLSSTSLIWAPDGSLRFPALRVDSVPSSVQNPPVLPFGPLCSCLVFPRNSHPHSISHCGLTNLLSSLRTGLAGSLGMSFIFLSVKLARCPLPFTLENKISLCNMVKPHLYQQNKKTQKLARCGGASLYSQQLRGLRWENGLSLGGRGCSELRSHHCTLARVTKPDFVSKNTGMNMSITLI

SEQ ID NO: 6120 - protein, 339 aa, Homo Sapiens
MSPSPTALFCLGLCLGRVPAQSGPLPKPSLQALPSSLVPLEKPVTLRCQGPPGVDLYRLEKLSSSRYQDQAVLFIPAMKRSLAGRYRCSYQNGSLWSLPSDQLELVATGVFAKPSLSAQPGPAVSSGGDVTLQCQTRYGFDQFALYKEGDPAPYKNPERWYRASFPIITVTAAHSGTYRCYSFSSRDPYLWSAPSDPLELVVTGTSVTPSRLPTEPPSPVAEFSEATAELTVSFTNEVFTTETSRSITASPKESDSPAGPARQYYTKGNLVRICLGAVILIILAGFLAEDWHSRRKRLRHRGRAVQRPLPPLPPLPLTRKSNGGQDGGRQDVHSRGLCS

SEQ ID NO: 6121 - protein, 134 aa, Homo Sapiens
MSALRPLLLLLLPLCPGPGPGPGSEAKVTRSCAETRQVLGARGYSLNLIPPALISGEHLRVCPQEYTCCSSETEQRLIRETEATFRGLVEDSGSFLVHTLAARHRKFDDNPDPGGCPSLCAGPGDWKKCGQRSA

SEQ ID NO: 6122 - protein, 579 aa, Homo Sapiens
MSALRPLLLLLLPLCPGPGPGPGSEAKVTRSCAETRQVLGARGYSLNLIPPALISGEHLRVCPQEYTCCSSETEQRLIRETEATFRGLVEDSGSFLVHTLAARHRKFDEFFLEMLSVAQHSLTQLFSHSYGRLYAQHALIFNGLFSRLRDFYGESGEGLDDTLADFWAQLLERVFPLLHPQYSFPPDYLLCLSRLASSTDGSLQPFGDSPRRLRLQITRTLVAARAFVQGLETGRNVVSEALKVPVSEGCSQALMRLIGCPLCRGVPSLMPCQGFCLNVVRGCLSSRGLEPDWGNYLDGLLILADKLQGPFSFELTAESIGVKISEGLMYLQENSAKVSAQVFQECGPPDPVPARNRRAPPPREEAGRLWSMVTEEERPTTAAGTNLHRLVWELRERLARMRGFWARLSLTVCGDSRMAADASLEAAPCWTGAGRGRYLPPVVGGSPAEQVNNPELKVDASGPDVPTRRRRLQLRAATARMKTAALGHDLDGQDADEDASGSGGGQQYADDWMAGAVAPPARPPRPPYPPRRDGSGGKGGGGSARYNQGRSRSGGASIGFHTQTILILSLSALALLGPR

SEQ ID NO: 6123 - protein, 320 aa, Homo Sapiens [sequence omitted]

SEQ ID NO: 6124 - protein, 572 aa, Homo Sapiens
MDAQTWPVGFRCLLLLALVGSARSEGVQTCEEVRKLFQWRLLGAVRGLPDSPRAGPDLQVCISKKPTCCTRKMEERYQIAARQDMQQFLQTSSSTLKFLISRNAAAFQETLETLIKQAENYTSILFCSTYRNMALEAAASVQEFFTDVGLYLFGADVNPEEFVNRFFDSLFPLVYNHLINPGVTDSSLEYSECIRMARRDVSPFGNIPQRVMGQMGRSLLPSRTFLQALNLGIEVINTTDYLHFSKECSRALLKMQYCPHCQGLALTKPCMGYCLNVMRGCLAHMAELNPHWHAYIRSLEELSDAMHGTYDIGHVLLNFHLLVNDAVLQAHLNGQKLLEQVNRICGRPVRTPTQSPRCSFDQSKEKHGMKTTTRNSEETLANRRKEFINSLRLYRSFYGGLADQLCANELAAADGLPCWNGEDIVKSYTQRVVGNGIKAQSGNPEVKVKGIDPVINQIIDKLKHVVQLLQGRSPKPDKWELLQLGSGGGMVEQVSGDCDDEDGCGGSGSGEVKRTLKITDWMPDDMNFSDVKQIHQTDTGSTLDTTGAGCAVATESMTFTLISVVMLLPGIW

SEQ ID NO: 6125 - protein, 51 aa, Homo Sapiens
  misc_feature (1)..(1): Xaa can be any naturally occurring amino acid
XMPDDMNFSDVKQIHQTDTGSTLDTTGAGCAVATESMTFTLISVVMLLPGI

SEQ ID NO: 6126 - protein, 263 aa, Homo Sapiens
DAMLLVAERLEGPFNIESVMDPIDVKISEAIMNMQENSMQVSAKVFQGCGQPKPAPALRSARSAPENFNTRFRPYNPEERPTTAAGTSLDRLVTDIKEKLKLSKKVWSALPYTICKDESVTAGTSNEEECWNGHSKARYLPEIMNDGLTNQINNPEVDVDITRPDTFIRQQIMALRVMTNKLKNAYNGNDVNFQDTSDESSGSGSGSGCMDDVCPTEFEFVTTEAPAVDPDRREVDSSAAQRGHSLLSWSLTCIVLALQRLCR

SEQ ID NO: 6127 - protein, 555 aa, Homo Sapiens
MPSWIGAVILPLLGLLLSLPAGADVKARSCGEVRQAYGAKGFSLADIPYQEIAGEHLRICPQEYTCCTTEMEDKLSQQSKLEFENLVEETSHFVRTTFVSRHKKFDEFFRELLENAEKSLNDMFVRTYGMLYMQNSEVFQDLFTELKRYYTGGNVNLEEMLNDFWARLLERMFQLINPQYHFSEDYLECVSKYTDQLKPFGDVPRKLKIQVTRAFIAARTFVQGLTVGREVANRVSKVSPTPGCIRALMKMLYCPYCRGLPTVRPCNNYCLNVMKGCLANQADLDTEWNLFIDAMLLVAERLEGPFNIESVMDPIDVKISEAIMNMQENSMQVSAKVFQGCGQPKPAPALRSARSAPENFNTRFRPYNPEERPTTAAGTSLDRLVTDIKEKLKLSKKVWSALPYTICKDESVTAGTSNEEECWNGHSKARYLPEIMNDGLTNQINNPEVDVDITRPDTFIRQQIMALRVMTNKLKNAYNGNDVNFQDTSDESSGSGSGSGCMDDVCPTEFEFVTTEAPAVDPDRREVDSSAAQRGHSLLSWSLTCIVLALQRLCR

SEQ ID NO: 6128 - protein, 109 aa, Homo Sapiens
MAFQKAVKGTILVGGGALATVLGLSQFAHYRRKQMNLAYVKAADCISEPVNREPPSREAQLLTLQNTSEFDILVIGGGATGSGCALDAVTRGLKTALVERDDFSSGTSS

SEQ ID NO: 6129 - protein, 727 aa, Homo Sapiens
MAFQKAVKGTILVGGGALATVLGLSQFAHYRRKQMNLAYVKAADCISEPVNREPPSREAQLLTLQNTSEFDILVIGGGATGSGCALDAVTRGLKTALVERDDFSSGTSSRSTKLIHGGVRYLQKAIMKLDIEQYRMVKEALHERANLLEIAPHLSAPLPIMLPVYKWWQLPYYWVGIKLYDLVAGSNCLKSSYVLSKSRALEHFPMLQKDKLVGAIVYYDGQHNDARMNLAIALTAARYGAATANYMEVVSLLKKTDPQTGKVRVSGARCKDVLTGQEFDVRAKCVINATGPFTDSVRKMDDKDAAAICQPSAGVHIVMPGYYSPESMGLLDPATSDGRVIFFLPWQKMTIAGTTDTPTDVTHHPIPSEEDINFILNEVRNYLSCDVEVRRGDVLAAWSGIRPLVTDPKSADTQSISRNHVVDISESGLITIAGGKWTTYRSMAEDTINAAVKTHNLKAGPSRTVGLFLQGGKDWSPTLYIRLVQDYGLESEVAQHLAATYGDKAFEVAKMASVTGKRWPIVGVRLVSEFPYIEAEVKYGIKEYACTAVDMISRRTRLAFLNVQAAEEALPRIVELMGRELNWDDYKKQEQLETARKFLYYEMGYKSRSEQLTDRSEISLLPSDIDRYKKRFHKFDADQKGFITIVDVQRVLESINVQMDENTLHEILNEVDLNKNGQVELNEFLQLMSAIQKGRVSGSRLAILMKTAEENLDRRVPIPVDRSCGGL

SEQ ID NO: 6130 - protein, 727 aa, Homo Sapiens; identical to SEQ ID NO: 6129

SEQ ID NO: 6131 - protein, 727 aa, Homo Sapiens; identical to SEQ ID NO: 6129

SEQ ID NO: 6132 - protein, 727 aa, Homo Sapiens; identical to SEQ ID NO: 6129

SEQ ID NO: 6133 - protein, 379 aa, Homo Sapiens
MAFQKAVKGTILVGGGALATVLGLSQFAHYRRKQMNLAYVKAADCISEPVNREPPSREAQLLTLQNTSEFDILVIGGGATGSGCALDAVTRGLKTALVERDDFSSGTSSRSTKLIHGGVRYLQKAIMKLDIEQYRMVKEALHERANLLEIAPHLSAPLPIMLPVYKWWQLPYYWVGIKLYDLVAGSNCLKSSYVLSKSRALEHFPMLQKDKLVGAIVYYDGQHNDARMNLAIALTAARYGAATANYMEVVSLLKKTDPQTGKVRVSGARCKDVLTGQEFDVRAKCVINATGPFTDSVRKMDDKDAAAICQPSAGVHIVMPGYYSPESMGLLDPATSDGRVIFFLPWQKMTIAGTTDTPTDVTHHPIPSEEDINFILNEV

SEQ ID NO: 6134 - protein, 56 aa, Homo Sapiens
MAFQKAVKGTILVGGGALATVLGLSQFAHYRRKQNIVLSGELRNEECILLRKCGKT

SEQ ID NO: 6135 - protein, 56 aa, Homo Sapiens; identical to SEQ ID NO: 6134

SEQ ID NO: 6136 - protein, 601 aa, Homo Sapiens
MKLDIEQYRMVKEALHERANLLEIAPHLSAPLPIMLPVYKWWQLPYYWVGIKLYDLVAGSNCLKSSYVLSKSRALEHFPMLQKDKLVGAIVYYDGQHNDARMNLAIALTAARYGAATANYMEVVSLLKKTDPQTGKVRVSGARCKDVLTGQEFDVRAKCVINATGPFTDSVRKMDDKDAAAICQPSAGVHIVMPGYYSPESMGLLDPATSDGRVIFFLPWQKMTIAGTTDTPTDVTHHPIPSEEDINFILNEVRNYLSCDVEVRRGDVLAAWSGIRPLVTDPKSADTQSISRNHVVDISESGLITIAGGKWTTYRSMAEDTINAAVKTHNLKAGPSRTVGLFLQGGKDWSPTLYIRLVQDYGLESEVAQHLAATYGDKAFEVAKMASVTGKRWPIVGVRLVSEFPYIEAEVKYGIKEYACTAVDMISRRTRLAFLNVQAAEEALPRIVELMGRELNWDDYKKQEQLETARKFLYYEMGYKSRSEQLTDRSEISLLPSDIDRYKKRFHKFDADQKGFITIVDVQRVLESINVQMDENTLHEILNEVDLNKNGQVELNEFLQLMSAIQKGRVSGSRLAILMKTAEENLDRRVPIPVDRSCGGL

SEQ ID NO: 6137 - protein, 73 aa, Homo Sapiens
MDVTSQARGVGLEMYPGTAQPAAPNTTSPELNLSHPLLGTALANGTGELSEHQQYVIGLFLSCLYTIFLFPIG

SEQ ID NO: 6138 - protein, 375 aa, Homo Sapiens
MDVTSQARGVGLEMYPGTAQPAAPNTTSPELNLSHPLLGTALANGTGELSEHQQYVIGLFLSCLYTIFLFPIGFVGNILILVVNISFREKMTIPDLYFINLAVADLILVADSLIEVFNLHERYYDIAVLCTFMSLFLQVNMYSSVFFLTWMSFDRYIALARAMRCSLFRTKHHARLSCGLIWMASVSATLVPFTAVHLQHTDEACFCFADVREVQWLEVTLGFIVPFAIIGLCYSLIVRVLVRAHRHRGLRPRRQKALRMILAVVLVFFVCWLPENVFISVHLLQRTQPGAAPCKQSFRHAHPLTGHIVNLAAFSNSCLNPLIYSFLGETFRDKLRLYIEQKTNLPALNRFCHAALKAVIPDSTEQSDVRFSSAV

SEQ ID NO: 6139 - protein, 375 aa, Homo Sapiens; identical to SEQ ID NO: 6138

SEQ ID NO: 6140 - protein, 375 aa, Homo Sapiens; identical to SEQ ID NO: 6138

SEQ ID NO: 6141 - protein, 375 aa, Homo Sapiens; identical to SEQ ID NO: 6138

SEQ ID NO: 6142 - protein, 408 aa, Homo Sapiens
MDVTSQARGVGLEMYPGTAQPAAPNTTSPELNLSHPLLGTALANGTGELSEHQQYVIGLFLSCLYTIFLFPIGFVGNILILVVNISFREKMTIPDLYFINLAVADLILVADSLIEVFNLHERYYDIAVLCTFMSLFLQVNMYSSVFFLTWMSFDRYIALARAMRCSLFRTKHHARLSCGLIWMASVSATLVPFTAVHLQHTDEACFCFADVREVQWLEVTLGFIVPFAIIGLCYSLIVRVLVRAHRHRGLRPRRQKALRMILAVVLVFFVCWLPENVFISVHLLQRTQPGAAPCKQSFRHAHPLTHGHVMSLNCGQMWLLAPRGLARVTLAWSPWGCLGNLTTGHLALLTQNCYNPKALAPQGPKASGDQPVTQLLPANPACRCTCLPLQETFLTPSTRKATRRGHCG

SEQ ID NO: 6143 - protein, 176 aa, Homo Sapiens
MSLNCGQMWLLAPRGLARVTLAWSPWGCLGNLTTGHLALLTQNCYNPKALAPQGPKASGDQPVTQLLPANPACRCTCLPLQETFLSVLHLPGWQQWRCAASPGPRGAAALGPEQQEGPSVERPPSAPGWFSHCLLTSTWQLHSCGLGPCELPCGLVGCQDNEILQHLWLTNLFLQK

SEQ ID NO: 6144 - protein, 129 aa, Homo Sapiens
MPMASPQTLVLYLLVLAVTEAWGQEAVIPGCHLHPFNVTVRSDRQGTCQGSHVAQACVGHCESSAFPSRYSVLVASGYRHNITSVSQCCTISGLKKVKVQLQCVGSRREELEIFTARACQCDMCRLSRY

SEQ ID NO: 6145 - protein, 129 aa, Homo Sapiens; identical to SEQ ID NO: 6144

SEQ ID NO: 6146 - protein, 118 aa, Homo Sapiens
MPMASPQTLVLYLLVLAVTEAWGQEAVIPGCHLHPFNVTVRSDRQGTCQGSHVAQACVGHCESSAFPSRYSVLVASGYRHNITSVSQCCTISGLKKVRRARARWMDAGVAGRPERWRS

SEQ ID NO: 6147 - protein, 130 aa, Homo Sapiens
MKLAFLFLGPMALLLLAGYGCVLGASSGNLRTFVGCAVREFTFLAKKPGCRGLRITTDACWGRCETWEKPILEPPYIEAHHRVCTYNETKQVTVKLPNCAPGVDPFYTYPVAIRCDCGACSTATTECETI

SEQ ID NO: 6148 - protein, 130 aa, Homo Sapiens; identical to SEQ ID NO: 6147

SEQ ID NO: 6149 - protein, 184 aa, Homo Sapiens
MKALGAVLLALLLFGRPGRGQTQQEEEEEDEDHGPDDYDEEDEDEVEEEETNRLPGGRSRVLLRCYTCKSLPRDERCNLTQNCSHGQTCTTLIAHGNTESGLLTTHSTWCTDSCQPITKTVEGTQVTMTCCQSSLCNVPPWQSSRVQDPTGKGAGGPRGSSETVGAALLLNLLAGLGAMGARRP

SEQ ID NO: 6150 - protein, 840 aa, Homo Sapiens
MSAFRLWPGLLIMLGSLCHRGSPCGLSTHVEIGHRALEFLQLHNGRVNYRELLLEHQDAYQAGIVFPDCFYPSICKGGKFHDVSESTHWTPFLNASVHYIRENYPLPWEKDTEKLVAFLFGITSHMAADVSWHSLGLEQGFLRTMGAIDFHGSYSEAHSAGDFGGDVLSQFEFNFNYLARRWYVPVKDLLGIYEKLYGRKVITENVIVDCSHIQFLEMYGEMLAVSKLYPTYSTKSPFLVEQFQEYFLGGLDDMAFWSTNIYHLTSFMLENGTSDCNLPENPLFIACGGQQNHTQGSKMQKNDFHRNLTTSLTESVDRNINYTERGVFFSVNSWTPDSMSFIYKALERNIRTMFIGGSQLSQKHVSSPLASYFLSFPYARLGWAMTSADLNQDGHGDLVVGAPGYSRPGHIHIGRVYLIYGNDLGLPPVDLDLDKEAHRILEGFQPSGRFGSALAVLDFNVDGVPDLAVGAPSVGSEQLTYKGAVYVYFGSKQGGMSSSPNITISCQDIYCNLGWTLLAADVNGDSEPDLVIGSPFAPGGGKQKGIVAAFYSGPSLSDKEKLNVEAANWTVRGEEDFSWFGYSLHGVTVDNRTLLLVGSPTWKNASRLGHLLHIRDEKKSLGRVYGYFPPNGQSWFTISGDKAMGKLGTSLSSGHVLMNGTLKQVLLVGAPTYDDVSKVAFLTVTLHQGGATRMYALTSDAQPLLLSTFSGDRRFSRFGGVLHLSDLDDDGLDEIIMAAPLRIADVTSGLIGGEDGRVYVYNGKETTLGDMTGKCKSWITPCPEEKAQYVLISPEASSRFGSSLITVRSKAKNQVVIAAGRSSLGARLSGALHVYSLGSD

SEQ ID NO: 6151 - protein, 560 aa, Homo Sapiens
MECLYYFLGFLLLAARLPLDAAKRFHDVLGNERPSAYMREHNQLNGWSSDENDWNEKLYPVWKRGDMRWKNSWKGGRVQAVLTSDSPALVGSNITFAVNLIFPRCQKEDANGNIVYEKNCRNEAGLSADPYVYNWTAWSEDSDGENGTGQSHHNVFPDGKPFPHHPGWRRWNFIYVFHTLGQYFQKLGRCSVRVSVNTANVTLGPQLMEVTVYRRHGRAYVPIAQVKDVYVVTDQIPVFVTMFQKNDRNSSDETFLKDLPIMFDVLIHDPSHFLNYSTINYKWSFGDNTGLFVSTNHTVNHTYVLNGTFSLNLTVKAAAPGPCPPPPPPPRPSKPTPSLGPAGDNPLELSRIPDENCQINRYGHFQATITIVEGILEVNIIQMTDVLMPVPWPESSLIDFVVTCQGSIPTEVCTIISDPTCEITQNTVCSPVDVDEMCLLTVRRTFNGSGTYCVNLTLGDDTSLALTSTLISVPDRDPASPLRMANSALISVGCLAIFVTVISLLVYKKHKEYNPIENSPGNVVRSKGLSVFLNRAKAVFFPGNQEKDPLLKNQEFKGVS

SEQ ID NO: 6152 - protein, 572 aa, Homo Sapiens
MECLYYFLGFLLLAARLPLDAAKRFHDVLGNERPSAYMREHNQLNGWSSDENDWNEKLYPVWKRGDMRWKNSWKGGRVQAVLTSDSPALVGSNITFAVNLIFPRCQKEDANGNIVYEKNCRNEAGLSADPYVYNWTAWSEDSDGENGTGQSHHNVFPDGKPFPHHPGWRRWNFIYVFHTLGQYFQKLGRCSVRVSVNTANVTLGPQLMEVTVYRRHGRAYVPIAQVKDVYVVTDQIPVFVTMFQKNDRNSSDETFLKDLPIMFDVLIHDPSHFLNYSTINYKWSFGDNTGLFVSTNHTVNHTYVLNGTFSLNLTVKAAAPGPCPPPPPPPRPSKPTPSLATTLKSYDSNTPGPAGDNPLELSRIPDENCQINRYGHFQATITIVEGILEVNIIQMTDVLMPVPWPESSLIDFVVTCQGSIPTEVCTIISDPTCEITQNTVCSPVDVDEMCLLTVRRTFNGSGTYCVNLTLGDDTSLALTSTLISVPDRDPASPLRMANSALISVGCLAIFVTVISLLVYKKHKEYNPIENSPGNVVRSKGLSVFLNRAKAVFFPGNQEKDPLLKNQEFKGVS

SEQ ID NO: 6153 - protein, 206 aa, Homo Sapiens
MECLYYFLGFLLLAARLPLDAAKRFHDVLGNERPSAYMREHNQLNGWSSDENDWNEKLYPVWKRGDMRWKNSWKGGRVQAVLTSDSPALVGSNITFAVNLIFPRCQKEDANGNIVYEKNCRNEAGLSADPYVYNWTAWSEDSDGENGTGQSHHNVFPDGKPFPHHPGWRRWNFIYVFHTLGWLLQTPKLLLYLSLKFQPSLFLLYN

SEQ ID NO: 6154 - protein, 588 aa, Homo Sapiens
MARGGAGAEEASLRSNALSWLACGLLALLANAWIILSISAKQQKHKPLELLLCFLAGTHILMAAVPLTTFAVVQLRRQASSDYDWNESICKVFVSTYYTLALATCFTVASLSYHRMWMVRWPVNYRLSNAKKQALHAVMGIWMVSFILSTLPSIGWHNNGERYYARGCQFIVSKIGLGFGVCFSLLLLGGIVMGLVCVAITFYQTLWARPRRARQARRVGGGGGTKAGGPGALGTRPAFEVPAIVVEDARGKRRSSLDGSESAKTSLQVTNLVSAIVFLYDSLTGVPILVVSFFSLKSDSAPPWMVLAVLWCSMAQTLLLPSFIWSCERYRADVRTVWEQCVAIMSEEDGDDDGGCDDYAEGRVCKVRFDANGATGPGSRDPAQVKLLPGRHMLFPPLERVHYLQVPLSRRLSHDETNIFSTPREPGSFLHKWSSSDDIRVLPAQSRALGGPPEYLGQRHRLEDEEDEEEAEGGGLASLRQFLESGVLGSGGGPPRGPGFFREEITTFIDETPLPSPTASPGHSPRRPRPLGLSPRRLSLGSPESRAVGLPLGLSAGRRCSLTGGEESARAWGGSWGPGNPIFPQLTL

SEQ ID NO: 6155 - protein, 304 aa, Homo Sapiens
MLSTGVVSFFSLKSDSAPPWMVLAVLWCSMAQTLLLPSFIWSCERYRADVRTVWEQCVAIMSEEDGDDDGGCDDYAEGRVCKVRFDANGATGPGSRDPAQVKLLPGRHMLFPPLERVHYLQVPLSRRLSHDETNIFSTPREPGSFLHKWSSSDDIRVLPAQSRALGGPPEYLGQRHRLEDEEDEEEAEGGGLASLRQFLESGVLGSGGGPPRGPGFFREEITTFIDETPLPSPTASPGHSPRRPRPLGLSPRRLSLGSPESRAVGLPLGLSAGRRCSLTGGEESARAWGGSWGPGNPIFPQLTL

SEQ ID NO: 6156 - protein, 284 aa, Homo Sapiens
MVLAVLWCSMAQTLLLPSFIWSCERYRADVRTVWEQCVAIMSEEDGDDDGGCDDYAEGRVCKVRFDANGATGPGSRDPAQVKLLPGRHMLFPPLERVHYLQVPLSRRLSHDETNIFSTPREPGSFLHKWSSSDDIRVLPAQSRALGGPPEYLGQRHRLEDEEDEEEAEGGGLASLRQFLESGVLGSGGGPPRGPGFFREEITTFIDETPLPSPTASPGHSPRRPRPLGLSPRRLSLGSPESRAVGLPLGLSAGRRCSLTGGEESARAWGGSWGPGNPIFPQLTL

SEQ ID NO: 6157 - protein, 228 aa, Homo Sapiens
  misc_feature (1)..(1): Xaa can be any naturally occurring amino acid
XITFYQTLWARPRRARQARRVGGGGGTKAGGPGALGTRPAFEVPAIVVEDARGKRRSSLDGSESAKTSLQVTNLVVSFFSLKSDSAPPWMVLAVLWCSMAQTLLLPSFIWSCERYRADVRTVWEQCVAIMSEEDGDDDGGCDDYAEGRVCKVRFDANGATGPGSRDPAQVKLLPGRHMLFPPLERVHYLQLKKLDLAAAAAHTFFVANPMHLQMREDMAKYRRMSGVR

SEQ ID NO: 6158 - protein, 138 aa, Homo Sapiens
MARLLQASCLLSLLLAGFVSQSRGQEKSKAPRQMGNPQMDCHGGISGTIYEYGALTIDGEEYIPFKQYAGKYVLFVNVASYGLTGQYIELNALQEELAPFGLVILGFPCNQFGKQEPGENSEILPTLKYVRPGGGFVP

SEQ ID NO: 6159 - protein, 62 aa, Homo Sapiens
MARLLQASCLLSLLLAGFVSQSRGQEKSKAPRQMGNPQVRETSTPFAAPSAAGTPPPTVVVS

SEQ ID NO: 6160 - protein, 72 aa, Homo Sapiens
MARLLQASCLLSLLLAGFVSQSRGQEKSKMDCHGGISGTIYEYGALTIDGEEYIPFKQYAGKYVLFVNVASY

SEQ ID NO: 6161 - protein, 225 aa, Homo Sapiens
MARLLQASCLLSLLLAGFVSQSRGQEKSKMDCHGGISGTIYEYGALTIDGEEYIPFKQYAGKYVLFVNVASYGLTGQYIELNALQEELAPFGLVILGFPCNQFGKQEPGENSEILPTLKYVRPGGGFVPNFQLFEKGDVNGEKEQKFYTFLKNSCPPTSELLGTSDRLFWEPMKVHDIRWNFEKFLVGPDGIPIMRWHHRTTVSNVKMDILSYMRRQAALGVKRK

SEQ ID NO: 6162 - protein, 225 aa, Homo Sapiens; identical to SEQ ID NO: 6161

SEQ ID NO: 6163 - protein, 99 aa, Homo Sapiens
MARLLQASCLLSLLLAGFVSQSRGQEKSKNMHYRKSLHHSVWSFWAFPATNLENRNQERTQRSFLPSSMSDQVEALSLISSSLRKGMSMERKSRNSTLS

SEQ ID NO: 6164 - protein, 170 aa, Homo Sapiens
  misc_feature (1)..(1): Xaa can be any naturally occurring amino acid
XCHGGISGTIYEYGALTIDGEEYIPFKQYAGKYVLFVNVASYGLTGQYIELNALQEELAPFGLVILGFPCNQFGKQEPGENSEILPTLKTPVLPPRSSWVHLTASSGNPRFTTSAGTLRSSWWGQMVYPSCAGTTGPRSATSRWTSCPTGGRQPWGSRGSNRPSHPMSTM

SEQ ID NO: 6165 - protein, 79 aa, Homo Sapiens
  misc_feature (1)..(1): Xaa can be any naturally occurring amino acid
XFGKQEPGENSEILPTLKYVRPGGGFVPNFQLFEKGDVNGEKEQKFYTFLKGQAIPQEGLGRKRVRGPQARLTLLLSLL

SEQ ID NO: 6166 - protein, 174 aa, Homo Sapiens
MCASRDDWRCARSMHEFSAKDIDGHMVNLDKYRGFVCIVTNVASQGKTEVNYTQLVDLHARYAECGLRILAFPCNQFGKQEPGSNEEIKEFAAGYNVKFDMFSKICVNGDDAHPLWKWMKIQPKGKGILGKTAWGLWGAAGDAHVHVLLFQCHQVELHQVPHRQERLRGEALRT

SEQ ID NO: 6167 - protein, 240 aa, Homo Sapiens
MCASRDDWRCARSMHEFSAKDIDGHMVNLDKYRGFVCIVTNVASQGKTEVNYTQLVDLHARYAECGLRILAFPCNQFGKQEPGSNEEIKEFAAGYNVKFDMFSKICVNGDDAHPLWKWMKIQPKGKGILGNAIKWNFTKFGHRLSTVPHRQERLRGEALRTHGGAPGDREGPAPLFLAPQVCGPARAPAHALGAFHRHSRPACKPAGGADPKIQRAPRRRKVPWPAGLGSAPPPLATLWE

SEQ ID NO: 6168 - protein, 169 aa, Homo Sapiens
MCASRDDWRCARSMHEFSAKDIDGHMVNLDKYRGFVCIVTNVASQGKTEVNYTQLVDLHARYAECGLRILAFPCNQFGKQEPGSNEEIKEFAAGYNVKFDMFSKICVNGDDAHPLWKWMKIQPKGKGILGNAIKWNFTKFLIDKNGCVVKRYGPMEEPLVIEKDLPHYF

SEQ ID NO: 6169 - protein, 133 aa, Homo Sapiens
MGRAGAGSPGRRRQRCQSRGRRRPRAPRRRKAPACRRRRARRRRKKPCPRSLRPEIHECPKSQDPCASRDDWRCARSMHEFSAKDIDGHMVNLDKGFVCIVTNVASQGKTEVNYTQLVDLHARYAECGLRILA

SEQ ID NO: 6170 - protein, 233 aa, Homo Sapiens
MGRAGAGSPGRRRQRCQSRGRRRPRAPRRRKAPACRRRRARRRRKKPCPRSLRPEIHECPKSQDPCASRDDWRCARSMHEFSAKDIDGHMVNLDKYRGFVCIVTNVASQGKTEVNYTQLVDLHARYAECGLRILAFPCNQFGKQEPGSNEEIKEFAAGYNVKFDMFSKICVNGDDAHPLWKWMKIQPKGKGILGNAIKWNFTKFLIDKNGCVVKRYGPMEEPLVIEKDLPHYF

SEQ ID NO: 6171 - protein, 179 aa, Homo Sapiens
MGRAGAGSPGRRRQRCQSRGRRRPRAPRRRKAPACRRRRARRRRKKPCPRSLRPEIHECPKSQDPCASRDDWRCARSMHEFSAKDIDGHMVNLDKYRGFVCIVTNVASQGKTEVNYTQLVDLHARYAECGLRILAFPCNQFGKQEPGSNEEIKEFAAGYNVKFDMFSKICVNGDDAHPL

SEQ ID NO: 6172 - protein, 154 aa, Homo Sapiens
MHEFSAKDIDGHMVNLDKYRGFVCIVTNVASQGKTEVNYTQLVDLHARYAECGLRILAFPCNQFGKQEPGSNEEIKEFAAGYNVKFDMFSKICVNGDDAHPLWKWMKIQPKGKGILGNAIKWNFTKFLIDKNGCVVKRYGPMEEPLVIEKDLPH

SEQ ID NO: 6173 - protein, 196 aa, Homo Sapiens
MSLGRLCRLLKPALLCGALAAPGLAGTMCASRDDWRCARSMHEFSAKDIDGHMVNLDKYRGFVCIVTNVASQGKTEVNYTQLVDLHARYAECGLRILAFPCNQFGKQEPGSNEEIKEFAAGYNVKFDMFSKICVNGDDAHPLWKWMKIQPKGKGILGNAIKWNFTKFLIDKNGCVVKRYGPMEEPLVIEKDLPHYF

SEQ ID NO: 6174 - protein, 196 aa, Homo Sapiens; identical to SEQ ID NO: 6173

SEQ ID NO: 6175 - protein, 177 aa, Homo Sapiens
MSLGRLCRLLKPALLCGALAAPGLAGTMCASRDDWRCARSMHEFSAKDIDGHMVNLDKYRGFVCIVTNVASQGKTEVNYTQLVDLHARYAECGLRILAFPCNQFGKQEPGSNEEIKEFAAGYNVKFDMFSKICVNGDDAHPLWKWMKIQPKGKGILGNSSSTRTAAWSATDPWRSPW

SEQ ID NO: 6176 - protein, 166 aa, Homo Sapiens
YAECGLRILAFPCNQFGKQEPGSNEEIKEFAAGYNVKFDMFSKICVNGDDAHPLWKWMKIQPKGKGILGNAIKWNFTKFLIDKNGCVVKRYGPMEEPLLHKCVAPPEPLPTPLEPSTGTHDGLPANLLVGQTRKSSVHPAGGRSHGLLGLARRPHPWLPCGNKQTN

SEQ ID NO: 6177 - protein, 221 aa, Homo Sapiens
MTTQLRVVHLLPLLLACFVQTSPKQEKMKMDCHKDEKGTIYDYEAIALNKNEYVSFKQYVGKHILFVNVATYCGLTAQYPELNALQEELKPYGLVVLGFPCNQFGKQEPGDNKEILPGLKYVRPGGGFVPSFQLFEKGDVNGEKEQKVFSFLKHSCPHPSEILGTFKSISWDPVKVHDIRWNFEKFLVGPDGIPVMRWSHRATVSSVKTDILAYLKQFKTK

SEQ ID NO: 6178 - protein, 100 aa, Homo Sapiens
MTTQLRVVHLLPLLLACFVQTSPKQEKMKMDCHKDEKGTIYDYEAIALNKNEYVSFKQYVGKHILFVNVATYCGLTAQYPGMSVQGEDLYLVSSFLRKGM

SEQ ID NO: 6179 - protein, 220 aa, Homo Sapiens
MFQQFQASCLVLFFLVGFAQQTLKPQNRKVDCNKGVTGTIYEYGALTLNGEEYIQFKQFAGKHVLFVNVAAYGLAAQYPELNALQEELKNFGVIVLAFPCNQFGKQEPGTNSEILLGLKYVCPGSGFVPSFQLFEKGDVNGEKEQKVFTFLKNSCPPTSDLLGSSSQLFWEPMKVHDIRWNFEKFLVGPDGVPVMHWFHQAPVSTVKSDILEYLKQFNTH

SEQ ID NO: 6180 - protein, 179 aa, Homo Sapiens
MFQQFQASCLVLFFLVGFAQQTLKPQNRKVDCNKGVTGTIYEYGALTLNGEEYIQFKQFAGKHVLFVNVAAYGLAAQYPELNALQEELKNFGVIVLAFPCNQFGKQEPGTNSEILLGLKTPALRPLIFWAHQANSSGSPRSMISAGTLRNFWWGPMESLSCIGSTRLQSAQSSQTSWST

SEQ ID NO: 6181 - protein, 220 aa, Homo Sapiens; identical to SEQ ID NO: 6179

SEQ ID NO: 6182 - protein, 187 aa, Homo Sapiens
MVAATVAAAWLLLWAAACAQQEQDFYDFKAVNIRGKLVSLEKYRGSVSLVVNVASECGFTDQHYRALQQLQRDLGPHHFNVLAFPCNQFGQQEPDSNKEIESFARRTYSVSFPMFSKIAVTGTGAHPAFKYLAQTSGKEPTWNFWKYLVAPDGKVVGAWDPTVSVEEVRPQITALVRKLILLKREDL

SEQ ID NO: 6183 - protein, 42 aa, Homo Sapiens
MSRTAYTVGALLLLLGTLLPAAEGKKKGSQGAIPPPAKRPCM

SEQ ID NO: 6184 - protein, 143 aa, Homo Sapiens
MSRTAYTVGALLLLLGTLLPAAEGKKKGSQGAIPPPDKALHVTERKYLKRDWCKTQPLKQTIHEEGCNSRTIINRFCYGQCNSFYIPRHIRKEEGSFQSCSFCKPKKFTTMMVTLNCPELQPPTKKKRVTRVKQCRCISIDLD

SEQ ID NO: 6185 - protein, 184 aa, Homo Sapiens
MSRTAYTVGALLLLLGTLLPAAEGKKKGSQGAIPPPDKAQHNDSEQTQSPQQPGSRNRGRGQGRGTAMPGEEVLESSQEALHVTERKYLKRDWCKTQPLKQTIHEEGCNSRTIINRFCYGQCNSFYIPRHIRKEEGSFQSCSFCKPKKFTTMMVTLNCPELQPPTKKKRVTRVKQCRCISIDLD

SEQ ID NO: 6186 - protein, 168 aa, Homo Sapiens
MFWKLSLSLFLVAVLVKVAEARKNRPAGAIPSPYKDGSSNNSERWQHQIKEVLASSQEALVVTERKYLKSDWCKTQPLRQTVSEEGCRSRTILNRFCYGQCNSFYIPRHVKKEEESFQSCAFCKPQRVTSVLVELECPGLDPPFRLKKIQKVKQCRCMSVNLSDSDKQ

SEQ ID NO: 6187 - protein, 81 aa, Homo Sapiens
MMRVNGDDDSVAALSFLYDYYMGPKEKRILSSSTGGRNDQGKRYYHGMEYETDLTPLESPTHLMKFLTENVSGTPEYPDLL

SEQ ID NO: 6188 - protein, 556 aa, Homo Sapiens
MMRVNGDDDSVAALSFLYDYYMGPKEKRILSSSTGGRNDQGKRYYHGMEYETDLTPLESPTHLMKFLTENVSGTPEYPDLLKKNNLMSLEGALPTPGKAAPLPAGPSKLEAGSVDSYLLPTTDMYDNGSLNSLFESIHGVPPTQRWQPDSTFKDDPQESMLFPDILKTSPEPPCPEDYPSLKSDFEYTLGSPKAIHIKSGESPMAYLNKGQFYPVTLRTPAGGKGLALSSNKVKSVVMVVFDNEKVPVEQLRFWKHWHSRQPTAKQRVIDVADCKENFNTVEHIEEVAYNALSFVWNVNEEAKVFIGVNCLSTDFSSQKGVKGVPLNLQIDTYDCGLGTERLVHRAVCQIKIFCDKGAERKMRDDERKQFRRKVKCPDSSNSGVKGCLLSGFRGNETTYLRPETDLETPPVLFIPNVHFSSLQRSGGAAPSAGPSSSNRLPLKRTCSPFTEEFEPLPSKQAKEGDLQRVLLYVRRETEEVFDALMLKTPDLKGLRNAISEKYGFPEENIYKVYKKCKRGILVNMDNNIIQHYSNHVAFLLDMGELDGKIQIILKEL

SEQ ID NO: 6189 - protein, 626 aa, Homo Sapiens
MSNELDFRSVRLLKNDPVNLQKFSYTSEDEAWKTYLENPLTAATKAMMRVNGDDDSVAALSFLYDYYMGPKEKRILSSSTGGRNDQGKRYYHGMEYETDLTPLESPTHLMKFLTENVSGTPEYPDLLKKNNLMSLEGALPTPGKAAPLPAGPSKLEAGSVDSYLLPTTDMYDNGSLNSLFESIHGVPPTQRWQPDSTFKDDPQESMLFPDILKTSPEPPCPEDYPSLKSDFEYTLGSPKAIHIKSGESPMAYLNKGQFYPVTLRTPAGGKGLALSSNKVKSVVMVVFDNEKVPVEQLRFWKHWHSRQPTAKQRVIDVADCKENFNTVEHIEEVAYNALSFVWNVNEEAKVFIGVNCLSTDFSSQKGVKGVPLNLQIDTYDCGLGTERLVHRAVCQIKIFCDKGAERKMRDDERKQFRRKVKCPDSSNSGVKGCLLSGFRGNETTYLRPETDLETPPVLFIPNVHFSSLQRSGGAAPSAGPSSSNRLPLKRTCSPFTEEFEPLPSKQAKEGDLQRVLLYVRRETEEVFDALMLKTPDLKGLRNAISEKYGFPEENIYKVYKKCKRGETSLLHPRLSRHPPPDCLECSHPVTQVRNMGFGDGFWRQRDLDSNPSPTTVNSLHFTVNSE

SEQ ID NO: 6190 - protein, 602 aa, Homo Sapiens
MSNELDFRSVRLLKNDPVNLQKFSYTSEDEAWKTYLENPLTAATKAMMRVNGDDDSVAALSFLYDYYMGPKEKRILSSSTGGRNDQGKRYYHGMEYETDLTPLESPTHLMKFLTENVSGTPEYPDLLKKNNLMSLEGALPTPGKAAPLPAGPSKLEAGSVDSYLLPTTDMYDNGSLNSLFESIHGVPPTQRWQPDSTFKDDPQESMLFPDILKTSPEPPCPEDYPSLKSDFEYTLGSPKAIHIKSGESPMAYLNKGQFYPVTLRTPAGGKGLALSSNKVKSVVMVVFDNEKVPVEQLRFWKHWHSRQPTAKQRVIDVADCKENFNTVEHIEEVAYNALSFVWNVNEEAKVFIGVNCLSTDFSSQKGVKGVPLNLQIDTYDCGLGTERLVHRAVCQIKIFCDKGAERKMRDDERKQFRRKVKCPDSSNSGVKGCLLSGFRGNETTYLRPETDLETPPVLFIPNVHFSSLQRSGGAAPSAGPSSSNRLPLKRTCSPFTEEFEPLPSKQAKEGDLQRVLLYVRRETEEVFDALMLKTPDLKGLRNAISEKYGFPEENIYKVYKKCKRGILVNMDNNIIQHYSNHVAFLLDMGELDGKIQIILKEL

SEQ ID NO: 6191 - protein, 607 aa, Homo Sapiens
MWMNSILPIFLFRSVRLLKNDPVNLQKFSYTSEDEAWKTYLENPLTAATKAMMRVNGDDDSVAALSFLYDYYMGPKEKRILSSSTGGRNDQGKRYYHGMEYETDLTPLESPTHLMKFLTENVSGTPEYPDLLKKNNLMSLEGALPTPGKAAPLPAGPSKLEAGSVDSYLLPTTDMYDNGSLNSLFESIHGVPPTQRWQPDSTFKDDPQESMLFPDILKTSPEPPCPEDYPSLKSDFEYTLGSPKAIHIKSGESPMAYLNKGQFYPVTLRTPAGGKGLALSSNKVKSVVMVVFDNEKVPVEQLRFWKHWHSRQPTAKQRVIDVADCKENFNTVEHIEEVAYNALSFVWNVNEEAKVFIGVNCLSTDFSSQKGVKGVPLNLQIDTYDCGLGTERLVHRAVCQIKIFCDKGAERKMRDDERKQFRRKVKCPDSSNSGVKGCLLSGFRGNETTYLRPETDLETPPVLFIPNVHFSSLQRSGGAAPSAGPSSSNRLPLKRTCSPFTEEFEPLPSKQAKEGDLQRVLLYVRRETEEVFDALMLKTPDLKGLRNAISEKYGFPEENIYKVYKKCKRGILVNMDNNIIQHYSNHVAFLLDMGELDGKIQIILKEL

SEQ ID NO: 6192 - protein, 52 aa, Homo Sapiens
MWMNSILPIFLVPRRSGYCPPALGAGMTKERGTTMAWNMRRTSLPLKAPHTS

SEQ ID NO: 6193 - protein, 48 aa, Homo Sapiens
MQKIMHISVLLSPVLWGLIFGVSSNSIQIGGLFPRGADQEYSAFRVGM

SEQ ID NO: 6194 - protein, 125 aa, Homo Sapiens
MQKIMHISVLLSPVLWGLIFGVSSNSIQIGGLFPRGADQEYSAFRVGMVQFSTSEFRLTPHIDNLEVANSFAVTNAFCSQFSRGVYAIFGFYDKKSVNTITSFCGTLHVSFITPSFPTDGTHPFV

SEQ ID NO: 6195 - protein, 883 aa, Homo Sapiens
MQKIMHISVLLSPVLWGLIFGVSSNSIQIGGLFPRGADQEYSAFRVGMVQFSTSEFRLTPHIDNLEVANSFAVTNAFCSQFSRGVYAIFGFYDKKSVNTITSFCGTLHVSFITPSFPTDGTHPFVIQMRPDLKGALLSLIEYYQWDKFAYLYDSDRGLSTLQAVLDSAAEKKWQVTAINVGNINNDKKDEMYRSLFQDLELKKERRVILDCERDKVNDIVDQVITIGKHVKGYHYIIANLGFTDGDLLKIQFGGANVSGFQIVDYDDSLVSKFIERWSTLEEKEYPGAHTTTIKYTSALTYDAVQVMTEAFRNLRKQRIEISRRGNAGDCLANPAVPWGQGVEIERALKQVQVEGLSGNIKFDQNGKRINYTINIMELKTNGPRKIGYWSEVDKMVVTLTELPSGNDTSGLENKTVVVTTILESPYVMMKKNHEMLEGNERYEGYCVDLAAEIAKHCGFKYKLTIVGDGKYGARDADTKIWNGMVGELVYGKADIAIAPLTITLVREEVIDFSKPFMSLGISIMIKKPQKSKPGVFSFLDPLAYEIWMCIVFAYIGVSVVLFLVSRFSPYEWHTEEFEDGRETQSSESTNEFGIFNSLWFSLGAFMQQGCDISPRSLSGRIVGGVWWFFTLIIISSYTANLAAFLTVERMVSPIESAEDLSKQTEIAYGTLDSGSTKEFFRRSKIAVFDKMWTYMRSAEPSVFVRTTAEGVARVRKSKGKYAYLLESTMNEYIEQRKPCDTMKVGGNLDSKGYGIATPKGSSLRNAVNLAVLKLNEQGLLDKLKNKWWYDKGECGSGGGDSKEKTSALSLSNVAGVFYILVGGLGLAMLVALIEFCYKSRAEAKRMKVAKNAQNINPSSSQNSQNFATYKEGYNVYGIESVKI

SEQ ID NO: 6196 - protein, 883 aa, Homo Sapiens
MQKIMHISVLLSPVLWGLIFGVSSNSIQIGGLFPRGADQEYSAFRVGMVQFSTSEFRLTPHIDNLEVANSFAVTNAFCSQFSRGVYAIFGFYDKKSVNTITSFCGTLHVSFITPSFPTDGTHPFVIQMRPDLKGALLSLIEYYQWDKFAYLYDSDRGLSTLQAVLDSAAEKKWQVTAINVGNINNDKKDEMYRSLFQDLELKKERRVILDCERDKVNDIVDQVITIGKHVKGYHYIIANLGFTDGDLLKIQFGGANVSGFQIVDYDDSLVSKFIERWSTLEEKEYPGAHTTTIKYTSALTYDAVQVMTEAFRNLRKQRIEISRRGNAGDCLANPAVPWGQGVEIERALKQVQVEGLSGNIKFDQNGKRINYTINIMELKTNGPRKIGYWSEVDKMVVTLTELPSGNDTSGLENKTVVVTTILESPYVMMKKNHEMLEGNERYEGYCVDLAAEIAKHCGFKYKLTIVGDGKYGARDADTKIWNGMVGELVYGKADIAIAPLTITLVREEVIDFSKPFMSLGISIMIKKPQKSKPGVFSFLDPLAYEIWMCIVFAYIGVSVVLFLVSRFSPYEWHTEEFEDGRETQSSESTNEFGIFNSLWFSLGAFMQQGCDISPRSLSGRIVGGVWWFFTLIIISSYTANLAAFLTVERMVSPIESAEDLSKQTEIAYGTLDSGSTKEFFRRSKIAVFDKMWTYMRSAEPSVFVRTTAEGVARVRKSKGKYAYLLESTMNEYIEQRKPCDTMKVGGNLDSKGYGIATPKGSSLRTPVNLAVLKLSEQGVLDKLKNKWWYDKGECGAKDSGSKEKTSALSLSNVAGVFYILVGGLGLAMLVALIEFCYKSRAEAKRMKVAKNAQNINPSSSQNSQNFATYKEGYNVYGIESVKI

SEQ ID NO: 6197 - protein, 901 aa, Homo Sapiens
MQKIMHISVLLSPVLWGLIFGVSSNSIQIGGLFPRGADQEYSAFRVGMVQFSTSEFRLTPHIDNLEVANSFAVTNAFCSQFSRGVYAIFGFYDKKSVNTITSFCGTLHVSFITPSFPTDGTHPFVIQMRPDLKGALLSLIEYYQWDKFAYLYDSDRGLSTLQAVLDSAAEKKWQVTAINVGNINNDKKDEMYRSLFQDLELKKERRVILDCERDKVNDIVDQVITIGKHVKGYHYIIANLGFTDGDLLKIQFGGANVSGFQIVDYDDSLVSKFIERWSTLEEKEYPGAHTTTIKYTSALTYDAVQVMTEAFRNLRKQRIEISRRGNAGDCLANPAVPWGQGVEIERALKQVQVEGLSGNIKFDQNGKRINYTINIMELKTNGPRKIGYWSEVDKMVVTLTELPSGNDTSGLENKTVVVTTILESPYVMMKKNHEMLEGNERYEGYCVDLAAEIAKHCGFKYKLTIVGDGKYGARDADTKIWNGMVGELVYGKADIAIAPLTITLVREEVIDFSKPFMSLGISIMIKKPQKSKPGVFSFLDPLAYEIWMCIVFAYIGVSVVLFLVSRFSPYEWHTEEFEDGRETQSSESTNEFGIFNSLWFSLGAFMQQGCDISPRSLSGRIVGGVWWFFTLIIISSYTANLAAFLTVERMVSPIESAEDLSKQTEIAYGTLDSGSTKEFFRRSKIAVFDKMWTYMRSAEPSVFVRTTAEGVARVRKSKGKYAYLLESTMNEYIEQRKPCDTMKVGGNLDSKGYGIATPKGSSLRNAVNLAVLKLNEQGLLDKLKNKWWYDKGECGSGGGDSKEKTSALSLSNVAGVFYILVGGLGLAMLVALIEFCYKSRAEAKRMKMTLNDAMRNKARLSITGSTGENGRVMTPEFPKAVHAVPYVSPGMGMNVSVTDLS

SEQ ID NO: 6198 - protein, 105 aa, Homo Sapiens
MRPDLKGALLSLIEYYQWDKFAYLYDSDRGLSTLQAVLDSAAEKKWQVTAINVGNINNDKKDEMYRSLFQDLELKKERRVILDCERDKVNDIVDQVITIGKHVKG

SEQ ID NO: 6199 - protein, 57 aa, Homo Sapiens
MVQFSTSEFRLTPHIDNLEVANSFAVTNAFCSQFSRGVYAIFGFYDKKSVNTITSFC

SEQ ID NO: 6200 - protein, 145 aa, Homo Sapiens
MVQFSTSEFRLTPHIDNLEVANSFAVTNAFCSQFSRGVYAIFGFYDKKSVNTITSFCGTLHVSFITPSFPTDGTHPFVIQMRPDLKGALLSLIEYYQWDKFAYLYDSDRGLSTLQAVLDSAAEKKWQVTAINVGNINNDKKDEMY

SEQ ID NO: 6201 - protein, 730 aa, Homo Sapiens
MVQFSTSEFRLTPHIDNLEVANSFAVTNAFCSQFSRGVYAIFGFYDKKSVNTITSFCGTLHVSFITPSFPTDGTHPFVIQMRPDLKGALLSLIEYYQWDKFAYLYDSDRGLSTLQAVLDSAAEKKWQVTAINVGNINNDKKDEMYRSLFQDLELKKERRVILDCERDKVNDIVDQVITIGKHVKGYHYIIANLGFTDGDLLKIQFGGANVSGFQIVDYDDSLVSKFIERWSTLEEKEYPGAHTTTIKYTSALTYDAVQVMTEAFRNLRKQRIEISRRGNAGDCLANPAVPWGQGVEIERALKQVQVEGLSGNIKFDQNGKRINYTINIMELKTNGPRKIGYWSEVDKMVVTLTELPSGNDTSGLENKTVVVTTILESPYVMMKKNHEMLEGNERYEGYCVDLAAEIAKHCGFKYKLTIVGDGKYGARDADTKIWNGMVGELVYGKADIAIAPLTITLVREEVIDFSKPFMSLGISIMIKKPQKSKPGVFSFLDPLAYEIWMCIVFAYIGVSVVLFLVSRFSPYEWHTEEFEDGRETQSSESTNEFGIFNSLWFSLGAFMQQGCDISPRSLSGRIVGGVWWFFTLIIISSYTANLAAFLTVERMVSPIESAEDLSKQTEIAYGTLDSGSTKEFFRRSKIAVFDKMWTYMRSAEPSVFVRTTAEGVARVRKSKGKYAYLLESTMNEYIEQRKPCDTMKVGGNLDSKGYGIATPKGSSLSGVTFKTLLFVCCG

SEQ ID NO: 6202 - protein, 836 aa, Homo Sapiens
MVQFSTSEFRLTPHIDNLEVANSFAVTNAFCSQFSRGVYAIFGFYDKKSVNTITSFCGTLHVSFITPSFPTDGTHPFVIQMRPDLKGALLSLIEYYQWDKFAYLYDSDRGLSTLQAVLDSAAEKKWQVTAINVGNINNDKKDEMYRSLFQDLELKKERRVILDCERDKVNDIVDQVITIGKHVKGYHYIIANLGFTDGDLLKIQFGGANVSGFQIVDYDDSLVSKFIERWSTLEEKEYPGAHTTTIKYTSALTYDAVQVMTEAFRNLRKQRIEISRRGNAGDCLANPAVPWGQGVEIERALKQVQVEGLSGNIKFDQNGKRINYTINIMELKTNGPRKIGYWSEVDKMVVTLTELPSGNDTSGLENKTVVVTTILESPYVMMKKNHEMLEGNERYEGYCVDLAAEIAKHCGFKYKLTIVGDGKYGARDADTKIWNGMVGELVYGKADIAIAPLTITLVREEVIDFSKPFMSLGISIMIKKPQKSKPGVFSFLDPLAYEIWMCIVFAYIGVSVVLFLVSRFSPYEWHTEEFEDGRETQSSESTNEFGIFNSLWFSLGAFMQQGCDISPRSLSGRIVGGVWWFFTLIIISSYTANLAAFLTVERMVSPIESAEDLSKQTEIAYGTLDSGSTKEFFRRSKIAVFDKMWTYMRSAEPSVFVRTTAEGVARVRKSKGKYAYLLESTMNEYIEQRKPCDTMKVGGNLDSKGYGIATPKGSSLRTPVNLAVLKLSEQGVLDKLKNKWWYDKGECGAKDSGSKEKTSALSLSNVAGVFYILVGGLGLAMLVALIEFCYKSRAEAKRMKVAKNAQNINPSSSQNSQNFATYKEGYNVYGIESVKI

SEQ ID NO: 6203 - protein, 836 aa, Homo Sapiens; identical to SEQ ID NO: 6202

SEQ ID NO: 6204 - protein, 214 aa, Homo Sapiens
  misc_feature (1)..(1): Xaa can be any naturally occurring amino acid
XLDSGSTKEFFRRSKIAVFDKMWTYMRSAEPSVFVRTTAEGVARVRKSKGKYAYLLESTMNEYIEQRKPCDTMKVGGNLDSKGYGIATPKGSSLRTPVNLAVLKLSEQGVLDKLKNKWWYDKGECGAKDSGSKEKTSALSLSNVAGVFYILVGGLGLAMLVALIEFCYKSRAEAKRMKVAKNAQNINPSSSQNSQNFATYKEGYNVYGIESVKI

SEQ ID NO: 6205 - protein, 144 aa, Homo Sapiens
MARQKKMGQSVLRAVFFLVLGLLGHSHGGFPNTISIGGLFMRNTVQEHSAFRFAVQLYNTNQNTTEKPFHLNYHVDHLDSSNSFSVTNACPAERDYLPWPGSIRENNWTALPCCKDHGLLHLKCSPGGARQNWAYCIWGVTGEL

SEQ ID NO: 6206 - protein, 144 aa, Homo Sapiens; identical to SEQ ID NO: 6205

SEQ ID NO: 6207 - protein, 894 aa, Homo Sapiens
MARQKKMGQSVLRAVFFLVLGLLGHSHGGFPNTISIGGLFMRNTVQEHSAFRFAVQLYNTNQNTTEKPFHLNYHVDHLDSSNSFSVTNAFCSQFSRGVYAIFGFYDQMSMNTLTSFCGALHTSFVTPSFPTDADVQFVIQMRPALKGAILSLLGHYKWEKFVYLYDTERGFSILQAIMEAAVQNNWQVTARSVGNIKDVQEFRRIIEEMDRRQEKRYLIDCEVERINTILEQVVILGKHSRGYHYMLANLGFTDILLERVMHGGANITGFQIVNNENPMVQQFIQRWVRLDEREFPEAKNAPLKYTSALTHDAILVIAEAFRYLRRQRVDVSRRGSAGDCLANPAVPWSQGIDIERALKMVQVQGMTGNIQFDTYGRRTNYTIDVYEMKVSGSRKAGYWNEYERFVPFSDQQISNDSASSENRTIVVTTILESPYVMYKKNHEQLEGNERYEGYCVDLAYEIAKHVRIKYKLSIVGDGKYGARDPETKIWNGMVGELVYGRADIAVAPLTITLVREEVIDFSKPFMSLGISIMIKKPQKSKPGVFSFLDPLAYEIWMCIVFAYIGVSVVLFLVSRFSPYEWHLEDNNEEPRDPQSPPDPPNEFGIFNSLWFSLGAFMQQGCDISPRSLSGRIVGGVWWFFTLIIISSYTANLAAFLTVERMVSPIESAEDLAKQTEIAYGTLDSGSTKEFFRRSKIAVYEKMWSYMKSAEPSVFTKTTADGVARVRKSKGKFAFLLESTMNEYIEQRKPCDTMKVGGNLDSKGYGVATPKGSALRTPVNLAVLKLSEQGILDKLKNKWWYDKGECGAKDSGSKDKTSALSLSNVAGVFYILVGGLGLAMMVALIEFCYKSRAESKRMKLTKNTQNFKPAPATNTQNYATYREGYNVYGTESVKI

SEQ ID NO: 6208 - protein, 824 aa, Homo Sapiens
MARQKKMGQSVLRAVFFLVLGLLGHSHGGFPNTISIGGLFMRNTVQEHSAFRFAVQLYNTNQNTTEKPFHLNYHVDHLDSSNSFSVTNAFCSQFSRGVYAIFGFYDQMSMNTLTSFCGALHTSFVTPSFPTDADVQFVIQMRPALKGAILSLLGHYKWEKFVYLYDTERGFSILQAIMEAAVQNNWQVTARSVGNIKDVQEFRRIIEEMDRRQEKRYLIDCEVERINTILEQVVILGKHSRGYHYMLANLGFTDILLERVMHGGANITGFQIVNNENPMVQQFIQRWVRLDEREFPEAKNAPLKYTSALTHDAILVIAEAFRYLRRQRVDVSRRGSAGDCLANPAVPWSQGIDIERALKMVQVQGMTGNIQFDTYGRRTNYTIDVYEMKVSGSRKAGYWNEYERFVPFSDQQISNDSASSENRTIVVTTILESPYVMYKKNHEQLEGNERYEGYCVDLAYEIAKHVRIKYKLSIVGDGKYGARDPETKIWNGMVGELVYGRADIAVAPLTITLVREEVIDFSKPFMSLGISIMIKKPQKSKPGVFSFLDPLAYEIWMCIVFAYIGVSVVLFLVSRFSPYEWHLEDNNEEPRDPQSPPDPPNEFGIFNSLWFSLGAFMQQGCDISPRSLSGRIVGGVWWFFTLIIISSYTANLAAFLTVERMVSPIESAEDLAKQTEIAYGTLDSGSTKEFFRRSKIAVYEKMWSYMKSAEPSVFTKTTADGVARVRKSKGKFAFLLESTMNEYIEQRKPCDTMKVGGNLDSKGYGVATPKGSALRNAVNLAVLKLNEQGLLDKLKNKWWYDKGECGSGGGDSKNACKPCSIETQ

SEQ ID NO: 6209 - protein, 894 aa, Homo Sapiens
MARQKKMGQSVLRAVFFLVLGLLGHSHGGFPNTISIGGLFMRNTVQEHSAFRFAVQLYNTNQNTTEKPFHLNYHVDHLDSSNSFSVTNAFCSQFSRGVYAIFGFYDQMSMNTLTSFCGALHTSFVTPSFPTDADVQFVIQMRPALKGAILSLLGHYKWEKFVYLYDTERGFSILQAIMEAAVQNNWQVTARSVGNIKDVQEFRRIIEEMDRRQEKRYLIDCEVERINTILEQVVILGKHSRGYHYMLANLGFTDILLERVMHGGANITGFQIVNNENPMVQQFIQRWVRLDEREFPEAKNAPLKYTSALTHDAILVIAEAFRYLRRQRVDVSRRGSAGDCLANPAVPWSQGIDIERALKMVQVQGMTGNIQFDTYGRRTNYTIDVYEMKVSGSRKAGYWNEYERFVPFSDQQISNDSASSENRTIVVTTILESPYVMYKKNHEQLEGNERYEGYCVDLAYEIAKHVRIKYKLSIVGDGKYGARDPETKIWNGMVGELVYGRADIAVAPLTITLVREEVIDFSKPFMSLGISIMIKKPQKSKPGVFSFLDPLAYEIWMCIVFAYIGVSVVLFLVSRFSPYEWHLEDNNEEPRDPQSPPDPPNEFGIFNSLWFSLGAFMQQGCDISPRSLSGRIVGGVWWFFTLIIISSYTANLAAFLTVERMVSPIESAEDLAKQTEIAYGTLDSGSTKEFFRRSKIAVYEKMWSYMKSAEPSVFTKTTADGVARVRKSKGKFAFLLESTMNEYIEQRKPCDTMKVGGNLDSKGYGVATPKGSALRNAVNLAVLKLNEQGLLDKLKNKWWYDKGECGSGGGDSKDKTSALSLSNVAGVFYILVGGLGLAMMVALIEFCYKSRAESKRMKLTKNTQNFKPAPATNTQNYATYREGYNVYGTESVKI

SEQ ID NO: 6210 - protein, 894 aa, Homo Sapiens; identical to SEQ ID NO: 6209

SEQ ID NO: 6211 - protein, 82 aa, Homo Sapiens
MRIISRQIVLLFSGFWGLAMGAFPSSVQIGGLFIRNTDQEYTAFRLAIFLHNTSPNASEAPFNLVPHVDNIETANSFAVTNA

SEQ ID NO: 6212 - protein, 82 aa, Homo Sapiens; identical to SEQ ID NO: 6211

SEQ ID NO: 6213 - protein, 82 aa, Homo Sapiens; identical to SEQ ID NO: 6211

SEQ ID NO: 6214 - protein, 84 aa, Homo Sapiens
MRIISRQIVLLFSGFWGLAMGAFPSSVQIGGLFIRNTDQEYTAFRLAIFLHNTSPNASEAPFNLVPHVDNIETANSFAVTNACK

SEQ ID NO: 6215 - protein, 225 aa, Homo Sapiens
MRIISRQIVLLFSGFWGLAMGAFPSSVQIGGLFIRNTDQEYTAFRLAIFLHNTSPNASEAPFNLVPHVDNIETANSFAVTNAFCSQYSRGVFAIFGLYDKRSVHTLTSFCSALHISLITPSFPTEGESQFVLQLRPSLRGALLSLLDHYEWNCFVFLYDTDRGLVISTTPLASNCMPSSVVHSWLYVLYNKSINSITACLLGPSTELNVFNYLIADSNLNNGNYI

SEQ ID NO: 6216 - protein, 902 aa, Homo Sapiens
MRIISRQIVLLFSGFWGLAMGAFPSSVQIGGLFIRNTDQEYTAFRLAIFLHNTSPNASEAPFNLVPHVDNIETANSFAVTNAFCSQYSRGVFAIFGLYDKRSVHTLTSFCSALHISLITPSFPTEGESQFVLQLRPSLRGALLSLLDHYEWNCFVFLYDTDRGYSILQAIMEKAGQNGWHVSAICVENFNDVSYRQLLEELDRRQEKKFVIDCEIERLQNILEQIVSVGKHVKGYHYIIANLGFKDISLERFIHGGANVTGFQLVDFNTPMVIKLMDRWKKLDQREYPGSETPPKYTSALTYDGVLVMAETFRSLRRQKIDISRRGNAGDCLANPAAPWGQGIDMERTLKQVRIQGLTGNVQFDHYGRRVNYTMDVFELKSTGPRKVGYWNDMDKLVLIQDVPTLGNDTAAIENRTVVVTTIMESPYVMYKKNHEMFEGNDKYEGYCVDLASEIAKHIGIKYKIAIVPDGKYGARDADTKIWNGMVGELVYGKAEIAIAPLTITLVREEVIDFSKPFMSLGISIMIKKPQKSKPGVFSFLDPLAYEIWMCIVFAYIGVSVVLFLVSRFSPYEWHTEEPEDGKEGPSDQPPNEFGIFNSLWFSLGAFMQQGCDISPRSLSGRIVGGVWWFFTLIIISSYTANLAAFLTVERMVSPIESAEDLAKQTEIAYGTLDSGSTKEFFRRSKIAVYEKMWTYMRSAEPSVFTRTTAEGVARVRKSKGKFAFLLESTMNEYIEQRKPCDTMKVGGNLDSKGYGVATPKGSSLRTPVNLAVLKLSEAGVLDKLKNKWWYDKGECGPKDSGSKDKTSALSLSNVAGVFYILVGGLGLAMLVALIEFCYKSRAEAKRMKLTFSEAIRNKARLSITGSVGENGRVLTPDCPKAVHTGTAIRQSSGLAVIASDLP

SEQ ID NO: 6217 - protein, 433 aa, Homo Sapiens
MRIISRQIVLLFSGFWGLAMGAFPSSVQIGGLFIRNTDQEYTAFRLAIFLHNTSPNASEAPFNLVPHVDNIETANSFAVTNAFCSQYSRGVFAIFGLYDKRSVHTLTSFCSALHISLITPSFPTEGESQFVLQLRPSLRGALLSLLDHYEWNCFVFLYDTDRGYSILQAIMEKAGQNGWHVSAICVENFNDVSYRQLLEELDRRQEKKFVIDCEIERLQNILEQIVSVGKHVKGYHYIIANLGFKDISLERFIHGGANVTGFQLVDFNTPMVIKLMDRWKKLDQREYPGSETPPKYTSALTYDGVLVMAETFRSLRRQKIDISRRGNAGDCLANPAAPWGQGIDMERTLKQVRIQGLTGNVQFDHYGRRVNYTMDVFELKSTGPRKVGYWNDMDKLVLIQDVPTLGNDTAAIENRTVVVTTIMPLMKNPILRN

SEQ ID NO: 6218 - protein, 884 aa, Homo Sapiens
MRIISRQIVLLFSGFWGLAMGAFPSSVQIGGLFIRNTDQEYTAFRLAIFLHNTSPNASEAPFNLVPHVDNIETANSFAVTNAFCSQYSRGVFAIFGLYDKRSVHTLTSFCSALHISLITPSFPTEGESQFVLQLRPSLRGALLSLLDHYEWNCFVFLYDTDRGYSILQAIMEKAGQNGWHVSAICVENFNDVSYRQLLEELDRRQEKKFVIDCEIERLQNILEQIVSVGKHVKGYHYIIANLGFKDISLERFIHGGANVTGFQLVDFNTPMVIKLMDRWKKLDQREYPGSETPPKYTSALTYDGVLVMAETFRSLRRQKIDISRRGNAGDCLANPAAPWGQGIDMERTLKQVRIQGLTGNVQFDHYGRRVNYTMDVFELKSTGPRKVGYWNDMDKLVLIQDVPTLGNDTAAIENRTVVVTTIMESPYVMYKKNHEMFEGNDKYEGYCVDLASEIAKHIGIKYKIAIVPDGKYGARDADTKIWNGMVGELVYGKAEIAIAPLTITLVREEVIDFSKPFMSLGISIMIKKPQKSKPGVFSFLDPLAYEIWMCIVFAYIGVSVVLFLVSRFSPYEWHTEEPEDGKEGPSDQPPNEFGIFNSLWFSLGAFMQQGCDISPRSLSGRIVGGVWWFFTLIIISSYTANLAAFLTVERMVSPIESAEDLAKQTEIAYGTLDSGSTKEFFRRSKIAVYEKMWTYMRSAEPSVFTRTTAEGVARVRKSKGKFAFLLESTMNEYIEQRKPCDTMKVGGNLDSKGYGVATPKGSSLRNAVNLAVLKLNEQGLLDKLKNKWWYDKGECGSGGGDSKDKTSALSLSNVAGVFYILVGGLGLAMLVALIEFCYKSRAEAKRMKVAKSAQTFNPTSSQNTQNLATYREGYNVYGTESIKI

SEQ ID NO: 6219 - protein, 433 aa, Homo Sapiens; identical to SEQ ID NO: 6217

SEQ ID NO: 6220 - protein, 902 aa, Homo Sapiens; identical to SEQ ID NO: 6216

SEQ ID NO: 6221 - protein, 884 aa, Homo Sapiens; identical to SEQ ID NO: 6218

SEQ ID NO: 6222 - protein, 104 aa, Homo Sapiens
  misc_feature (1)..(1): Xaa can be any naturally occurring amino acid
XVARVRKSKGKFAFLLESTMNEYIEQRKPCDTMKVGGNLDSKGYGVATPKGSSLRNAVNLAVLKLNEQGLLDKLKNKWWYDKGECGSGGGDSKNSCKPCRFETQ

SEQ ID NO: 6223 - protein, 180 aa, Homo Sapiens
CSHEMAAGILKQALAMGMMTEYYHYIFTTLTDAALMYDAVHVVSVAVQQFPQMTVSSLQCNRHKPWRFGTRFMSLIKEAHWEGLTGRITFNKTNGLRTDFDLDVISLKEEGLEKIGTWDPASGLNMTESQKGKPANITDSLSNRSLIVTTILEEPYVLFKKSDKPLYGNDRFEGYCIDLL

SEQ ID NO: 6224 - protein, 854 aa, Homo Sapiens
GGIFEYVESGPMGAEELAFRFAVNTINRNRTLLPNTTLTYDTQKINLYDSFEASKKACDQLSLGVAAIFGPSHSSSANAVQSICNALGVPHIQTRWKHQVSDNKDSFYVSLYPDFSSLSRAILDLVQFFKWKTVTVVYDDSTGLIRLQELIKAPSRYNLRLKIRQLPADTKDAKPLLKEMKRGKEFHVIFDCSHEMAAGILKQALAMGMMTEYYHYIFTTLDLFALDVEPYRYSGVNMTGFRILNTENTQVSSIIEKWSMERLQAPPKPDSGLLDGFMTTDAALMYDAVHVVSVAVQQFPQMTVSSLQCNRHKPWRFGTRFMSLIKEAHWEGLTGRITFNKTNGLRTDFDLDVISLKEEGLEKIGTWDPASGLNMTESQKGKPANITDSLSNRSLIVTTILEEPYVLFKKSDKPLYGNDRFEGYCIDLLRELSTILGFTYEIRLVEDGKYGAQDDANGQWNGMVRELIDHKADLAVAPLAITYVREKVIDFSKPFMTLGISILYRKPNGTNPGVFSFLNPLSPDIWMYILLAYLGVSCVLFVIARFSPYEWYNPHPCNPDSDVVENNFTLLNSFWFGVGALMQQGSELMPKALSTRIVGGIWWFFTLIIISSYTANLAAFLTVERMESPIDSADDLAKQTKIEYGAVEDGATMTFFKKSKISTYDKMWAFMSSRRQSVLVKSNEEGIQRVLTSDYAFLMESTTIEFVTQRNCNLTQIGGLIDSKGYGVGTPMGSPYRDKITIAILQLQEEGKLHMMKEKWWRGNGCPEEESKEASALGVQNIGGIFIVLAAGLVLSVFVAVGEFLYKSKKNAQLEKRAKTKLPQDYVFLPILESVSISTVLSSSPSSSSLSSCS

SEQ ID NO: 6225 - protein, 870 aa, Homo Sapiens
GGIFEYVESGPMGAEELAFRFAVNTINRNRTLLPNTTLTYDTQKINLYDSFEASKKACDQLSLGVAAIFGPSHSSSANAVQSICNALGVPHIQTRWKHQVSDNKDSFYVSLYPDFSSLSRAILDLVQFFKWKTVTVVYDDSTGLIRLQELIKAPSRYNLRLKIRQLPADTKDAKPLLKEMKRGKEFHVIFDCSHEMAAGILKQALAMGMMTEYYHYIFTTLDLFALDVEPYRYSGVNMTGFRILNTENTQVSSIIEKWSMERLQAPPKPDSGLLDGFMTTDAALMYDAVHVVSVAVQQFPQMTVSSLQCNRHKPWRFGTRFMSLIKEAHWEGLTGRITFNKTNGLRTDFDLDVISLKEEGLEKIGTWDPASGLNMTESQKGKPANITDSLSNRSLIVTTILEEPYVLFKKSDKPLYGNDRFEGYCIDLLRELSTILGFTYEIRLVEDGKYGAQDDANGQWNGMVRELIDHKADLAVAPLAITYVREKVIDFSKPFMTLGISILYRKPNGTNPGVFSFLNPLSPDIWMYILLAYLGVSCVLFVIARFSPYEWYNPHPCNPDSDVVENNFTLLNSFWFGVGALMQQGSELMPKALSTRIVGGIWWFFTLIIISSYTANLAAFLTVERMESPIDSADDLAKQTKIEYGAVEDGATMTFFKKSKISTYDKMWAFMSSRRQSVLVKSNEEGIQRVLTSDYAFLMESTTIEFVTQRNCNLTQIGGLIDSKGYGVGTPMGSPYRDKITIAILQLQEEGKLHMMKEKWWRGNGCPEEESKEASALGVQNIGGIFIVLAAGLVLSVFVAVGEFLYKSKKNAQLEKRSFCSAMVEELRMSLKCQRRLKHKPQAPVIVKTEEVINMHTFNDRRLPGKETMA

SEQ ID NO: 6226 - protein, 831 aa, Homo Sapiens
GGIFEYVESGPMGAEELAFRFAVNTINRNRTLLPNTTLTYDTQKINLYDSFEASKKACDQLSLGVAAIFGPSHSSSANAVQSICNALGVPHIQTRWKHQVSDNKDSFYVSLYPDFSSLSRAILDLVQFFKWKTVTVVYDDSTGLIRLQELIKAPSRYNLRLKIRQLPADTKDAKPLLKEMKRGKEFHVIFDCSHEMAAGILKQALAMGMMTEYYHYIFTTLDLFALDVEPYRYSGVNMTGFRILNTENTQVSSIIEKWSMERLQAPPKPDSGLLDGFMTTDAALMYDAVHVVSVAVQQFPQMTVSSLQCNRHKPWRFGTRFMSLIKEAHWEGLTGRITFNKTNGLRTDFDLDVISLKEEGLEKIGTWDPASGLNMTESQKGKPANITDSLSNRSLIVTTILEEPYVLFKKSDKPLYGNDRFEGYCIDLLRELSTILGFTYEIRLVEDGKYGAQDDANGQWNGMVRELIDHKADLAVAPLAITYVREKVIDFSKPFMTLGISILYRKPNGTNPGVFSFLNPLSPDIWMYILLAYLGVSCVLFVIARFSPYEWYNPHPCNPDSDVVENNFTLLNSFWFGVGALMQQGSELMPKALSTRIVGGIWWFFTLIIISSYTANLAAFLTVERMESPIDSADDLAKQTKIEYGAVEDGATMTFFKKSKISTYDKMWAFMSSRRQSVLVKSNEEGIQRVLTSDYAFLMESTTIEFVTQRNCNLTQIGGLIDSKGYGVGTPMGSPYRDKITIAILQLQEEGKLHMMKEKWWRGNGCPEEESKEASALGVQNIGGIFIVLAAGLVLSVFVAVGEFLYKSKKNAQLEKESSIWLVPPYHPDTV

SEQ ID NO: 6227 - protein, 182 aa, Homo Sapiens
IGTWDPASGLNMTESQKGKPANITDSLSNRSLIVTTILEEPYVLFKKSDKPLYGNDRFEGYCIDLLRELSTILGFTYEIRLVEDGKYGAQDDANGQWNGMVRELIDHKADLAVAPLAITYVREKVIDFSKPFMTLGISILYRKPNGTNPGVFSFLNPLSPDIWMYILLAYLGVSCVLFVIAR

SEQ ID NO: 6228 - protein, 892 aa, Homo Sapiens
MKIIFPILSNPVFRRTVKLLLCLLWIGYSQGTTHVLRFGGIFEYVESGPMGAEELAFRFAVNTINRNRTLLPNTTLTYDTQKINLYDSFEASKKACDQLSLGVAAIFGPSHSSSANAVQSICNALGVPHIQTRWKHQVSDNKDSFYVSLYPDFSSLSRAILDLVQFFKWKTVTVVYDDSTGLIRLQELIKAPSRYNLRLKIRQLPADTKDAKPLLKEMKRGKEFHVIFDCSHEMAAGILKQALAMGMMTEYYHYIFTTLDLFALDVEPYRYSGVNMTGFRILNTENTQVSSIIEKWSMERLQAPPKPDSGLLDGFMTTDAALMYDAVHVVSVAVQQFPQMTVSSLQCNRHKPWRFGTRFMSLIKEAHWEGLTGRITFNKTNGLRTDFDLDVISLKEEGLEKIGTWDPASGLNMTESQKGKPANITDSLSNRSLIVTTILEEPYVLFKKSDKPLYGNDRFEGYCIDLLRELSTILGFTYEIRLVEDGKYGAQDDANGQWNGMVRELIDHKADLAVAPLAITYVREKVIDFSKPFMTLGISILYRKPNGTNPGVFSFLNPLSPDIWMYILLAYLGVSCVLFVIARFSPYEWYNPHPCNPDSDVVENNFTLLNSFWFGVGALMQQGSELMPKALSTRIVGGIWWFFTLIIISSYTANLAAFLTVERMESPIDSADDLAKQTKIEYGAVEDGATMTFFKKSKISTYDKMWAFMSSRRQSVLVKSNEEGIQRVLTSDYAFLMESTTIEFVTQRNCNLTQIGGLIDSKGYGVGTPMGSPYRDKITIAILQLQEEGKLHMMKEKWWRGNGCPEEESKEASALGVQNIGGIFIVLAAGLVLSVFVAVGEFLYKSKKNAQLEKRAKTKLPQDYVFLPILESVSISTVLSSSPSSSSLSSCS

SEQ ID NO: 6229 - protein, 353 aa, Homo Sapiens
MKIIFPILSNPVFRRTVKLLLCLLWIGYSQGTTHVLRFGGIFEYVESGPMGAEELAFRFAVNTINRNRTLLPNTTLTYDTQKINLYDSFEASKKACDQLSLGVAAIFGPSHSSSANAVQSICNALGVPHIQTRWKHQVSDNKDSFYVSLYPDFSSLSRAILDLVQFFKWKTVTVVYDDSTGLIRLQELIKAPSRYNLRLKIRQLPADTKDAKPLLKEMKRGKEFHVIFDCSHEMAAGILKQALAMGMMTEYYHYIFTTLDLFALDVEPYRYSGVNMTGFRILNTENTQVSSIIEKWSMERLQAPPKPDSGLLDGFMTMEFHSCCPGWSAMARSQLTATSASWVQAILLPQPPE

SEQ ID NO: 6230 - protein, 869 aa, Homo Sapiens
MKIIFPILSNPVFRRTVKLLLCLLWIGYSQGTTHVLRFGGIFEYVESGPMGAEELAFRFAVNTINRNRTLLPNTTLTYDTQKINLYDSFEASKKACDQLSLGVAAIFGPSHSSSANAVQSICNALGVPHIQTRWKHQVSDNKDSFYVSLYPDFSSLSRAILDLVQFFKWKTVTVVYDDSTGLIRLQELIKAPSRYNLRLKIRQLPADTKDAKPLLKEMKRGKEFHVIFDCSHEMAAGILKQALAMGMMTEYYHYIFTTLDLFALDVEPYRYSGVNMTGFRILNTENTQVSSIIEKWSMERLQAPPKPDSGLLDGFMTTDAALMYDAVHVVSVAVQQFPQMTVSSLQCNRHKPWRFGTRFMSLIKEAHWEGLTGRITFNKTNGLRTDFDLDVISLKEEGLEKIGTWDPASGLNMTESQKGKPANITDSLSNRSLIVTTILEEPYVLFKKSDKPLYGNDRFEGYCIDLLRELSTILGFTYEIRLVEDGKYGAQDDANGQWNGMVRELIDHKADLAVAPLAITYVREKVIDFSKPFMTLGISILYRKPNGTNPGVFSFLNPLSPDIWMYILLAYLGVSCVLFVIARFSPYEWYNPHPCNPDSDVVENNFTLLNSFWFGVGALMQQGSELMPKALSTRIVGGIWWFFTLIIISSYTANLAAFLTVERMESPIDSADDLAKQTKIEYGAVEDGATMTFFKKSKISTYDKMWAFMSSRRQSVLVKSNEEGIQRVLTSDYAFLMESTTIEFVTQRNCNLTQIGGLIDSKGYGVGTPMGSPYRDKITIAILQLQEEGKLHMMKEKWWRGNGCPEEESKEASALGVQNIGGIFIVLAAGLVLSVFVAVGEFLYKSKKNAQLEKESSIWLVPPYHPDTV

SEQ ID NO: 6231 - protein, 908 aa, Homo Sapiens
MKIIFPILSNPVFRRTVKLLLCLLWIGYSQGTTHVLRFGGIFEYVESGPMGAEELAFRFAVNTINRNRTLLPNTTLTYDTQKINLYDSFEASKKACDQLSLGVAAIFGPSHSSSANAVQSICNALGVPHIQTRWKHQVSDNKDSFYVSLYPDFSSLSRAILDLVQFFKWKTVTVVYDDSTGLIRLQELIKAPSRYNLRLKIRQLPADTKDAKPLLKEMKRGKEFHVIFDCSHEMAAGILKQALAMGMMTEYYHYIFTTLDLFALDVEPYRYSGVNMTGFRILNTENTQVSSIIEKWSMERLQAPPKPDSGLLDGFMTTDAALMYDAVHVVSVAVQQFPQMTVSSLQCNRHKPWRFGTRFMSLIKEAHWEGLTGRITFNKTNGLRTDFDLDVISLKEEGLEKIGTWDPASGLNMTESQKGKPANITDSLSNRSLIVTTILEEPYVLFKKSDKPLYGNDRFEGYCIDLLRELSTILGFTYEIRLVEDGKYGAQDDANGQWNGMVRELIDHKADLAVAPLAITYVREKVIDFSKPFMTLGISILYRKPNGTNPGVFSFLNPLSPDIWMYILLAYLGVSCVLFVIARFSPYEWYNPHPCNPDSDVVENNFTLLNSFWFGVGALMQQGSELMPKALSTRIVGGIWWFFTLIIISSYTANLAAFLTVERMESPIDSADDLAKQTKIEYGAVEDGATMTFFKKSKISTYDKMWAFMSSRRQSVLVKSNEEGIQRVLTSDYAFLMESTTIEFVTQRNCNLTQIGGLIDSKGYGVGTPMGSPYRDKITIAILQLQEEGKLHMMKEKWWRGNGCPEEESKEASALGVQNIGGIFIVLAAGLVLSVFVAVGEFLYKSKKNAQLEKRSFCSAMVEELRMSLKCQRRLKHKPQAPVIVKTEEVINMHTFNDRRLPGKETMA

SEQ ID NO: 6232 - protein, 46 aa, Homo Sapiens
ANLAAFMIQEEYVDQVSGLSDKKMRTLRLRRSIFPKVTKLVTEPGF

SEQ ID NO: 6233 - protein, 35 aa, Homo Sapiens
MKPRAECCSPKFWLVLAVLAVSGSRARSQKSPPSI

SEQ ID NO: 6234 - protein, 35 aa, Homo Sapiens; identical to SEQ ID NO: 6233

SEQ ID NO: 6235 - protein, 1484 aa, Homo Sapiens [sequence omitted]

SEQ ID NO: 6236 - protein, 70 aa, Homo Sapiens [sequence omitted]

SEQ ID NO: 6237 - protein, 435 aa, Homo Sapiens
MGSLLALLALLLLWGAVAEGPAKKVLTLEGDLVLGGLFPVHQKGGPAEDCGPVNEHRGIQRLEAMLFALDRINRDPHLLPGVRLGAHILDSCSKDTHALEQALDFVRASLSRGADGSRHICPDGSYATHGDAPTAITGVIGGSYSDVSIQVANLLRLFQIPQISYASTSAKLSDKSRYDYFARTVPPDFFQAKAMAEILRFFNWTYVSTVASEGDYGETGIEAFELEARARNICVATSEKVGRAMSRAAFEGVVRALLQKPSARVAVLFTRSEDARELLAASQRLNASFTWVASDGWGALESVVAGSEGAAEGAITIELASYPISDFASYFQSLDPWNNSRNPWFREFWEQRFRCSFRQRDCAAHSLRAVPFEQESKIMFVVNAVYAMAHALHNMHRALCPNTTRLCDAMRPVNGRRLYKDFVLNVKFDGDLKVS

SEQ ID NO: 6238 - protein, 872 aa, Homo Sapiens [sequence omitted]

SEQ ID NO: 6239 - protein, 594 aa, Homo Sapiens
MGSLLALLALLLLWGAVAEGPAKKVLTLEGDLVLGGLFPVHQKGGPAEDCGPVNEHRGIQRLEAMLFALDRINRDPHLLPGVRLGAHILDSCSKDTHALEQALDFVRASLSRGADGSRHICPDGSYATHGDAPTAITGVIGGSYSDVSIQVANLLRLFQIPQISYASTSAKLSDKSRYDYFARTVPPDFFQAKAMAEILRFFNWTYVSTVASEGDYGETGIEAFELEARARNICVATSEKVGRAMSRAAFEGVVRALLQKPSARVAVLFTRSEDARELLAASQRLNASFTWVASDGWGALESVVAGSEGAAEGAITIELASYPISDFASYFQSLDPWNNSRNPWFREFWEQRFRCSFRQRDCAAHSLRAVPFEQESKIMFVVNAVYAMAHALHNMHRALCPNTTRLCDAMRPVNGRRLYKDFVLNVKFDAPFRPADTHNEVRFDRFGDGIGRYNIFTYLRAGSGRYRYQKTRKCPENFNEAKFIGFTMYTTCIIWLAFLPIFYVTSSDYRVQTTTMCVSVSLSGSVVLGCLFAPKLHIILFQPQKNVVSHRAPTSRFGSAAARASSSLGQGSGSQFVPTVCNGREVVDSTTSSL

SEQ ID NO: 6240 - protein, 81 aa, Homo Sapiens
MKMLTRLQVLTLALFSKGFLLSLGDHNFLRREIKIEGDLVLGGLFPINEKGTGTEECGRINEDRGIQRLEAMLFAIDEINK

SEQ ID NO: 6241 - protein, 87 aa, Homo Sapiens
MKMLTRLQVLTLALFSKGFLLSLGDHNFLRREIKIEGDLVLGGLFPINEKGTGTEECGRINEDRGIQRLEAMLFAIDEINKDDYLLP

SEQ ID NO: 6242 - protein, 879 aa, Homo Sapiens
MKMLTRLQVLTLALFSKGFLLSLGDHNFLRREIKIEGDLVLGGLFPINEKGTGTEECGRINEDRGIQRLEAMLFAIDEINKDDYLLPGVKLGVHILDTCSRDTYALEQSLEFVRASLTKVDEAEYMCPDGSYAIQENIPLLIAGVIGGSYSSVSIQVANLLRLFQIPQISYASTSAKLSDKSRYDYFARTVPPDFYQAKAMAEILRFFNWTYVSTVASEGDYGETGIEAFEQEARLRNICIATAEKVGRSNIRKSYDSVIRELLQKPNARVVVLFMRSDDSRELIAAASRANASFTWVASDGWGAQESIIKGSEHVAYGAITLELASQPVRQFDRYFQSLNPYNNHRNPWFRDFWEQKFQCSLQNKRNHRRVCDKHLAIDSSNYEQESKIMFVVNAVYAMAHALHKMQRTLCPNTTKLCDAMKILDGKKLYKDYLLKINFTAPFNPNKDADSIVKFDTFGDGMGRYNVFNFQNVGGKYSYLKVGHWAETLSLDVNSIHWSRNSVPTSQCSDPCAPNEMKNMQPGDVCCWICIPCEPYEYLADEFTCMDCGSGQWPTADLTGCYDLPEDYIRWEDAWAIGPVTIACLGFMCTCMVVTVFIKHNNTPLVKASGRELCYILLFGVGLSYCMTFFFIAKPSPVICALRRLGLGSSFAICYSALLTKTNCIARIFDGVKNGAQRPKFISPSSQVFICLGLILVQIVMVSVWLILEAPGTRRYTLAEKRETVILKCNVKDSSMLISLTYDVILVILCTVYAFKTRKCPENFNEAKFIGFTMYTTCIIWLAFLPIFYVTSSDYRVQTTTMCISVSLSGFVVLGCLFAPKVHIILFQPQKNVVTHRLHLNRFSVSGTGTTYSQSSASTYVPTVCNGREVLDSTTSSL

SEQ ID NO: 6243 - protein, 537 aa, Homo Sapiens
MKMLTRLQVLTLALFSKGFLLSLGDHNFLRREIKIEGDLVLGGLFPINEKGTGTEECGRINEDRGIQRLEAMLFAIDEINKDDYLLPGVKLGVHILDTCSRDTYALEQSLEFVRASLTKVDEAEYMCPDGSYAIQENIPLLIAGVIGGSYSSVSIQVANLLRLFQIPQISYASTSAKLSDKSRYDYFARTVPPDFYQAKAMAEILRFFNWTYVSTVASEGDYGETGIEAFEQEARLRNICIATAEKVGRSNIRKSYDSVIRELLQKPNARVVVLFMRSDDSRELIAAASRANASFTWVASDGWGAQESIIKGSEHVAYGAITLELASQPVRQFDRYFQSLNPYNNHRNPWFRDFWEQKFQCSLQNKRNHRRVCDKHLAIDSSNYEQESKIMFVVNAVYAMAHALHKMQRTLCPNTTKLCDAMKILDGKKLYKDYLLKINFTGADDNHVHLCQPEWLCGLGLFVCTQGSHHPVSTPEECCHTQTAPQQVQCQWNWDHILSVLCKHVCANGVQWAGSPRLHHLISVIVNCSSVLVFLDC

SEQ ID NO: 6244 - protein, 171 aa, Homo Sapiens
MSQSPGAGSPPPLPPRSAPVPARSCRCEVANLLRLFQIPQISYASTSAKLSDKSRYDYFARTVPPDFYQAKAMAEILRFFNWTYVSTVASEGDYGETGIEAFEQEARLRNICIATAEKVGRSNIRKSYDSVIRELLQKPNARVVVLFMRSDDSRELIAAASRANASFTWVA

SEQ ID NO: 6245 - protein, 1212 aa, Homo Sapiens
MVLLLILSVLLLKEDVRGSAQSSERRVVAHMPGDIIIGALFSVHHQPTVDKVHERKCGAVREQYGIQRVEAMLHTLERINSDPTLLPNITLGCEIRDSCWHSAVALEQSIEFIRDSLISSEEEEGLVRCVDGSSSSFRSKKPIVGVIGPGSSSVAIQVQNLLQLFNIPQIAYSATSMDLSDKTLFKYFMRVVPSDAQQARAMVDIVKRYNWTYVSAVHTEGNYGESGMEAFKDMSAKEGICIAHSYKIYSNAGEQSFDKLLKKLTSHLPKARVVACFCEGMTVRGLLMAMRRLGLAGEFLLLGSDGWADRYDVTDGYQREAVGGITIKLQSPDVKWFDDYYLKLRPETNHRNPWFQEFWQHRFQCRLEGFPQENSKYNKTCNSSLTLKTHHVQDSKMGFVINAIYSMAYGLHNMQMSLCPGYAGLCDAMKPIDGRKLLESLMKTNFTGVSGDTILFDENGDSPGRYEIMNFKEMGKDYFDYINVGSWDNGELKMDDDEVWSKKSNIIRSVCSEPCEKGQIKVIRKGEVSCCWTCTPCKENEYVFDEYTCKACQLGSWPTDDLTGCDLIPVQYLRWGDPEPIAAVVFACLGLLATLFVTVVFIIYRDTPVVKSSSRELCYIILAGICLGYLCTFCLIAKPKQIYCYLQRIGIGLSPAMSYSALVTKTNRIARILAGSKKKICTKKPRFMSACAQLVIAFILICIQLGIIVALFIMEPPDIMHDYPSIREVYLICNTTNLGVVTPLGYNGLLILSCTFYAFKTRNVPANFNEAKYIAFTMYTTCIIWLAFVPIYFGSNYKIITMCFSVSLSATVALGCMFVPKVYIILAKPERNVRSAFTTSTVVRMHVGDGKSSSAASRSSSLVNLWKRRGSSGETLRYKDRRLAQHKSEIECFTPKGSMGNGGRATMSSSNGKSVTWAQNEKSSRGQHLWQRLSIHINKKENPNQTAVIKPFPKSTESRGLGAGAGAGGSAGGVGATGGAGCAGAGPGGPESPDAGPKALYDVAEAEEHFPAPARPRSPSPISTLSHRAGSASRTDDDVPSLHSEPVARSSSSQGSLMEQISSVVTRFTANISELNSMMLSTAAPSPGVGAPLCSSYLIPKEIQLPTTMTTFAEIQPLPAIEVTGGAQPAAGAQAAGDAARESPAAGPEAAAAKPDLEELVALTPPSPFRDSVDSGSTTPNSPVSESALCIPSSPKYDTLIIRDYTQSSSSL

SEQ ID NO: 6246 - protein, 1180 aa, Homo Sapiens
MVLLLILSVLLLKEDVRGSAQSSERRVVAHMPGDIIIGALFSVHHQPTVDKVHERKCGAVREQYGIQRVEAMLHTLERINSDPTLLPNITLGCEIRDSCWHSAVALEQSIEFIRDSLISSEEEEGLVRCVDGSSSSFRSKKPIVGVIGPGSSSVAIQVQNLLQLFNIPQIAYSATSMDLSDKTLFKYFMRVVPSDAQQARAMVDIVKRYNWTYVSAVHTEGNYGESGMEAFKDMSAKEGICIAHSYKIYSNAGEQSFDKLLKKLTSHLPKARVVACFCEGMTVRGLLMAMRRLGLAGEFLLLGSDGWADRYDVTDGYQREAVGGITIKLQSPDVKWFDDYYLKLRPETNHRNPWFQEFWQHRFQCRLEGFPQENSKYNKTCNSSLTLKTHHVQDSKMGFVINAIYSMAYGLHNMQMSLCPGYAGLCDAMKPIDGRKLLESLMKTNFTGVSGDTILFDENGDSPGRYEIMNFKEMGKDYFDYINVGSWDNGELKMDDDEVWSKKSNIIRSVCSEPCEKGQIKVIRKGEVSCCWTCTPCKENEYVFDEYTCKACQLGSWPTDDLTGCDLIPVQYLRWGDPEPIAAVVFACLGLLATLFVTVVFIIYRDTPVVKSSSRELCYIILAGICLGYLCTFCLIAKPKQIYCYLQRIGIGLSPAMSYSALVTKTNRIARILAGSKKKICTKKPRFMSACAQLVIAFILICIQLGIIVALFIMEPPDIMHDYPSIREVYLICNTTNLGVVTPLGYNGLLILSCTFYAFKTRNVPANFNEAKYIAFTMYTTCIIWLAFVPIYFGSNYKIITMCFSVSLSATVALGCMFVPKVYIILAKPERNVRSAFTTSTVVRMHVGDGKSSSAASRSSSLVNLWKRRGSSGETLSSNGKSVTWAQNEKSSRGQHLWQRLSIHINKKENPNQTAVIKPFPKSTESRGLGAGAGAGGSAGGVGATGGAGCAGAGPGGPESPDAGPKALYDVAEAEEHFPAPARPRSPSPISTLSHRAGSASRTDDDVPSLHSEPVARSSSSQGSLMEQISSVVTRFTANISELNSMMLSTAAPSPGVGAPLCSSYLIPKEIQLPTTMTTFAEIQPLPAIEVTGGAQPAAGAQAAGDAARESPAAGPEAAAAKPDLEELVALTPPSPFRDSVDSGSTTPNSPVSESALCIPSSPKYDTLIIRDYTQSSSSL

SEQ ID NO: 6247 - protein, 1180 aa, Homo Sapiens; identical to SEQ ID NO: 6246

SEQ ID NO: 6248 - protein, 298 aa, Homo Sapiens
MVLLLILSVLLLKEDVRGSAQSSERRVVAHMPGDIIIGALFSVHHQPTVDKVHERKCGAVREQYGIQRVEAMLHTLERINSDPTLLPNITLGCEIRDSCWHSAVALEQSIEFIRDSLISSEEEEGLVRCVDGSSSSFRSKKPIVGVIGPGSSSVAIQVQNLLQLFNIPQIAYSATSMDLSDKTLFKYFMRVVPSDAQQARAMVDIVKRYNWTYVSAVHTEGRGTKKEEMRKRDQTLMLSFMRCVFLRFEEIRWNDSLVYDALENENIQVLSLCFPSSAVIQINTFLSPIALINRLNVT

SEQ ID NO: 6249 - protein, 87 aa, Homo Sapiens
  misc_feature (1)..(1): Xaa can be any naturally occurring amino acid
XQIAYSATSMDLSDKTLFKYFMRVVPSDAQQARAMVDIVKRYNWTYVSAVHTEGRGTKKEEMRKRDQTLMLSFMRFKLFSCLSLQRS

SEQ ID NO: 6250 - protein, 37 aa, Homo Sapiens
MWTLVSWVALTAGLVAGTRCPDGQFCPVACCLDPGGA

SEQ ID NO: 6251 - protein, 62 aa, Homo Sapiens
MWTLVSWVALTAGLVAGTRCPDGQFCPVACCLDPGGASYSCCRPLLDKWPTTLSRHLGGPCQ

SEQ ID NO: 6252 - protein, 172 aa, Homo Sapiens
MWTLVSWVALTAGLVAGTRCPDGQFCPVACCLDPGGASYSCCRPLLDKWPTTLSRHLGGPCQVDAHCSAGHSCIFTVSGTSSCCPFPEASCCEDRVHCCPHGAFCDLVHTRCITPTGTHPLAKKLPAQRTNRAVALSSSVMCPDARSRCPDGSTCCELPSGKYGCCPMPNAT

SEQ ID NO: 6253 - protein, 111 aa, Homo Sapiens
MWTLVSWVALTAGLVAGTRCPDGQFCPVACCLDPGGASYSCCRPLLDKWPTTLSRHLGGPCQVDAHCSAGHSCIFTVSGTSSCCPFPEAVACGDGHHCCPRGFHCSADGRS

SEQ ID NO: 6254 - protein, 135 aa, Homo Sapiens
MWTLVSWVALTAGLVAGTRCPDGQFCPVACCLDPGGASYSCCRPLLDKWPTTLSRHLGGPCQVDAHCSAGHSCIFTVSGTSSCCPFPEAVACGDGHHCCPRGFHCSADGRSCFQRSGNNSVGAIQCPDSQFECPD

SEQ ID NO: 6255 - protein, 136 aa, Homo Sapiens
MWTLVSWVALTAGLVAGTRCPDGQFCPVACCLDPGGASYSCCRPLLDKWPTTLSRHLGGPCQVDAHCSAGHSCIFTVSGTSSCCPFPEAVACGDGHHCCPRGFHCSADGRSCFQRSGNNSVGAIQCPDSQFECPDF

SEQ ID NO: 6256 - protein, 142 aa, Homo Sapiens
MWTLVSWVALTAGLVAGTRCPDGQFCPVACCLDPGGASYSCCRPLLDKWPTTLSRHLGGPCQVDAHCSAGHSCIFTVSGTSSCCPFPEAVACGDGHHCCPRGFHCSADGRSCFQRSGNNSVGAIQCPDSQFECPDFSTCCVM

SEQ ID NO: 6257 - protein, 149 aa, Homo Sapiens
MWTLVSWVALTAGLVAGTRCPDGQFCPVACCLDPGGASYSCCRPLLDKWPTTLSRHLGGPCQVDAHCSAGHSCIFTVSGTSSCCPFPEAVACGDGHHCCPRGFHCSADGRSCFQRSGNNSVGAIQCPDSQFECPDFSTCCVMVDGSWGC

SEQ ID NO: 6258 - protein, 163 aa, Homo Sapiens
MWTLVSWVALTAGLVAGTRCPDGQFCPVACCLDPGGASYSCCRPLLDKWPTTLSRHLGGPCQVDAHCSAGHSCIFTVSGTSSCCPFPEAVACGDGHHCCPRGFHCSADGRSCFQRSGNNSVGAIQCPDSQFECPDFSTCCVMVDGSWGCCPMPQASCCEDRVH

SEQ ID NO: 6259 - protein, 593 aa, Homo Sapiens
MWTLVSWVALTAGLVAGTRCPDGQFCPVACCLDPGGASYSCCRPLLDKWPTTLSRHLGGPCQVDAHCSAGHSCIFTVSGTSSCCPFPEAVACGDGHHCCPRGFHCSADGRSCFQRSGNNSVGAIQCPDSQFECPDFSTCCVMVDGSWGCCPMPQASCCEDRVHCCPHGAFCDLVHTRCITPTGTHPLAKKLPAQRTNRAVALSSSVMCPDARSRCPDGSTCCELPSGKYGCCPMPNATCCSDHLHCCPQDTVCDLIQSKCLSKENATTDLLTKLPAHTVGDVKCDMEVSCPDGYTCCRLQSGAWGCCPFTQAVCCEDHIHCCPAGFTCDTQKGTCEQGPHQVPWMEKAPAHLSLPDPQALKRDVPCDNVSSCPSSDTCCQLTSGEWGCCPIPEAVCCSDHQHCCPQGYTCVAEGQCQRGSEIVAGLEKMPARRASLSHPRDIGCDQHTSCPVGQTCCPSLGGSWACCQLPHAVCCEDRQHCCPAGYTCNVKARSCEKEVVSAQPATFLARSPHVGVKDVECGEGHFCHDNQTCCRDNRQGWACCPYRQGVCCADRRHCCPAGFRCAARGTKCLRREAPRWDAPLRDPALRQLL

SEQ ID NO: 6260 - protein, 438 aa, Homo Sapiens
MWTLVSWVALTAGLVAGTRCPDGQFCPVACCLDPGGASYSCCRPLLDKWPTTLSRHLGGPCQVDAHCSAGHSCIFTVSGTSSCCPFPEAVACGDGHHCCPRGFHCSADGRSCFQRSGNNSVGAIQCPDSQFECPDFSTCCVMVDGSWGCCPMPQASCCEDRVHCCPHGAFCDLVHTRCITPTGTHPLAKKLPAQRTNRAVALSSSVMCPDARSRCPDGSTCCELPSGKYGCCPMPNATCCSDHLHCCPQDTVCDLIQSKCLSKENATTDLLTKLPAHTVGDVKCDMEVSCPDGYTCCRLQSGAWGCCPFTQAVCCEDHIHCCPAGFTCDTQKGTCEQGPHQVPWMEKAPAHLSLPDPQALKRDVPCDNVSSCPSSDTCCRDNRQGWACCPYRQGVCCADRRHCCPAGFRCAARGTKCLRREAPRWDAPLRDPALRQLL

SEQ ID NO: 6261 - protein, 436 aa, Homo Sapiens
MWTLVSWVALTAGLVAGTRCPDGQFCPVACCLDPGGASYSCCRPLLDKWPTTLSRHLGGPCQVDAHCSAGHSCIFTVSGTSSCCPFPEAVACGDGHHCCPRGFHCSADGRSCFQRSGNNSVGAIQCPDSQFECPDFSTCCVMVDGSWGCCPMPQAVCCEDHIHCCPAGFTCDTQKGTCEQGPHQVPWMEKAPAHLSLPDPQALKRDVPCDNVSSCPSSDTCCQLTSGEWGCCPIPEAVCCSDHQHCCPQGYTCVAEGQCQRGSEIVAGLEKMPARRASLSHPRDIGCDQHTSCPVGQTCCPSLGGSWACCQLPHAVCCEDRQHCCPAGYTCNVKARSCEKEVVSAQPATFLARSPHVGVKDVECGEGHFCHDNQTCCRDNRQGWACCPYRQGVCCADRRHCCPAGFRCAARGTKCLRREAPRWDAPLRDPALRQLL

SEQ ID NO: 6262 - protein, 189 aa, Homo Sapiens
MWTLVSWVALTAGLVAGTRCPDGQFCPVACCLDPGGASYSCCRPLLDKWPTTLSRHLGGPCQVDAHCSAGHSCIFTVSGTSSCCPFPEAVACGDGHHCCPRGFHCSADGRSCFQRSGNNSVGAIQCPDSQFECPDFSTCCVMVDGSWGCCPMPQGALLSARCLLRPGSHPLHHTHGHPPPGKEAPCPED

SEQ ID NO: 6263 - protein, 191 aa, Homo Sapiens
MWTLVSWVALTAGLVAGTRCPDGQFCPVACCLDPGGASYSCCRPLLDKWPTTLSRHLGGPCQVDAHCSAGHSCIFTVSGTSSCCPFPEIKGPCQCRFLCVPQAVACGDGHHCCPRGFHCSADGRSCFQRSGNNSVGAIQCPDSQFECPDFSTCCVMVDGSWGCCPMPQASCCEDRVHCCPHGAFCDLVHTR

SEQ ID NO: 6264 - protein, 388 aa, Homo Sapiens
  misc_feature (1)..(1): Xaa can be any naturally occurring amino acid
XAKKLPAQRTNRAVALSSSVMCPDARSRCPDGSTCCELPSGKYGCCPMPNATCCSDHLHCCPQDTVCDLIQSKCLSKENATTDLLTKLPAHTVGDVKCDMEVSCPDGYTCCRLQSGAWGCCPFTQAVCCEDHIHCCPAGFTCDTQKGTCEQGPHQVPWMEKAPAHLSLPDPQALKRDVPCDNVSSCPSSDTCCQLTSGEWGCCPIPEAVCCSDHQHCCPQGYTCVAEGQCQRGSEIVAGLEKMPARRASLSHPRDIGCDQHTSCPVGQTCCPSLGGSWACCQLPHAVCCEDRQHCCPAGYTCNVKARSCEKEVVSAQPATFLARSPHVGVKDVECGEGHFCHDNQTCCRDNRQGWACCPYRQVSANPHPGAGYGQGPGPTSSNPLAPL

SEQ ID NO: 6265 - protein, 110 aa, Homo Sapiens
  misc_feature (1)..(1): Xaa can be any naturally occurring amino acid
XCPSLGGSWACCQLPHAVCCEDRQHCCPAGYTCNVKARSCEKEVVSAQPATFLARSPHVGVKDVECGEGHFCHDNQTCCRDNRQGWACCPYRQPGVPSVCAGRPRAGTPL

SEQ ID NO: 6266 - protein, 138 aa, Homo Sapiens
MRGRELPLVLLALVLCLAPRGRAVPLPAGGGTVLTKMYPRGNHWAVGHLMGKKSTGESSSVSERGSLKQQLREYIRWEEAARNLLGLIEAKENRNHQPPQPKALGNQQPSWDSEDSSNFKDLVDSLLQVLNVKEGTPS

SEQ ID NO: 6267 - protein, 141 aa, Homo Sapiens
MRGRELPLVLLALVLCLAPRGRAVPLPAGGGTVLTKMYPRGNHWAVGHLMGKKSTGESSSVSERGSLKQQLREYIRWEEAARNLLGLIEAKENRNHQPPQPKALGNQQPSWDSEDSSNFKDVGSKGKGSQREGRNPQLNQQ

SEQ ID NO: 6268 - protein, 148 aa, Homo Sapiens
MRGRELPLVLLALVLCLAPRGRAVPLPAGGGTVLTKMYPRGNHWAVGHLMGKKSTGESSSVSERGSLKQQLREYIRWEEAARNLLGLIEAKENRNHQPPQPKALGNQQPSWDSEDSSNFKDVGSKGKVGRLSAPGSQREGRNPQLNQQ

SEQ ID NO: 6269 - protein, 96 aa, Homo Sapiens
  misc_feature (1)..(1): Xaa can be any naturally occurring amino acid
XHLMGKKSTGESSSVSERGSLKQQLREYIRWEEAARNLLGLIEAKENRNHQPPQPKALGNQQPSWDSEDSSNFKDVGSKGKDSLLQVLNVKEGTPS

SEQ ID NO: 6270 - protein, 35 aa, Homo Sapiens
  misc_feature (1)..(1): Xaa can be any naturally occurring amino acid
XISSLRGIQRIAATSKILSAPGSQREGRNPQLNQQ

SEQ ID NO: 6271 - protein, 496 aa, Homo Sapiens
MFAKATRNFLREVDADGDLIAVSNLNDSDKLQLLSLVTKKKRFWCWQRPKYQFLSLTLGDVLIEDQFPSPVVVESDFVKYEGKFANHVSGTLETALGKVKLNLGGSSRVESQSSFGTLRKQEVDLQQLIRDSAERTINLRNPVLQQVLEGRNEVLCVLTQKITTMQKCVISEHMQVEEKCGGIVGIQTKTVQVSATEDGNVTKDSNVVLEIPAATTIAYGVIELYVKLDGQFEFCLLRGKQGGFENKKRIDSVYLDPLVFREFAFIDMPDAAHGISSQDGPLSVLKQATLLLERNFHPFAELPEPQQTALSDIFQAVLFDDELLMVLEPVCDDLVSGLSPTVAVLGELKPRQQQDLVAFLQLVGCSLQGGCPGPEDAGSKQLFMTAYFLVSALAEMPDSAAALLGTCCKLQIIPTLCHLLRALSDDGVSDLEDPTLTPLKDTERFGIVQRLFASADISLERLKSSVKAVILKDSKVFPLLLCITLNGLCALGREHS

SEQ ID NO: 6272 - protein, 356 aa, Homo Sapiens
MFAKATRNFLREVDADGDLIAVSNLNDSDKLQLLSLVTKKKRFWCWQRPKYQFLSLTLGDVLIEDQFPSPVVVESDFVKYEGKFANHVSGTLETALGKVKLNLGGSSRVESQSSFGTLRKQEVDLQQLIRDSAERTINLRNPVLQQVLEGRNEVLCVLTQKITTMQKCVISEHMQVEEKCGGIVGIQTKTVQVSATEDGNVTKDSNVVLEIPAATTIAYGVIELYVKLDGQFEFCLLRGKQGGFENKKRIDSVYLDPLVFREFAFIDMPDAAHGISSQDGPLSVLKQATLLLERNFHPFAELPEPQQTALSDIFQAVLFDDELLMVLEPVVSPETSQGSVFTGVFWNRGGGRMELC

SEQ ID NO: 6273 - protein, 496 aa, Homo Sapiens; identical to SEQ ID NO: 6271

SEQ ID NO: 6274 - protein, 496 aa, Homo Sapiens; identical to SEQ ID NO: 6271

SEQ ID NO: 6275 - protein, 332 aa, Homo Sapiens
MQKCVISEHMQVEEKCGGIVGIQTKTVQVSATEDGNVTKDSNVVLEIPAATTIAYGVIELYVKLDGQFEFCLLRGKQGGFENKKRIDSVYLDPLVFREFAFIDMPDAAHGISSQDGPLSVLKQATLLLERNFHPFAELPEPQQTALSDIFQAVLFDDELLMVLEPVCDDLVSGLSPTVAVLGELKPRQQQDLVAFLQLVGCSLQGGCPGPEDAGSKQLFMTAYFLVSALAEMPDSAAALLGTCCKLQIIPTLCHLLRALSDDGVSDLEDPTLTPLKDTERFGIVQRLFASADISLERLKSSVKAVILKDSKVFPLLLCITLNGLCALGREHS

SEQ ID NO: 6276 - protein, 332 aa, Homo Sapiens; identical to SEQ ID NO: 6275

SEQ ID NO: 6277 - protein, 55 aa, Homo Sapiens
QLFMTAYFLVSALAEMPDSAAALLGTCCKLQIIPTLCHLVSNLPGGTLEWIGMGK

SEQ ID NO: 6278 - protein, 155 aa, Homo Sapiens
  misc_feature (1)..(1): Xaa can be any naturally occurring amino acid
XAATTIAYGVIELYVKLDGQFEFCLLRGKQGGFENKKRIDSVYLDPLVFREFAFIDMPDAAHGISSQDGPLSVLKQATLLLERNFHPFAELPEPQQTALSDIFQAVLFDDELLMVLEPVKDILGRSSSLTLSCTNGESHTSCQPSSHPDSVSSLS

SEQ ID NO: 6279 - protein, 192 aa, Homo Sapiens
  misc_feature (1)..(1): Xaa can be any naturally occurring amino acid
XEEKCGGIVGIQTKTVQVSATEDGNVTKDSNVVLEIPAATTIAYGVIELYVKLDGQFEFCLLRGKQGGFENKKRIDSVYLDPLVFREFAFIDMPDAAHGISSQDGPLSVLKQATLLLERNFHPFAELPEPQQTALSDIFQAVLFDDELLMVLEPVQKDILGRSSSLTLSCTNGESHTSCQPSSHPDSVSSLS

SEQ ID NO: 6280 - protein, 211 aa, Homo Sapiens
MAKMELSKAFSGQRTLLSAILSMLSLSFSTTSLLSNYWFVGTQKVPKPLCEKGLAAKCFDMPVSLDGDTNTSTQEVVQYNWETGDDRFSFRSFRSGMWLSCEETVEEPAKSEMEEELKKCVYLHLYLLLCHLALLHPQSWKQFRALRSSGTAAAKGERCRSFIELTPPAKRGEKGLLEFATLQGPCHPTLRFGGKRLMEKASLPSPPLGLC

SEQ ID NO: 6281 - protein, 298 aa, Homo Sapiens
MAKMELSKAFSGQRTLLSAILSMLSLSFSTTSLLSNYWFVGTQKVPKPLCEKGLAAKCFDMPVSLDGDTNTSTQEVVQYNWETGDDRFSFRSFRSGMWLSCEETVEEPALLHPQSWKQFRALRSSGTAAAKGERCRSFIELTPPAKRGLLGMVAHMMYSQVFQATVNLGPEDWRPHVWNYGWAFYMAWLSFTCCMASAVTTFNTYTRMVLEFKCKHSKSFKENPNCLPHHHQCFPRRLSSAAPTVGPLTSYHQYHNQPIHSVSEGVDFYSELRNKGFQRGASQELKEAVRSSVEEEQC

SEQ ID NO: 6282 - protein, 326 aa, Homo Sapiens
MAKMELSKAFSGQRTLLSAILSMLSLSFSTTSLLSNYWFVGTQKVPKPLCEKGLAAKCFDMPVSLDGDTNTSTQEVVQYNWETGDDRFSFRSFRSGMWLSCEETVEEPGERCRSFIELTPPAKREILWLSLGTQITYIGLQFISFLLLLTDLLLTGNPACGLKLSAFAAVSSVLSGLLGMVAHMMYSQVFQATVNLGPEDWRPHVWNYGWAFYMAWLSFTCCMASAVTTFNTYTRMVLEFKCKHSKSFKENPNCLPHHHQCFPRRLSSAAPTVGPLTSYHQYHNQPIHSVSEGVDFYSELRNKGFQRGASQELKEAVRSSVEEEQC

SEQ ID NO: 6283 - protein, 285 aa, Homo Sapiens
MAKMELSKAFSGQRTLLSAILSMLSLSFSTTSLLSNYWFVGTQKVPKPLCEKGLAAKCFDMPVSLDGDTNTSTQEVVQYNWETGDDRFSFRSFRSGMWLSCEETVEEPGERCRSFIELTPPAKRGEKGLLEFATLQGPCHPTLRFGGKRLMEKASLPSPPLGLCGKNPMVIPGNADHLHRTSIHQLPPATNRLATHWEPCLWAQTERLCCCFLCPVRSPGDGGPHDVFTSLPSDCQLGSRRLETTCLELWLGLLHGLALLHLLHGVGCHHLQHVHQDGAGVQVQA

SEQ ID NO: 6284 - protein, 275 aa, Homo Sapiens
MAKMELSKAFSGQRTLLSAILSMLSLSFSTTSLLSNYWFVGTQKVPKPLCEKGLAAKCFDMPVSLDGDTNTSTQEVVQYNWETGDDRFSFRSFRSGMWLSCEETVEEPGERCRSFIELTPPAKRGLLGMVAHMMYSQVFQATVNLGPEDWRPHVWNYGWAFYMAWLSFTCCMASAVTTFNTYTRMVLEFKCKHSKSFKENPNCLPHHHQCFPRRLSSAAPTVGPLTSYHQYHNQPIHSVSEGVDFYSELRNKGFQRGASQELKEAVRSSVEEEQC

SEQ ID NO: 6285 - protein, 220 aa, Homo Sapiens
MSDPSQLTQNVCLTQEMELSKAFSGQRTLLSAILSMLSLSFSTTSLLSNYWFVGTQKVPKPLCEKGLAAKCFDMPVSLDGDTNTSTQEVVQYNWETGDDRFSFRSFRSGMWLSCEETVEEPAKSEMEEELKKCVYLHLYLLLCHLALLHPQSWKQFRALRSSGTAAAKGERCRSFIELTPPAKREILWLSLGTQITYIGLQFISFLLLLTDLLLTGNPAC

SEQ ID NO: 6286 - protein, 321 aa, Homo Sapiens
MSDPSQLTQNVCLTQEMELSKAFSGQRTLLSAILSMLSLSFSTTSLLSNYWFVGTQKVPKPLCEKGLAAKCFDMPVSLDGDTNTSTQEVVQYNWETGDDRFSFRSFRSGMWLSCEETVEEPALLHPQSWKQFRALRSSGTAAAKGERCRSFIELTPPAKRGEKGLLEFATLQGPCHPTLRFGGKRLMEKASLPSPPLGLCGKNPMVIPGNADHLHRTSIHQLPPATNRLATHWEPCLWAQTERLCCCFLCPVRSPGDGGPHDVFTSLPSDCQLGSRRLETTCLELWLGLLHGLALLHLLHGVGCHHLQHVHQDGAGVQVQA

SEQ ID NO: 6287 - protein, 339 aa, Homo Sapiens
MSDPSQLTQNVCLTQEMELSKAFSGQRTLLSAILSMLSLSFSTTSLLSNYWFVGTQKVPKPLCEKGLAAKCFDMPVSLDGDTNTSTQEVVQYNWETGDDRFSFRSFRSGMWLSCEETVEEPGERCRSFIELTPPAKREILWLSLGTQITYIGLQFISFLLLLTDLLLTGNPACGLKLSAFAAVSSVLSGLLGMVAHMMYSQVFQATVNLGPEDWRPHVWNYGWAFYMAWLSFTCCMASAVTTFNTYTRMVLEFKCKHSKSFKENPNCLPHHHQCFPRRLSSAAPTVGPLTSYHQYHNQPIHSVSEGVDFYSELRNKGFQRGASQELKEAVRSSVEEEQC

SEQ ID NO: 6288 - protein, 236 aa, Homo Sapiens
MSDPSQLTQNVCLTQEMELSKAFSGQRTLLSAILSMLSLSFSTTSLLSNYWFVGTQKVPKPLCEKGLAAKCFDMPVSLDGDTNTSTQEVVQYNWETGDDRFSFRSFRSGMWLSCEETVEEPGERCRSFIELTPPAKRGEKGLLEFATLQGPCHPTLRFGGKRLMEKASLPSPPLGLCGKNPMVIPGNADHLHRTSIHQLPPATNRLATHWEPCLWAQTERLCCCFLCPVRSPGDGG

SEQ ID NO: 6289 - protein, 748 aa, Homo Sapiens
MAEEEALRGNSDPWPNSMVVEHPEFLKAGKEPGLQIWRVEKFDLVPVPTNLYGDFFTGDAYVILKTVQLRNGNLQYDLHYWLGNECSQDESGAAAIFTVQLDDYLNGRAVQHREVQGFESATFLGYFKSGLKYKKGGVASGFKHVVPNEVVVQRLFQVKGRRVVRATEVPVSWESFNNGDCFILDLGNNIHQWCGSNSNRYERLKATQVSKGIRDNERSGRARVHVSEEGTEPEAMLQVLGPKPALPAGTEDTAKEDAANRKLAKLYKVSNGAGTMSVSLVADENPFAQGALKSEDCFILDHGKDGKIFVWKGKQANTEERKAALKTASDFITKMDYPKQTQVSVLPEGGETPLFKQFFKNWRDPDQTDGLGLSYLSSHIANVERVPFDAATLHTSTAMAAQHGMDDDGTGQKQIWRIEGSNKVPVDPATYGQFYGGDSYIILYNYRHGGRQGQIIYNWQGAQSTQDEVAASAILTAQLDEELGGTPVQSRVVQGKEPAHLMSLFGGKPMIIYKGGTSREGGQTAPASTRLFQVRANSAGATRAVEVLPKAGALNSNDAFVLKTPSAAYLWVGTGASEAEKTGAQELLRVLRAQPVQVAEGSEPDGFWEALGGKAAYRTSPRLKDKKMDAHPPRLFACSNKIGRFVIEEVPGELMQEDLATDDVMLLDTWDQVFVWVGKDSQEEEKTEALTSAKRYIETDPANRDRRTPITVVKQGFEPPSFVGWFLGWDDDYWSVDPLDRAMAELAA

SEQ ID NO: 6290 - protein, 782 aa, Homo Sapiens
MAPHRPAPALLCALSLALCALSLPVRAATASRGASQAGAPQGRVPEARPNSMVVEHPEFLKAGKEPGLQIWRVEKFDLVPVPTNLYGDFFTGDAYVILKTVQLRNGNLQYDLHYWLGNECSQDESGAAAIFTVQLDDYLNGRAVQHREVQGFESATFLGYFKSGLKYKKGGVASGFKHVVPNEVVVQRLFQVKGRRVVRATEVPVSWESFNNGDCFILDLGNNIHQWCGSNSNRYERLKATQVSKGIRDNERSGRARVHVSEEGTEPEAMLQVLGPKPALPAGTEDTAKEDAANRKLAKLYKVSNGAGTMSVSLVADENPFAQGALKSEDCFILDHGKDGKIFVWKGKQANTEERKAALKTASDFITKMDYPKQTQVSVLPEGGETPLFKQFFKNWRDPDQTDGLGLSYLSSHIANVERVPFDAATLHTSTAMAAQHGMDDDGTGQKQIWRIEGSNKVPVDPATYGQFYGGDSYIILYNYRHGGRQGQIIYNWQGAQSTQDEVAASAILTAQLDEELGGTPVQSRVVQGKEPAHLMSLFGGKPMIIYKGGTSREGGQTAPASTRLFQVRANSAGATRAVEVLPKAGALNSNDAFVLKTPSAAYLWVGTGASEAEKTGAQELLRVLRAQPVQVAEGSEPDGFWEALGGKAAYRTSPRLKDKKMDAHPPRLFACSNKIGRFVIEEVPGELMQEDLATDDVMLLDTWDQVFVWVGKDSQEEEKTEALTSAKRYIETDPANRDRRTPITVVKQGFEPPSFVGWFLGWDDDYWSVDPLDRAMAELAA

SEQ ID NO: 6291 - protein, 232 aa, Homo Sapiens
MEKLFCCFPNSMVVEHPEFLKAGKEPGLQIWRVEKFDLVPVPTNLYGDFFTGDAYVILKTVQLRNGNLQYDLHYWLGNECSQDESGAAAIFTVQLDDYLNGRAVQHREVQGFESATFLGYFKSGLKYKKGGVASGFKHVVPNEVVVQRLFQVKGRRVVRATEVPVSWESFNNGDCFILDLGNNIHQWCGSNSNRYERLKATQVSKGIRDNERSGRARVHVSEEGTEPEAMLQ

SEQ ID NO: 6292 - protein, 742 aa, Homo Sapiens
MEKLFCCFPNSMVVEHPEFLKAGKEPGLQIWRVEKFDLVPVPTNLYGDFFTGDAYVILKTVQLRNGNLQYDLHYWLGNECSQDESGAAAIFTVQLDDYLNGRAVQHREVQGFESATFLGYFKSGLKYKKGGVASGFKHVVPNEVVVQRLFQVKGRRVVRATEVPVSWESFNNGDCFILDLGNNIHQWCGSNSNRYERLKATQVSKGIRDNERSGRARVHVSEEGTEPEAMLQVLGPKPALPAGTEDTAKEDAANRKLAKLYKVSNGAGTMSVSLVADENPFAQGALKSEDCFILDHGKDGKIFVWKGKQANTEERKAALKTASDFITKMDYPKQTQVSVLPEGGETPLFKQFFKNWRDPDQTDGLGLSYLSSHIANVERVPFDAATLHTSTAMAAQHGMDDDGTGQKQIWRIEGSNKVPVDPATYGQFYGGDSYIILYNYRHGGRQGQIIYNWQGAQSTQDEVAASAILTAQLDEELGGTPVQSRVVQGKEPAHLMSLFGGKPMIIYKGGTSREGGQTAPASTRLFQVRANSAGATRAVEVLPKAGALNSNDAFVLKTPSAAYLWVGTGASEAEKTGAQELLRVLRAQPVQVAEGSEPDGFWEALGGKAAYRTSPRLKDKKMDAHPPRLFACSNKIGRFVIEEVPGELMQEDLATDDVMLLDTWDQVFVWVGKDSQEEEKTEALTSAKRYIETDPANRDRRTPITVVKQGFEPPSFVGWFLGWDDDYWSVDPLDRAMAELAA

SEQ ID NO: 6293 - protein, 767 aa, Homo Sapiens
MNTGLTRLLWPSWLPDGDMSHPQPELFLFPKAQPNSMVVEHPEFLKAGKEPGLQIWRVEKFDLVPVPTNLYGDFFTGDAYVILKTVQLRNGNLQYDLHYWLGNECSQDESGAAAIFTVQLDDYLNGRAVQHREVQGFESATFLGYFKSGLKYKKGGVASGFKHVVPNEVVVQRLFQVKGRRVVRATEVPVSWESFNNGDCFILDLGNNIHQWCGSNSNRYERLKATQVSKGIRDNERSGRARVHVSEEGTEPEAMLQVLGPKPALPAGTEDTAKEDAANRKLAKLYKVSNGAGTMSVSLVADENPFAQGALKSEDCFILDHGKDGKIFVWKGKQANTEERKAALKTASDFITKMDYPKQTQVSVLPEGGETPLFKQFFKNWRDPDQTDGLGLSYLSSHIANVERVPFDAATLHTSTAMAAQHGMDDDGTGQKQIWRIEGSNKVPVDPATYGQFYGGDSYIILYNYRHGGRQGQIIYNWQGAQSTQDEVAASAILTAQLDEELGGTPVQSRVVQGKEPAHLMSLFGGKPMIIYKGGTSREGGQTAPASTRLFQVRANSAGATRAVEVLPKAGALNSNDAFVLKTPSAAYLWVGTGASEAEKTGAQELLRVLRAQPVQVAEGSEPDGFWEALGGKAAYRTSPRLKDKKMDAHPPRLFACSNKIGRFVIEEVPGELMQEDLATDDVMLLDTWDQVFVWVGKDSQEEEKTEALTSAKRYIETDPANRDRRTPITVVKQGFEPPSFVGWFLGWDDDYWSVDPLDRAMAELAA

SEQ ID NO: 6294 - protein, 739 aa, Homo Sapiens
MPLCTPNSMVVEHPEFLKAGKEPGLQIWRVEKFDLVPVPTNLYGDFFTGDAYVILKTVQLRNGNLQYDLHYWLGNECSQDESGAAAIFTVQLDDYLNGRAVQHREVQGFESATFLGYFKSGLKYKKGGVASGFKHVVPNEVVVQRLFQVKGRRVVRATEVPVSWESFNNGDCFILDLGNNIHQWCGSNSNRYERLKATQVSKGIRDNERSGRARVHVSEEGTEPEAMLQVLGPKPALPAGTEDTAKEDAANRKLAKLYKVSNGAGTMSVSLVADENPFAQGALKSEDCFILDHGKDGKIFVWKGKQANTEERKAALKTASDFITKMDYPKQTQVSVLPEGGETPLFKQFFKNWRDPDQTDGLGLSYLSSHIANVERVPFDAATLHTSTAMAAQHGMDDDGTGQKQIWRIEGSNKVPVDPATYGQFYGGDSYIILYNYRHGGRQGQIIYNWQGAQSTQDEVAASAILTAQLDEELGGTPVQSRVVQGKEPAHLMSLFGGKPMIIYKGGTSREGGQTAPASTRLFQVRANSAGATRAVEVLPKAGALNSNDAFVLKTPSAAYLWVGTGASEAEKTGAQELLRVLRAQPVQVAEGSEPDGFWEALGGKAAYRTSPRLKDKKMDAHPPRLFACSNKIGRFVIEEVPGELMQEDLATDDVMLLDTWDQVFVWVGKDSQEEEKTEALTSAKRYIETDPANRDRRTPITVVKQGFEPPSFVGWFLGWDDDYWSVDPLDRAMAELAA

SEQ ID NO: 6295 - protein, 731 aa, Homo Sapiens
MVVEHPEFLKAGKEPGLQIWRVEKFDLVPVPTNLYGDFFTGDAYVILKTVQLRNGNLQYDLHYWLGNECSQDESGAAAIFTVQLDDYLNGRAVQHREVQGFESATFLGYFKSGLKYKKGGVASGFKHVVPNEVVVQRLFQVKGRRVVRATEVPVSWESFNNGDCFILDLGNNIHQWCGSNSNRYERLKATQVSKGIRDNERSGRARVHVSEEGTEPEAMLQVLGPKPALPAGTEDTAKEDAANRKLAKLYKVSNGAGTMSVSLVADENPFAQGALKSEDCFILDHGKDGKIFVWKGKQANTEERKAALKTASDFITKMDYPKQTQVSVLPEGGETPLFKQFFKNWRDPDQTDGLGLSYLSSHIANVERVPFDAATLHTSTAMAAQHGMDDDGTGQKQIWRIEGSNKVPVDPATYGQFYGGDSYIILYNYRHGGRQGQIIYNWQGAQSTQDEVAASAILTAQLDEELGGTPVQSRVVQGKEPAHLMSLFGGKPMIIYKGGTSREGGQTAPASTRLFQVRANSAGATRAVEVLPKAGALNSNDAFVLKTPSAAYLWVGTGASEAEKTGAQELLRVLRAQPVQVAEGSEPDGFWEALGGKAAYRTSPRLKDKKMDAHPPRLFACSNKIGRFVIEEVPGELMQEDLATDDVMLLDTWDQVFVWVGKDSQEEEKTEALTSAKRYIETDPANRDRRTPITVVKQGFEPPSFVGWFLGWDDDYWSVDPLDRAMAELAA

SEQ ID NO: 6296 - protein, 260 aa, Homo Sapiens
MVVEHPEFLKAGKEPGLQIWRVEKFDLVPVPTNLYGDFFTGDAYVILKTVQLRNGNLQYDLHYWLGNECSQDESGAAAIFTVQLDDYLNGRAVQHREVQGFESATFLGYFKSGLKYKKGGVASGFKHVVPNEVVVQRLFQVKGRRVVRATEVPVSWESFNNGDCFILDLGNNIHQWCGSNSNRYERLKATQVSKGIRDNERSGRARVHVSEEGTEPEAMLQVLGPKPALPAGTEDTAKEDAANRKLAKLYKVSNGAGTMS

SEQ ID NO: 6297 - protein, 67 aa, Homo Sapiens
  misc_feature (1)..(1): Xaa can be any naturally occurring amino acid
XKGGTSREGGQTAPASTRLFQVRANSAGATRAVEVISRSWNTEGIGLPETSQLNDQISRHRNGGRGW

SEQ ID NO: 6298 - protein, 329 aa, Homo Sapiens
MESFLTSMGKFMKLIPDHRPKDLESIIRPKCQVIYFPIRFPDVSRFMPKHKTTHLKKMLGLKGNGGAVLSMALPFQPEQRDSEDLLKNFNSECDTHCGLDTARQEYLGNSLRQESDLKKSTSSDNSSSHHGENKQNLTVDPCDILGGVDNQQRLLHIVWPHRWEHDKDPESFFKVLMHLKDLGLNFHVSVLGETFTDVPDIFSEAKKALGSSVLHWGYLPSKDDYFQVLCMADVVISTAKHEFFGVAMLEAVYCGCYPLCPKDLVYPEIFPAEYLYSTPEQLSKRLQNFCKRPDIIRKHLYKGEIAPFSWAALHGKFRSLLTTEPREDL

SEQ ID NO: 6299 - protein, 426 aa, Homo Sapiens
MLTLHVWIWFGFMPCPNLMQNYNHQCCRTLFASSVLNLTELAALRPDLGKLKKILYFHENQLIYPVKKCQERDFQYGYNQILSCLVADVVVFNSVFNMESFLTSMGKFMKLIPDHRPKDLESIIRPKCQVIYFPIRFPDVSRFMPKHKTTHLKKMLGLKGNGGAVLSMALPFQPEQRDSEDLLKNFNSECDTHCGLDTARQEYLGNSLRQESDLKKSTSSDNSSSHHGENKQNLTVDPCDILGGVDNQQRLLHIVWPHRWEHDKDPESFFKVLMHLKDLGLNFHVSVLGETFTDVPDIFSEAKKALGSSVLHWGYLPSKDDYFQVLCMADVVISTAKHEFFGVAMLEAVYCGCYPLCPKDLVYPEIFPAEYLYSTPEQLSKRLQNFCKRPDIIRKHLYKGEIAPFSWAALHGKFRSLLTTEPREDL

SEQ ID NO: 6300 - protein, 66 aa, Homo Sapiens
MSILIIEAFYGGSHKQLVDLLQEELGDCVVYTLPAKKWHWRARTSALYFSQTIPISEHYRQSEITN

SEQ ID NO: 6301 - protein, 66 aa, Homo Sapiens; identical to SEQ ID NO: 6300

SEQ ID NO: 6302 - protein, 99 aa, Homo Sapiens
MSILIIEAFYGGSHKQLVDLLQEELGDCVVYTLPAKKWHWRARTSALYFSQTIPISEHYRTLFASSVLNLTELAALRPDLGKLKKILYFHENQLIYPVK

SEQ ID NO: 6303 - protein, 173 aa, Homo Sapiens
MSILIIEAFYGGSHKQLVDLLQEELGDCVVYTLPAKKWHWRARTSALYFSQTIPISEHYRTLFASSVLNLTELAALRPDLGKLKKILYFHENQLIYPVKKCQERDFQYGYNQILSCLVADVVVFNSVFNMESFLTSMGKFMKLIPDHRPKDLESIIRPKCQVIYFPIRFPDVS

SEQ ID NO: 6304 - protein, 340 aa, Homo Sapiens
MSILIIEAFYGGSHKQLVDLLQEELGDCVVYTLPAKKWHWRARTSALYFSQTIPISEHYRTLFASSVLNLTELAALRPDLGKLKKILYFHENQLIYPVKKCQERDFQYGYNQILSCLVADVVVFNSVFNMESFLTSMGKFMKLIPDHRPKDLESIIRPKCQVIYFPIRFPDVSREHDKDPESFFKVLMHLKDLGLNFHVSVLGETFTDVPDIFSEAKKALGSSVLHWGYLPSKDDYFQVLCMADVVISTAKHEFFGVAMLEAVYCGCYPLCPKDLVYPEIFPAEYLYSTPEQLSKRLQNFCKRPDIIRKHLYKGEIAPFSWAALHGKFRSLLTTEPREDL

SEQ ID NO: 6305 - protein, 376 aa, Homo Sapiens
MSILIIEAFYGGSHKQLVDLLQEELGDCVVYTLPAKKWHWRARTSALYFSQTIPISEHYRTLFASSVLNLTELAALRPDLGKLKKILYFHENQLIYPVKKCQERDFQYGYNQILSCLVADVVVFNSVFNMESFLTSMGKFMKLIPDHRPKDLESIIRPKCQVIYFPIRFPDVSRFMPKHKTTHLKKMLGLKGNGGAVLSMALPFQPEQRDSEDLLKNFNSECDTHCGLDTARQEYLGNSLRQESDLKKSTSSDNSSSHHGENKQNLTVDPCDILGGVDNQQRLLHIVWPHRWEHDKDPESFFKVLMHLKDLGLNFHVSVLGETFTDVPGWKLCTVGVTHFVLKIWFIPKYFQLNICILHLNSFQKGSRISARDQIL

SEQ ID NO: 6306 - protein, 458 aa, Homo Sapiens
MSILIIEAFYGGSHKQLVDLLQEELGDCVVYTLPAKKWHWRARTSALYFSQTIPISEHYRTLFASSVLNLTELAALRPDLGKLKKILYFHENQLIYPVKKCQERDFQYGYNQILSCLVADVVVFNSVFNMESFLTSMGKFMKLIPDHRPKDLESIIRPKCQVIYFPIRFPDVSRFMPKHKTTHLKKMLGLKGNGGAVLSMALPFQPEQRDSEDLLKNFNSECDTHCGLDTARQEYLGNSLRQESDLKKSTSSDNSSSHHGENKQNLTVDPCDILGGVDNQQRLLHIVWPHRWEHDKDPESFFKVLMHLKDLGLNFHVSVLGETFTDVPDIFSEAKKALGSSVLHWGYLPSKDDYFQVLCMADVVISTAKHEFFGVAMLEAVYCGCYPLCPKDLVYPEIFPAEYLYSTPEQLSKRLQNFCKRPDIIRKHLYKGEIAPFSWAALHGKFRSLLTTEPREDL

SEQ ID NO: 6307 - protein, 373 aa, Homo Sapiens
MSILIIEAFYGGSHKQLVDLLQEELGDCVVYTLPAKKWHWRARTSALYFSQTIPISEHYRTLFASSVLNLTELAALRPDLGKLKKILYFHENQLIYPVKKCQERDFQYGYNQILSCLVADVVVFNSVFNMESFLTSMGKFMKLIPDHRPKDLESIIRPKCQVIYFPIRFPDVSRFMPKHKTTHLKKMLGLKGNGGAVLSMALPFQPEQRDSEDLLKNFNSECDTHCGLDTARQEYLGNSLRQESDLKKSTSSDNSSSHHGENKQNLTVDPCDILGGVDNQQRLLHIVWPHRWLEAVYCGCYPLCPKDLVYPEIFPAEYLYSTPEQLSKRLQNFCKRPDIIRKHLYKGEIAPFSWAALHGKFRSLLTTEPREDL

SEQ ID NO: 6308 - protein, 376 aa, Homo Sapiens; identical to SEQ ID NO: 6305

SEQ ID NO: 6309 - protein, 458 aa, Homo Sapiens; identical to SEQ ID NO: 6306

SEQ ID NO: 6310 - protein, 458 aa, Homo Sapiens; identical to SEQ ID NO: 6306

SEQ ID NO: 6311 - protein, 458 aa, Homo Sapiens; identical to SEQ ID NO: 6306

SEQ ID NO: 6312 - protein, 236 aa, Homo Sapiens
MRTVSLCHPDWSALASSWLTAASTSWAQYGNFIDKLRLFTRGGSGGMGYPRLGGEGGKGGDVWVVAQNRMTLKQLKDRYPRKRFVAGVGANSKISALKGSKGKDCEIPVPVGISVTDENGKIIGELNKENDRILVAQGGLGGKLLTNFLPLKGQKRIIHLDLKLIADVGLVGFPNAGKSSLLSCVSHAKPAIADYAFTTLKPELGKIMYSDFKQISVADLPGLIEGAHMNKGMGHK

SEQ ID NO: 6313 - protein, 107 aa, Homo Sapiens
MRYGNFIDKLRLFTRGGSGGMGYPRLGGEGGKGGDVWVVAQNRMTLKQLKDRYPRKRFVAGVGANSKISALKGSKGKDCEIPVPVGISVTDENGKIIDSQMLENPLC

SEQ ID NO: 6314 - protein, 210 aa, Homo Sapiens
MRYGNFIDKLRLFTRGGSGGMGYPRLGGEGGKGGDVWVVAQNRMTLKQLKDRYPRKRFVAGVGANSKISALKGSKGKDCEIPVPVGISVTDENGKIIGELNKENDRILVAQGGLGGKLLTNFLPLKGQKRIIHLDLKLIADVGLVGFPNAGKSSLLSCVSHAKPAIADYAFTTLKPELGKIMYSDFKQISVADLPGLIEGAHMNKGMGHK

SEQ ID NO: 6315 - protein, 70 aa, Homo Sapiens
MRYGNFIDKLRLFTRGGSGGMGYPRLGGEGGKGGDVWVVAQNRMTLKQLKDRYPRKRFVAGVGANSKRTQ

SEQ ID NO: 6316 - protein, 308 aa, Homo Sapiens
MVHCSCVLFRKYGNFIDKLRLFTRGGSGGMGYPRLGGEGGKGGDVWVVAQNRMTLKQLKDRYPRKRFVAGVGANSKFPNAGKSSLLSCVSHAKPAIADYAFTTLKPELGKIMYSDFKQISVADLPGLIEGAHMNKGMGHKFLKHIERTRQLLFVVDISGFQLSSHTQYRTAFETIILLTKELELYKEELQTKPALLAVNKMDLPDAQDKFHELMSQLQNPKDFLHLFEKNMIPERTVEFQHIIPISAVTGEGIEELKNCIRKSLDEQANQENDALHKKQLLNLWISDTMSSTEPPSKHAVTTSKMDII

SEQ ID NO: 6317 - protein, 116 aa, Homo Sapiens
MVHCSCVLFRKYGNFIDKLRLFTRGGSGGMGYPRLGGEGGKGGDVWVVAQNRMTLKQLKDRYPRKRFVAGVGANSKISALKGSKGKDCEIPVPVGISVTDENGKIIDSQMLENPLC

SEQ ID NO: 6318 - protein, 387 aa, Homo Sapiens
MVHCSCVLFRKYGNFIDKLRLFTRGGSGGMGYPRLGGEGGKGGDVWVVAQNRMTLKQLKDRYPRKRFVAGVGANSKISALKGSKGKDCEIPVPVGISVTDENGKIIGELNKENDRILVAQGGLGGKLLTNFLPLKGQKRIIHLDLKLIADVGLVGFPNAGKSSLLSCVSHAKPAIADYAFTTLKPELGKIMYSDFKQISVADLPGLIEGAHMNKGMGHKFLKHIERTRQLLFVVDISGFQLSSHTQYRTAFETIILLTKELELYKEELQTKPALLAVNKMDLPDAQDKFHELMSQLQNPKDFLHLFEKNMIPERTVEFQHIIPISAVTGEGIEELKNCIRKSLDEQANQENDALHKKQLLNLWISDTMSSTEPPSKHAVTTSKMDII

SEQ ID NO: 6319 - protein, 243 aa, Homo Sapiens
MVHCSCVLFRKYGNFIDKLRLFTRGGSGGMGYPRLGGEGGKGGDVWVVAQNRMTLKQLKDRYPRKRFVAGVGANSKISALKGSKGKDCEIPVPVGISVTDENGKIIVTTLKPELGKIMYSDFKQISVADLPGLIEGAHMNKGMGHKFLKHIERTRQLLFVVDISGFQLSSHTQYRTAFETIILLTKELELYKEELQTKPALLAVNKMDLPDAQDKFHELMSQLQNPKDFLHLFEKNMIPERTV

SEQ ID NO: 6320 - protein, 79 aa, Homo Sapiens
MVHCSCVLFRKYGNFIDKLRLFTRGGSGGMGYPRLGGEGGKGGDVWVVAQNRMTLKQLKDRYPRKRFVAGVGANSKRTQ

SEQ ID NO: 6321 - protein, 115 aa, Homo Sapiens
MNAFLLSALCLLGAWAALAGGVTVQDGNFSFSLESVKKLKDLQEPQEPRVGKLRNFAPIPGEPVVPILCSNPNFPEELKPLCKEPNAQEILQRLEEIAEDPGTCEICAYAACTGC

SEQ ID NO: 6322 - protein, 112 aa, Homo Sapiens
MGCRAASGLLPGVAVVLLLLLQSTQSVYIQYQGFRVQLESMKKLSDLEAQWAPSPRLQAQSLLPAVCHHPALPQDLQPVCASQEASSIFKTLRTIANDDCELCVNVACTGCL

SEQ ID NO: 6323 - protein, 134 aa, Homo Sapiens
MARGSAVAWAALGPLLWGCALGLQGGMLYPQESPSRECKELDGLWSFRADFSDNRRRGFEEQWYRRPLWESGPTVDMPVPSSFNDISQDWRLRHFVGWVWYEREVILPERWTQDLRTRVVLRIGSAHSYAIVGW

SEQ ID NO: 6324 - protein, 144 aa, Homo Sapiens
MARGSAVAWAALGPLLWGCALGLQGGMLYPQESPSRECKELDGLWSFRADFSDNRRRGFEEQWYRRPLWESGPTVDMPVPSSFNDISQDWRLRHFVGWVWYEREVILPERWTQDLRTRVVLRIGSAHSYAIVVSQGLLCPEHIF

SEQ ID NO: 6325 - protein, 144 aa, Homo Sapiens; identical to SEQ ID NO: 6324

SEQ ID NO: 6326 - protein, 651 aa, Homo Sapiens
MARGSAVAWAALGPLLWGCALGLQGGMLYPQESPSRECKELDGLWSFRADFSDNRRRGFEEQWYRRPLWESGPTVDMPVPSSFNDISQDWRLRHFVGWVWYEREVILPERWTQDLRTRVVLRIGSAHSYAIVWVNGVDTLEHEGGYLPFEADISNLVQVGPLPSRLRITIAINNTLTPTTLPPGTIQYLTDTSKYPKGYFVQNTYFDFFNYAGLQRSVLLYTTPTTYIDDITVTTSVEQDSGLVNYQISVKGSNLFKLEVRLLDAENKVVANGTGTQGQLKVPGVSLWWPYLMHERPAYLYSLEVQLTAQTSLGPVSDFYTLPVGIRTVAVTKSQFLINGKPFYFHGVNKHEDADIRGKGFDWPLLVKDFNLLRWLGANAFRTSHYPYAEEVMQMCDRYGIVVIDECPGVGLALPQFFNNVSLHHHMQVMEEVVRRDKNHPAVVMWSVANEPASHLESAGYYLKMVIAHTKSLDPSRPVTFVSNSNYAADKGAPYVDVICLNSYYSWYHDYGHLELIQLQLATQFENWYKKYQKPIIQSEYGAETIAGFHQDPPLMFTEEYQKSLLEQYHLGLDQKRRKYVVGELIWNFADFMTEQSPTRVLGNKKGIFTRQRQPKSAAFLLRERYWKIANETRYPHSVAKSQCLENSLFT

SEQ ID NO: 6327 - protein, 505 aa, Homo Sapiens
MARGSAVAWAALGPLLWGCALGLQGGMLYPQESPSRECKELDGLWSFRADFSDNRRRGFEEQWYRRPLWESGPTVDMPVPSSFNDISQDWRLRHFVGWVWYEREVILPERWTQDLRTRVVLRIGSAHSYAIVWVNGVDTLEHEGGYLPFEADISNLVQVQLTAQTSLGPVSDFYTLPVGIRTVAVTKSQFLINGKPFYFHGVNKHEDADIRGKGFDWPLLVKDFNLLRWLGANAFRTSHYPYAEEVMQMCDRYGIVVIDECPGVGLALPQFFNNVSLHHHMQVMEEVVRRDKNHPAVVMWSVANEPASHLESAGYYLKMVIAHTKSLDPSRPVTFVSNSNYAADKGAPYVDVICLNSYYSWYHDYGHLELIQLQLATQFENWYKKYQKPIIQSEYGAETIAGFHQDPPLMFTEEYQKSLLEQYHLGLDQKRRKYVVGELIWNFADFMTEQSPTRVLGNKKGIFTRQRQPKSAAFLLRERYWKIANETRYPHSVAKSQCLENSLFT

SEQ ID NO: 6328 - protein, 195 aa, Homo Sapiens; identical to SEQ ID NO: 73

SEQ ID NO: 6329 - protein, 440 aa, Homo Sapiens
MRRYLRVVVLCVACGFCSLLYAFSQLAVSLEEGTGGGGGKPQAAVASWLAGGGRGAVRGAGVAGPAAHPGVSDRCKDFSLCYWNPYWMLPSDVCGMNCFWEAAFRYSLKIQPVEKMHLAVVACGERLEETMTMLKSAIIFSIKPLQFHIFAEDQLHHSFKGRLDNWSFLQTFNYTLYPITFPSENAAEWKKLFKPCASQRLFLPLILKEVDSLLYVDTDILFLRPVDDIWSLLKKFNSTQIAAMAPEHEEPRIGWYNRFARHPYYGKTGVNSGVMLMNMTRMRRKYFKNDMTTVRLQWGDILMPLLKKYKLNITWGDQDLLNIVFFHNPESLFVFPCQWNYRPDHCIYGSNCQEAEEGGIFILHGNRGVYHDDKQPAFRAVYEALRNCSFEDDNIRSLLKPLELELQKTVHTYCGKIYKIFIKQLAKSVRDRYARSPKEK

SEQ ID NO: 6330 - protein, 409 aa, Homo Sapiens
MRRYLRVVVLCVACGFCSLLYAFSQLAVSLEEGTGGGGGKPQAAVASWLAGGGRGAVRGAGVAGPAAHPGVSDRYSLKIQPVEKMHLAVVACGERLEETMTMLKSAIIFSIKPLQFHIFAEDQLHHSFKGRLDNWSFLQTFNYTLYPITFPSENAAEWKKLFKPCASQRLFLPLILKEVDSLLYVDTDILFLRPVDDIWSLLKKFNSTQIAAMAPEHEEPRIGWYNRFARHPYYGKTGVNSGVMLMNMTRMRRKYFKNDMTTVRLQWGDILMPLLKKYKLNITWGDQDLLNIVFFHNPESLFVFPCQWNYRPDHCIYGSNCQEAEEGGIFILHGNRGVYHDDKQPAFRAVYEALRNCSFEDDNIRSLLKPLELELQKTVHTYCGKIYKIFIKQLAKSVRDRYARSPKEK

SEQ ID NO: 6331 - protein, 164 aa, Homo Sapiens
MAPEHEIPKIGWYSRFARHPFYGSAGVNSGVMLMNLTRIRSTQFKNSMIPTGLAWEDMLYPLYQKYKNAITWGDQDLLNIIFYFNPECLYVFPCQWNYRPDHCMYGSNCREAEHEGVSVLHGNRGVYHDDKQPTFRALYEAIRDILRRGGKRKFVLSWISFFVM

SEQ ID NO: 6332 - protein, 443 aa, Homo Sapiens
MKLRSKAAALLLLALAALLLALLSLRAGRAEPPALPARPASAPQRHPAPVPARWPGPGALPGASPGVRRRRPPRPRPRAGRRGAARLEKLARRPGEPRSFQAVLPPELWIHLAVVACGNRLEETLVMLKSAVLFSHRKIQFHIFTEDSLKPEFDKQLRQWPDSYTKKFEHRIYPITFSVGNPQEWKKLFKPCAAQRLFLPVILKDVDSLLYVDTDVLFLRPVDDIWKLLRLFNSTQLAAMAPEHEIPKIGWYSRFARHPFYGSAGVNSGVMLMNLTRIRSTQFKNSMIPTGLAWEDMLYPLYQKYKNAITWGDQDLLNIIFYFNPECLYVFPCQWNYRPDHCMYGSNCREAEHEGVSVLHGNRGVYHDDKQPTFRALYEAIRDFPFQDNLFQSMYYPLQLKFLETVHTLCGRIPQVFLKQIEKTMKRAYEKHVIIHVGPNQMH

SEQ ID NO: 6333 - protein, 102 aa, Homo Sapiens
MLKSAVLFSHRKIQFHIFTEDSLKPEFDKQLRQWPDSYTKKFEHRIYPITFSVGNPQEWKKLFKPCAAQRLFLPVILKDVDSLLYVDTDVLFLRPVDDIWKL

SEQ ID NO: 6334 - protein, 65 aa, Homo Sapiens
MHTSTSSSVTKSYISSQTNGETGQLVHRFTVPAPVVIILIILCVMAGIIGTILLISYSIRRLIKA

SEQ ID NO: 6335 - protein, 121 aa, Homo Sapiens
MYGKIIFVLLLSEIVSISALSTTEVAMHTSTSSSVTKSYISSQTNDKHKRDTCPAHTANEVSEISVTTVSPPEKKNGETGQLVHRFTVPAPVVIILIILCVMAGIIGTILLISYSIRRLIK

SEQ ID NO: 6336 - protein, 91 aa, Homo Sapiens
MYGKIIFVLLLSEIVSISALSTTEVAMHTSTSSSVTKSYISSQTNGETGQLVHRFTVPAPVVIILIILCVMAGIIGTILLISYSIRRLIKA

SEQ ID NO: 6337 - protein, 62 aa, Homo Sapiens
MYGKIIFVLLLSEIVSISALSTTEVAMHTSTSSSVTKSYISSQTNGETGQLVHRFTVPVFAD

SEQ ID NO: 6338 - protein, 42 aa, Homo Sapiens
MYGKIIFVLLLSGDGANPENSGRRGQKAEGRARAKILKQEKL

SEQ ID NO: 6339 - protein, 58 aa, Homo Sapiens
MYGKIIFVLLLSGETGQLVHRFTVPAPVVIILIILCVMAGIIGTILLISYSIRRLIKA

SEQ ID NO: 6340 - protein, 45 aa, Homo Sapiens
MYGKIIFVLLLSGNFEHSAEGPSWLPLRRSPSTSTPLHLGAIPLI

SEQ ID NO: 6341 - protein, 45 aa, Homo Sapiens; identical to SEQ ID NO: 6340

SEQ ID NO: 6342 - protein, 45 aa, Homo Sapiens; identical to SEQ ID NO: 6340

SEQ ID NO: 6343 - protein, 262 aa, Homo Sapiens
MRNSYRFLASSLSVVVSLLLIPEDVCEKIIGGNEVTPHSRPYMVLLSLDRKTICAGALIAKDWVLTAAHCNLNKRSQVILGAHSITREEPTKQIMLVKKEFPYPCYDPATREGDLKLLQLMEKAKINKYVTILHLPKKGDDVKPGTMCQVAGWGRTHNSASWSDTLREVNITIIDRKVCNDRNHYNFNPVIGMNMVCAGSLRGGRDSCNGDSGSPLLCEGVFRGVTSFGLENKCGDPRGPGVYILLSKKHLNWIIMTIKGAV

SEQ ID NO: 6344 - protein, 44 aa, Homo Sapiens
MQECSELQLPFYQDPPSVMLDKLSAGMAEQQAILKKSQGDHRGT

SEQ ID NO: 6345 - protein, 35 aa, Homo Sapiens
MQPILLLLAFLLLPRADAAGEKGQADQSCAAPQAT

SEQ ID NO: 6346 - protein, 202 aa, Homo Sapiens
MQPILLLLAFLLLPRADAGEIIGGHEAKPHSRPYMAYLMIWDQKSLKRCGGFLIRDDFVLTAAHCWGRLERKAKRTRAVQPLRLPSNKAQVKPGQTCSVAGWGQTAPLGKHSHTLQEVKMTVQEDRKCESDLRHYYDSTIELCVGDPEIKKTSFKGDSGGPLVCNKVAQGIVSYGRNNGMPPRACTKVSSFVHWIKKTMKRY

SEQ ID NO: 6347 - protein, 202 aa, Homo Sapiens; identical to SEQ ID NO: 6346

SEQ ID NO: 6348 - protein, 247 aa, Homo Sapiens
MQPILLLLAFLLLPRADAGEIIGGHEAKPHSRPYMAYLMIWDQKSLKRCGGFLIRDDFVLTAAHCWGSSINVTLGAHNIKEQEPTQQFIPVKRPIPHPAYNPKNFSNDIMLLQLERKAKRTRAVQPLRLPSNKAQVKPGQTCSVAGWGQTAPLGKHSHTLQEVKMTVQEDRKCESDLRHYYDSTIELCVGDPEIKKTSFKGDSGGPLVCNKVAQGIVSYGRNNGMPPRACTKVSSFVHWIKKTMKRY

SEQ ID NO: 6349 - protein, 90 aa, Homo Sapiens
MQPILLLLAFLLLPRADAGEIIGGHEAKPHSRPYMAYLMIWDQKSLKRCGGFLIRDDFVLTAAHCWGSWRERPSGPELCSPSGYLATRPR

SEQ ID NO: 6350 - protein, 90 aa, Homo Sapiens; identical to SEQ ID NO: 6349

SEQ ID NO: 6351 - protein, 152 aa, Homo Sapiens
MQPILLLLAFLLLPRADQLERKAKRTRAVQPLRLPSNKAQVKPGQTCSVAGWGQTAPLGKHSHTLQEVKMTVQEDRKCESDLRHYYDSTIELCVGDPEIKKTSFKGDSGGPLVCNKVAQGIVSYGRNNGMPPRACTKVSSFVHWIKKTMKRY

SEQ ID NO: 6352 - protein, 235 aa, Homo Sapiens
MQTFPSGEIIGGHEAKPHSRPYMAYLMIWDQKSLKRCGGFLIRDDFVLTAAHCWGSSINVTLGAHNIKEQEPTQQFIPVKRPIPHPAYNPKNFSNDIMLLQLERKAKRTRAVQPLRLPSNKAQVKPGQTCSVAGWGQTAPLGKHSHTLQEVKMTVQEDRKCESDLRHYYDSTIELCVGDPEIKKTSFKGDSGGPLVCNKVAQGIVSYGRNNGMPPRACTKVSSFVHWIKKTMKRY

SEQ ID NO: 6353 - protein, 115 aa, Homo Sapiens
MQPFLLLLAFLLTPGAGTEEIIGGHEAKPHSRPYMAFVQFLQEKSRKRCGGILVRKDFVLTAAHCQGRGDSGGPLVCKDVAQGILSYGNKKGTPPGVYIKVSHFLPWIKRTMKRL

SEQ ID NO: 6354 - protein, 160 aa, Homo Sapiens
MQPFLLLLAFLLTPGAGTEEIIGGHEAKPHSRPYMAFVQFLQEKSRKRCGGILVRKDFVLTAAHCQGSSINVTLGAHNIKEQERTQQFIPVKRPIPHPAYNPKNFSNDIMLLQGDSGGPLVCKDVAQGILSYGNKKGTPPGVYIKVSHFLPWIKRTMKRL

SEQ ID NO: 6355 - protein, 246 aa, Homo Sapiens
MQPFLLLLAFLLTPGAGTEEIIGGHEAKPHSRPYMAFVQFLQEKSRKRCGGILVRKDFVLTAAHCQGSSINVTLGAHNIKEQERTQQFIPVKRPIPHPAYNPKNFSNDIMLLQLERKAKWTTAVRPLRLPSSKAQVKPGQLCSVAGWGYVSMSTLATTLQEVLLTVQKDCQCERLFHGNYSRATEICVGDPKKTQTGFKGDSGGPLVCKDVAQGILSYGNKKGTPPGVYIKVSHFLPWIKRTMKRL

SEQ ID NO: 6356 - protein, 264 aa, Homo Sapiens
MTKFSSFSLFFLIVGAYMTHVCFNMEIIGGKEVSPHSRPFMASIQYGGHHVCGGVLIDPQWVLTAAHCQYRFTKGQSPTVVLGAHSLSKNEASKQTLEIKKFIPFSRVTSDPQSNDIMLVKLQTAAKLNKHVKMLHIRSKTSLRSGTKCKVTGWGATDPDSLRPSDTLREVTVTVLSRKLCNSQSYYNGDPFITKDMVCAGDAKGQKDSCKGDSGGPLICKGVFHAIVSGGHECGVATKPGIYTLLTKKYQTWIKSNLVPPHTN

SEQ ID NO: 6357 - protein, 218 aa, Homo Sapiens
MASLQRNGSHLCGGVLVHPKWVLTAAHCLAQRMAQLRLVLGLHTLDSPGLTFHIKAAIQHPRYKPVPALENDLALLQLDGKVKPSRTIRPLALPSKRQVVAAGTRCSMAGWGLTHQGGRLSRVLRELDLQVLDTRMCNNSRFWNGSLSPSMVCLAADSKDQAPCKGDSGGPLVCGKGRVLARVLSFSSRVCTDIFKPPVATAVAPYVSWIRKVTGRSA

SEQ ID NO: 6358 - protein, 257 aa, Homo Sapiens
MEACVSSLLVLALGALSVGSSFGTQIIGGREVIPHSRPYMASLQRNGSHLCGGVLVHPKWVLTAAHCLAQRMAQLRLVLGLHTLDSPGLTFHIKAAIQHPRYKPVPALENDLALLQLDGKVKPSRTIRPLALPSKRQVVAAGTRCSMAGWGLTHQGGRLSRVLRELDLQVLDTRMCNNSRFWNGSLSPSMVCLAADSKDQAPCKGDSGGPLVCGKGRVLARVLSFSSRVCTDIFKPPVATAVAPYVSWIRKVTGRSA

SEQ ID NO: 6359 - protein, 802 aa, Homo Sapiens
MLAEPFNWHPGMWNMLIVAMCLALLGCLQAQELQGHVSIILLGATGDLAKKYLWQGLFQLYLDEAGRGHSFSFHGAALTAPKQGQELMAKALESLSCPKDMAPSHCAEHKDQFLQLSQYRQLKTAEDYQALNKDIEAQLQHAGLREAGRIFYFSVPPFAYEDIARNINSSCRPGPGAWLRVVLEKPFGHDHFSAQQLATELGTFFQEEEMYRVDHYLGKQAVAQILPFRDQNRKALDGLWNRHHVERVEIIMKETVDAEGRTSFYEEYGVIRDVLQNHLTEVLTLVAMELPHNVSSAEAVLRHKLQVFQALRGLQRGSAVVGQYQSYSEQVRRELQKPDSFHSLTPTFAAVLVHIDNLRWEGVPFILMSGKALDERVGYARILFKNQACCVQSEKHWAAAQSQCLPRQLVFHIGHGDLGSPAVLVSRNLFRPSLPSSWKEMEGPPGLRLFGSPLSDYYAYSPVRERDAHSVLLSHIFHGRKNFFITTENLLASWNFWTPLLESLAHKAPRLYPGGAENGRLLDFEFSSGRLFFSQQQPEQLVPGPGPAPMPSDFQVLRAKYRESPLVSAWSEELISKLANDIEATAVRAVRRFGQFHLALSGGSSPVALFQQLATAHYGFPWAHTHLWLVDERCVPLSDPESNFQGLQAHLLQHVRIPYYNIHPMPVHLQQRLCAEEDQGAQIYAREISALVANSSFDLVLLGMGADGHTASLFPQSPTGLDGEQLVVLTTSPSQPHRRMSLSLPLINRAKKVAVLVMGRMKREITTLVSRVGHEPKKWPISGVLPHSGQLVWYMDYDAFLG

SEQ ID NO: 6360 - protein, 791 aa, Homo Sapiens
MWNMLIVAMCLALLGCLQAQELQGHVSIILLGATGDLAKKYLWQGLFQLYLDEAGRGHSFSFHGAALTAPKQGQELMAKALESLSCPKDMAPSHCAEHKDQFLQLSQYRQLKTAEDYQALNKDIEAQLQHAGLREAGRIFYFSVPPFAYEDIARNINSSCRPGPGAWLRVVLEKPFGHDHFSAQQLATELGTFFQEEEMYRVDHYLGKQAVAQILPFRDQNRKALDGLWNRHHVERVEIIMKETVDAEGRTSFYEEYGVIRDVLQNHLTEVLTLVAMELPHNVSSAEAVLRHKLQVFQALRGLQRGSAVVGQYQSYSEQVRRELQKPDSFHSLTPTFAAVLVHIDNLRWEGVPFILMSGKALDERVGYARILFKNQACCVQSEKHWAAAQSQCLPRQLVFHIGHGDLGSPAVLVSRNLFRPSLPSSWKEMEGPPGLRLFGSPLSDYYAYSPVRERDAHSVLLSHIFHGRKNFFITTENLLASWNFWTPLLESLAHKAPRLYPGGAENGRLLDFEFSSGRLFFSQQQPEQLVPGPGPAPMPSDFQVLRAKYRESPLVSAWSEELISKLANDIEATAVRAVRRFGQFHLALSGGSSPVALFQQLATAHYGFPWAHTHLWLVDERCVPLSDPESNFQGLQAHLLQHVRIPYYNIHPMPVHLQQRLCAEEDQGAQIYAREISALVANSSFDLVLLGMGADGHTASLFPQSPTGLDGEQLVVLTTSPSQPHRRMSLSLPLINRAKKVAVLVMGRMKREITTLVSRVGHEPKKWPISGVLPHSGQLVWYMDYDAFLG

SEQ ID NO: 6361 - protein, 560 aa, Homo Sapiens
MFARMSDLHVLLLMALVGKTACGFSLMSLLESLDPDWTPDQYDYSYEDYNQEENTSSTLTHAENPDWYYTEDQADPCQPNPCEHGGDCLVHGSTFTCSCLAPFSGNKCQKVQNTCKDNPCGRGQCLITQSPPYYRCVCKHPYTGPSCSQVVPVCRPNPCQNGATCSRHKRRSKFTCACPDQFKGKFCEIGSDDCYVGDGYSYRGKMNRTVNQHACLYWNSHLLLQENYNMFMEDAETHGIGEHNFCRNPDADEKPWCFIKVTNDKVKWEYCDVSACSAQDVAYPEESPTEPSTKLPGFDSCGKTEIAERKIKRIYGGFKSTAGKHPWQASLQSSLPLTISMPQGHFCGGALIHPCWVLTAAHCTDIKTRHLKVVLGDQDLKKEEFHEQSFRVEKIFKYSHYNERDEIPHNDIALLKLKPVDGHCALESKYVKTVCLPDGSFPSGSECHISGWGVTETGKGSRQLLDAKVKLIANTLCNSRQLYDHMIDDSMICAGNLQKPGQDTCQGDSGGPLTCEKDGTYYVYGIVSWGLECGKRPGVYTQVTKFLNWIKATIKSESGF

SEQ ID NO: 6362 - protein, 534 aa, Homo Sapiens
MSLLESLDPDWTPDQYDYSYEDYNQEENTSSTLTHAENPDWYYTEDQADPCQPNPCEHGGDCLVHGSTFTCSCLAPFSGNKCQKVQNTCKDNPCGRGQCLITQSPPYYRCVCKHPYTGPSCSQVVPVCRPNPCQNGATCSRHKRRSKFTCACPDQFKGKFCEIGSDDCYVGDGYSYRGKMNRTVNQHACLYWNSHLLLQENYNMFMEDAETHGIGEHNFCRNPDADEKPWCFIKVTNDKVKWEYCDVSACSAQDVAYPEESPTEPSTKLPGFDSCGKTEIAERKIKRIYGGFKSTAGKHPWQASLQSSLPLTISMPQGHFCGGALIHPCWVLTAAHCTDIKTRHLKVVLGDQDLKKEEFHEQSFRVEKIFKYSHYNERDEIPHNDIALLKLKPVDGHCALESKYVKTVCLPDGSFPSGSECHISGWGVTETGKGSRQLLDAKVKLIANTLCNSRQLYDHMIDDSMICAGNLQKPGQDTCQGDSGGPLTCEKDGTYYVYGIVSWGLECGKRPGVYTQVTKFLNWIKATIKSESGF

SEQ ID NO: 6363 - protein, 459 aa, Homo Sapiens
MTILTYPFKNLPTASKWALRFSIRPLSCSSQLRAAPAVQTKTKKTLAKPNIRNVVVVDGVRTPFLLSGTSGLLHRTSVPKEVVDYIIFGTVIQEVKTSNVAREAALGAGFSDKTPAHTVTMACISANQAMTTGVGLIASGQCDVIVAGGVELMSDVPIRHSRKMRKLMLDLNKAKSMGQRLSLISKFRFNFLAPELPAVSEFSTSETMGHSADRLAAAFAVSRLEQDEYALRSHSLAKKAQDEGLLSDVVPFKVPGKDTVTKDNGIRPSSLEQMAKLKPAFIKPYGTVTAANSSFLTDGASAMLIMAEEKALAMGYKPKAYLRDFMYVSQDPKDQLLLGPTYATPKVLEKAGLTMNDIDAFEFHEAFSGQILANFKAMDSDWFAENYMGRKTKVGLPPLEKFNNWGGSLSLGHPFGATGCRLVMAAANRLRKEGGQYGLVAACAAGGQGHAMIVEAYPK

SEQ ID NO: 6364 - protein, 85 aa, Homo Sapiens
MTILTYPFKNLPTASKWALRFSIRPLSCSSQLRAAPAVQTKTKKTLAKPNIRNVVVVDGVRTPFLLSGTSYKDLMPHDLARAALT

SEQ ID NO: 6365 - protein, 351 aa, Homo Sapiens
MTILTYPFKNLPTASKWALRFSIRPLSCSSQLRAAPAVQTKTKKTLAKPNIRNVVVVDGVRTPFLLSGTSYKDLMPHDLARAALTGLLHRTSVPKEVVDYIIFGTVIQEVKTSNVAREAALGAGFSDKTPAHTVTMACISANQAMTTGKDTVTKDNGIRPSSLEQMAKLKPAFIKPYGTVTAANSSFLTDGASAMLIMAEEKALAMGYKPKAYLRDFMYVSQDPKDQLLLGPTYATPKVLEKAGLTMNDIDAFEFHEAFSGQILANFKAMDSDWFAENYMGRKTKVGLPPLEKFNNWGGSLSLGHPFGATGCRLVMAAANRLRKEGGQYGLVAACAAGGQGHAMIVEAYPK

SEQ ID NO: 6366 - protein, 150 aa, Homo Sapiens
MTILTYPFKNLPTASKWALRFSIRPLSCSSQLRAAPAVQTKTKKTLAKPNIRNVVVVDGVRTPFLLSGTSYKDLMPHDLARAALTGLLHRTSVPKEVVDYIIFGTVIQEVKTSNVAREAALGAGFSDKTPAHTVTMACISANQAMTTGVG

SEQ ID NO: 6367 - protein, 176 aa, Homo Sapiens
MTILTYPFKNLPTASKWALRFSIRPLSCSSQLRAAPAVQTKTKKTLAKPNIRNVVVVDGVRTPFLLSGTSYKDLMPHDLARAALTGLLHRTSVPKEVVDYIIFGTVIQEVKTSNVAREAALGAGFSDKTPAHTVTMACISANQAMTTGVGLIASGQCDVIVAGGVELMSDVPIRHS

SEQ ID NO: 6368 - protein, 474 aa, Homo Sapiens
MTILTYPFKNLPTASKWALRFSIRPLSCSSQLRAAPAVQTKTKKTLAKPNIRNVVVVDGVRTPFLLSGTSYKDLMPHDLARAALTGLLHRTSVPKEVVDYIIFGTVIQEVKTSNVAREAALGAGFSDKTPAHTVTMACISANQAMTTGVGLIASGQCDVIVAGGVELMSDVPIRHSRKMRKLMLDLNKAKSMGQRLSLISKFRFNFLAPELPAVSEFSTSETMGHSADRLAAAFAVSRLEQDEYALRSHSLAKKAQDEGLLSDVVPFKVPGKDTVTKDNGIRPSSLEQMAKLKPAFIKPYGTVTAANSSFLTDGASAMLIMAEEKALAMGYKPKAYLRDFMYVSQDPKDQLLLGPTYATPKVLEKAGLTMNDIDAFEFHEAFSGQILANFKAMDSDWFAENYMGRKTKVGLPPLEKFNNWGGSLSLGHPFGATGCRLVMAAANRLRKEGGQYGLVAACAAGGQGHAMIVEAYPK

SEQ ID NO: 6369 - protein, 452 aa, Homo Sapiens
MTLVSGWLLYGWIIAVQTKTKKTLAKPNIRNVVVVDGVRTPFLLSGTSYKDLMPHDLARAALTGLLHRTSVPKEVVDYIIFGTVIQEVKTSNVAREAALGAGFSDKTPAHTVTMACISANQAMTTGVGLIASGQCDVIVAGGVELMSDVPIRHSRKMRKLMLDLNKAKSMGQRLSLISKFRFNFLAPELPAVSEFSTSETMGHSADRLAAAFAVSRLEQDEYALRSHSLAKKAQDEGLLSDVVPFKVPGKDTVTKDNGIRPSSLEQMAKLKPAFIKPYGTVTAANSSFLTDGASAMLIMAEEKALAMGYKPKAYLRDFMYVSQDPKDQLLLGPTYATPKVLEKAGLTMNDIDAFEFHEAFSGQILANFKAMDSDWFAENYMGRKTKVGLPPLEKFNNWGGSLSLGHPFGATGCRLVMAAANRLRKEGGQYGLVAACAAGGQGHAMIVEAYPK

SEQ ID NO: 6370 - protein, 84 aa, Homo Sapiens
MALSSQIWAACLLLLLLLASLTSGSVFPQQTGQLAELQPQDRAGARASWMPMFQRRRRRDTHFPICIFCCGCCHRSKCGMCCKT

SEQ ID NO: 6371 - protein, 84 aa, Homo Sapiens; identical to SEQ ID NO: 6370

SEQ ID NO: 6372 - protein, 153 aa, Homo Sapiens
MKSLLLLVLISICWADHLSDNYTLDHDRAIHIQAENGPHLLVEAEQAKVFSHRGGNVTLPCKFYRDPTAFGSGIHKIRIKWTKLTSDYLKEVDVFVSMGYHKKTYGGYQGRVFLKGGSDSDASLVITDLTLEDYGRYKCEVIEGLEDDTVVVA

SEQ ID NO: 6373 - protein, 161 aa, Homo Sapiens
MKSLLLLVLISICWADHLSDNYTLDHDRAIHIQAENGPHLLVEAEQAKVFSHRGGNVTLPCKFYRDPTAFGSGIHKIRIKWTKLTSDYLKEVDVFVSMGYHKKTYGGYQGRVFLKGGSDSDASLVITDLTLEDYGRYKCEVIEGLEDDTVVVALDLQGMYL

SEQ ID NO: 6374 - protein, 169 aa, Homo Sapiens
MKSLLLLVLISICWADHLSDNYTLDHDRAIHIQAENGPHLLVEAEQAKVFSHRGGNVTLPCKFYRDPTAFGSGIHKIRIKWTKLTSDYLKEVDVFVSMGYHKKTYGGYQGRVFLKGGSDSDASLVITDLTLEDYGRYKCEVIEGLEDDTVVVALDLQGVVFPYFPRLGR

SEQ ID NO: 6375 - protein, 199 aa, Homo Sapiens
MKSLLLLVLISICWADHLSDNYTLDHDRAIHIQAENGPHLLVEAEQAKVFSHRGGNVTLPCKFYRDPTAFGSGIHKIRIKWTKLTSDYLKEVDVFVSMGYHKKTYGGYQGRVFLKGGSDSDASLVITDLTLEDYGRYKCEVIEGLEDDTVVVALDLQGVVFPYFPRLGRYNLNFHEAQQACLDQDAVIASFDQLYDAWR

SEQ ID NO: 6376 - protein, 354 aa, Homo Sapiens
MKSLLLLVLISICWADHLSDNYTLDHDRAIHIQAENGPHLLVEAEQAKVFSHRGGNVTLPCKFYRDPTAFGSGIHKIRIKWTKLTSDYLKEVDVFVSMGYHKKTYGGYQGRVFLKGGSDSDASLVITDLTLEDYGRYKCEVIEGLEDDTVVVALDLQGVVFPYFPRLGRYNLNFHEAQQACLDQDAVIASFDQLYDAWRGGLDWCNAGWLSDGSVQYPITKPREPCGGQNTVPGVRNYGFWDKDKSRYDVFCFTSNFNGRFYYLIHPTKLTYDEAVQACLNDGAQIAKVGQIFAAWKILGYDRCDAGWLADGSVRYPISRPRRRCSPTEAAVRFVGFPDKKHKLYGVYCFRAYN

SEQ ID NO: 6377 - protein, 258 aa, Homo Sapiens
MKSLLLLVLISICWADHLSDNYTLDHDRAIHIQAENGPHLLVEAEQAKVFSHRGGNVTLPCKFYRDPTAFGSGIHKIRIKWTKLTSDYLKEVDVFVSMGYHKKTYGGYQGRVFLKGGSDSDASLVITDLTLEDYGRYKCEVIEGLEDDTVVVALDLQGVVFPYFPRLGRYNLNFHEAQQACLDQDAVIASFDQLYDAWRGGLDWCNAGWLSDGSVQYPITKPREPCGGQNTVPGVRNYGFWDKDKSRYDVFCFTSNFN

SEQ ID NO: 6378 - protein, 182 aa, Homo Sapiens
MKSLLLLVLISICWADHLSDNYTLDHDRAIHIQENGPHLLVEAEQAKVFSHRGGNVTLPCKFYRDPTAFGSGIHKIRIKWTKLTSDYLKEVDVFVSMGYHKKTYGGYQGRVFLKGGSDSDASLVITDLTLEDYGRYKCEVIEGLEDDTVVVALDLQGVVFPYFPRLGRYNLNFHEAQQACLD

SEQ ID NO: 6379 - protein, 185 aa, Homo Sapiens
MPGWLTLPTLCRFLLWAFTIFHKAQGDPASHPGPHYLLPPIHEVIHSHRGATATLPCVLGTTPPSYKVRWSKVEPGELRETLILITNGLHARGYGPLGGRARMRRGHRLDASLVIAGVRLEDEGRYRCELINGIEDESVALTLSLEGVVFPYQPSRGRYQFNYYEAKQACEEQDGRLATYSQLYQ

SEQ ID NO: 6380 - protein, 340 aa, Homo Sapiens
MPGWLTLPTLCRFLLWAFTIFHKAQGDPASHPGPHYLLPPIHEVIHSHRGATATLPCVLGTTPPSYKVRWSKVEPGELRETLILITNGLHARGYGPLGGRARMRRGHRLDASLVIAGVRLEDEGRYRCELINGIEDESVALTLSLEGVVFPYQPSRGRYQFNYYEAKQACEEQDGRLATYSQLYQAWTEGLDWCNAGWLLEGSVRYPVLTARAPCGGRGRPGIRSYGPRDRMRDRYDAFCFTSALAGQVFFVPGRLTLSEAHAACRRRGAVVAKVGHLYAAWKFSGLDQCDGGWLADGSVRFPITTPRPRCGGLPDPGVRSFGFPRPQQAAYGTYCYAEN

SEQ ID NO: 6381 - protein, 226 aa, Homo Sapiens
MGLLLLVPLLLLPGSYGLPFYNGFYYSNSANDQNLGNGHGKDLLNGVKLVVETPEETLFTYQGASVILPCRYRYEPALVSPRRVRVKWWKLSENGAPEKDVLVAIGLRHRSFGDYQGRVHLRQDKEHDVSLEIQDLRLEDYGRYRCEVIDGLEDESGLVELELRAESQERGGNGQEVWSFLTSPPTGATSSTSTRASRSVQSRLRWWPPLSSSSGPGRRAWTGATR

SEQ ID NO: 6382 - protein, 360 aa, Homo Sapiens
MGLLLLVPLLLLPGSYGLPFYNGFYYSNSANDQNLGNGHGKDLLNGVKLVVETPEETLFTYQGASVILPCRYRYEPALVSPRRVRVKWWKLSENGAPEKDVLVAIGLRHRSFGDYQGRVHLRQDKEHDVSLEIQDLRLEDYGRYRCEVIDGLEDESGLVELELRGVVFPYQSPNGRYQFNFHEGQQVCAEQAAVVASFEQLFRAWEEGLDWCNAGWLQDATVQYPIMLPRQPCGGPGLAPGVRSYGPRHRRLHRYDVFCFATALKGRVYYLEHPEKLTLTEAREACQEDDATIAKVGQLFAAWKFHGLDRCDAGWLADGSVRYPVVHPHPNCGPPEPGVRSFGFPDPQSRLYGVYCYRQH

SEQ ID NO: 6383 - protein, 186 aa, Homo Sapiens
MGLLLLVPLLLLPGSYGLPFYNGFYYSNSANDQNLGNGHGKDLLNGVKLVVETPEETLFTYQGASVILPCRYRYEPALVSPRRVRVKWWKLSENGAPEKDVLVAIGLRHRSFGDYQGRVHLRQDKEHDVSLEIQDLRLEDYGRYRCEVIDGLEDESGLVELELRGWGCVSSHLSHMLGRQFGDRGR

SEQ ID NO: 6384 - protein, 422 aa, Homo Sapiens
MRKWRHREVNLPEVTQQDAVCPAPIPSPGLSAQTGLQKIWGTIHCQVCPGAPAWPGSPWHEEMGLLLLVPLLLLPGSYGLPFYNGFYYSNSANDQNLGNGHGKDLLNGVKLVVETPEETLFTYQGASVILPCRYRYEPALVSPRRVRVKWWKLSENGAPEKDVLVAIGLRHRSFGDYQGRVHLRQDKEHDVSLEIQDLRLEDYGRYRCEVIDGLEDESGLVELELRGVVFPYQSPNGRYQFNFHEGQQVCAEQAAVVASFEQLFRAWEEGLDWCNAGWLQDATVQYPIMLPRQPCGGPGLAPGVRSYGPRHRRLHRYDVFCFATALKGRVYYLEHPEKLTLTEAREACQEDDATIAKVGQLFAAWKFHGLDRCDAGWLADGSVRYPVVHPHPNCGPPEPGVRSFGFPDPQSRLYGVYCYRQH

SEQ ID NO: 6385 - protein, 402 aa, Homo Sapiens
MVCARAALGPGALWAAAWGVLLLTAPAGAQRGRKKVVHVLEGESGSVVVQTAPGQVVSHRGGTIVLPCRYHYEAAAHGHDGVRLKWTKVVDPLAFTDVFVALGPQHRAFGSYRGRAELQGDGPGDASLVLRNVTLQDYGRYECEVTNELEDDAGMVKLDLEGVVFPYHPRGGRYKLTFAEAQRACAEQDGILASAEQLHAAWRDGLDWCNAGWLRDGSVQYPVNRPREPCGGLGGTGSAGGGGDANGGLRNYGYRHNAEERYDAFCFTSNLPGRVFFLKPLRPVPFSGAARACAARGAAVAKVGQLFAAWKLQLLDRCTAGWLADGSARYPIVNPRARCGGRRPGVRSLGFPDATRRLFGVYCYRAPGAPDPAPGGWGWGWAGGGGWAGGARDPAAWTPLHV

SEQ ID NO: 6386 - protein, 334 aa, Homo Sapiens
MPLLGLLPRRAWASLLSQLLRPPCASCTGAVRCQSQDFDIAGQFDPMIPDAECLKIMCEILSGLQLGDFLIKMAWKDVRHEMVVKKGLAPEVADRIGDYVQCHGGVSLVEQMFQDPRLSQNKQALEGLGDLKLLFEYLTLFGIADKISFDLSLARGLDYYTGVIYEAVLLQTPTQAGEEPLNVGSVAAGGRYDGLVGMFDPKGHKVPCVGLSIGVERIFYIVEQRMKTKGEKVRTTETQVFVATPQKNFLQERLKLIAELWDSGIKAEMLYKNNPKLLTQLHYCESTGIPLVVIIGEQELKEGVIKIRSVASREEVAIKRENFVAEIQKRLSES

SEQ ID NO: 6387 - protein, 512 aa, Homo Sapiens
MPLLGLLPRRAWASLLSQLLRPPCASCTGAVRCQSQGEESLQVAEAVLTSQLKAHQEKPNFIIKTPKGTRDLSPQHMVVREKILDLVISCFKRHGAKGMDTPAFELKETLTEKYGEDSGLMYDLKDQGGELLSLRYDLTVPFARYLAMNKVKKMKRYHVGKVWRRESPTIVQGRYREFCQCDFDIAGQFDPMIPDAECLKIMCEILSGLQLGDFLIKVNDRRIVDGMFAVCGVPESKFRAICSSIDKLDKMAWKDVRHEMVVKKGLAPEVADRIGDYVQCHGGVSLVEQMFQDPRLSQNKQALEGLGDLKLLFEYLTLFGIADKISFDLSLARGLDYYTGVIYEAVLLQTPTQAGEEPLNVGSVAAGGRYDGLVGMFDPKGHKVPCVGLSIGVERIFYIVEQRMKTKGEKVRTTETQVFVATPQKNFLQERLKLIAELWDSGIKAEMLYKNNPKLLTQLHYCESTGIPLVVIIGEQELKEGVIKIRSVASREEVAIKRENFVAEIQKRLSES

SEQ ID NO: 6388 - protein, 512 aa, Homo Sapiens; identical to SEQ ID NO: 6387

SEQ ID NO: 6389 - protein, 99 aa, Homo Sapiens
MPLLGLLPRRAWASLLSQLLRPPCASCTGAVRCQSQGEESLQVGGQQGQRCHRSGQCPEKPHLTFILLPGCRGSVNIPTESTSRETKFYYQDPKGYQGS

SEQ ID NO: 6390 - protein, 99 aa, Homo Sapiens; identical to SEQ ID NO: 6389

SEQ ID NO: 6391 - protein, 481 aa, Homo Sapiens
MPLLGLLPRRAWASLLSQLLRPPCASCTGAVRCQSQGTRDLSPQHMVVREKILDLVISCFKRHGAKGMDTPAFELKETLTEKYGEDSGLMYDLKDQGGELLSLRYDLTVPFARYLAMNKVKKMKRYHVGKVWRRESPTIVQGRYREFCQCDFDIAGQFDPMIPDAECLKIMCEILSGLQLGDFLIKVNDRRIVDGMFAVCGVPESKFRAICSSIDKLDKMAWKDVRHEMVVKKGLAPEVADRIGDYVQCHGGVSLVEQMFQDPRLSQNKQALEGLGDLKLLFEYLTLFGIADKISFDLSLARGLDYYTGVIYEAVLLQTPTQAGEEPLNVGSVAAGGRYDGLVGMFDPKGHKVPCVGLSIGVERIFYIVEQRMKTKGEKVRTTETQVFVATPQKNFLQERLKLIAELWDSGIKAEMLYKNNPKLLTQLHYCESTGIPLVVIIGEQELKEGVIKIRSVASREEVAIKRENFVAEIQKRLSES

SEQ ID NO: 6392 - protein, 399 aa, Homo Sapiens
MPLLGLLPRRAWASLLSQLLRPPCASCTGAVRCQSQVAEAVLTSQLKAHQEKPNFIIKTPKGTRDLSPQHMVVREKILDLVISCFKRHGAKGMDTPAFELKDFDIAGQFDPMIPDAECLKIMCEILSGLQLGDFLIKMAWKDVRHEMVVKKGLAPEVADRIGDYVQCHGGVSLVEQMFQDPRLSQNKQALEGLGDLKLLFEYLTLFGIADKISFDLSLARGLDYYTGVIYEAVLLQTPTQAGEEPLNVGSVAAGGRYDGLVGMFDPKGHKVPCVGLSIGVERIFYIVEQRMKTKGEKVRTTETQVFVATPQKNFLQERLKLIAELWDSGIKAEMLYKNNPKLLTQLHYCESTGIPLVVIIGEQELKEGVIKIRSVASREEVAIKRENFVAEIQKRLSES

SEQ ID NO: 6393 - protein, 473 aa, Homo Sapiens
MPLLGLLPRRAWASLLSQLLRPPCASCTGAVRCQSQVAEAVLTSQLKAHQEKPNFIIKTPKGTRDLSPQHMVVREKILDLVISCFKRHGAKGMDTPAFELKETLTEKYGEDSGLMYDLKDQGGELLSLRYDLTVPFARYLAMNKVKKMKRYHVGKVWRRESPTIVQGRYREFCQCDFDIAGQFDPMIPDAECLKIMCEILSGLQLGDFLIKMAWKDVRHEMVVKKGLAPEVADRIGDYVQCHGGVSLVEQMFQDPRLSQNKQALEGLGDLKLLFEYLTLFGIADKISFDLSLARGLDYYTGVIYEAVLLQTPTQAGEEPLNVGSVAAGGRYDGLVGMFDPKGHKVPCVGLSIGVERIFYIVEQRMKTKGEKVRTTETQVFVATPQKNFLQERLKLIAELWDSGIKAEMLYKNNPKLLTQLHYCESTGIPLVVIIGEQELKEGVIKIRSVASREEVAIKRENFVAEIQKRLSES

SEQ ID NO: 6394 - protein, 506 aa, Homo Sapiens
MPLLGLLPRRAWASLLSQLLRPPCASCTGAVRCQSQVAEAVLTSQLKAHQEKPNFIIKTPKGTRDLSPQHMVVREKILDLVISCFKRHGAKGMDTPAFELKETLTEKYGEDSGLMYDLKDQGGELLSLRYDLTVPFARYLAMNKVKKMKRYHVGKVWRRESPTIVQGRYREFCQCDFDIAGQFDPMIPDAECLKIMCEILSGLQLGDFLIKVNDRRIVDGMFAVCGVPESKFRAICSSIDKLDKMAWKDVRHEMVVKKGLAPEVADRIGDYVQCHGGVSLVEQMFQDPRLSQNKQALEGLGDLKLLFEYLTLFGIADKISFDLSLARGLDYYTGVIYEAVLLQTPTQAGEEPLNVGSVAAGGRYDGLVGMFDPKGHKVPCVGLSIGVERIFYIVEQRMKTKGEKVRTTETQVFVATPQKNFLQERLKLIAELWDSGIKAEMLYKNNPKLLTQLHYCESTGIPLVVIIGEQELKEGVIKIRSVASREEVAIKRENFVAEIQKRLSES

SEQ ID NO: 6395 - protein, 506 aa, Homo Sapiens; identical to SEQ ID NO: 6394

SEQ ID NO: 6396 - protein, 506 aa, Homo Sapiens; identical to SEQ ID NO: 6394

SEQ ID NO: 6397 - protein, 160 aa, Homo Sapiens
MVVREKILDLVISCFKRHGAKGMDTPAFELKETLTEKYGEDSGLMYDLKDQGGELLSLRYDLTVPFARYLAMNKVKKMKRYHVGKVWRRESPTIVQGRYREFCQCDFDIAGQFDPMIPDAECLKIMCEILSGLQLGDFLIKESRYCHCFEWKGIDKHLGH

SEQ ID NO: 6398 - protein, 436 aa, Homo Sapiens
MVVREKILDLVISCFKRHGAKGMDTPAFELKETLTEKYGEDSGLMYDLKDQGGELLSLRYDLTVPFARYLAMNKVKKMKRYHVGKVWRRESPTIVQGRYREFCQCDFDIAGQFDPMIPDAECLKIMCEILSGLQLGDFLIKVNDRRIVDGMFAVCGVPESKFRAICSSIDKLDKMAWKDVRHEMVVKKGLAPEVADRIGDYVQCHGGVSLVEQMFQDPRLSQNKQALEGLGDLKLLFEYLTLFGIADKISFDLSLARGLDYYTGVIYEAVLLQTPTQAGEEPLNVGSVAAGGRYDGLVGMFDPKGHKVPCVGLSIGVERIFYIVEQRMKTKGEKVRTTETQVFVATPQKNFLQERLKLIAELWDSGIKAEMLYKNNPKLLTQLHYCESTGIPLVVIIGEQELKEGVIKIRSVASREEVAIKRENFVAEIQKRLSES

SEQ ID NO: 6399 - protein, 293 aa, Homo Sapiens
MVVREKILDLVISCFKRHGAKGMDTPAFELKETLTEKYGEDSGLMYDLKDQGGELLSLRYDLTVPFARYLAMNKVKKMKRYHVGKVWRRESPTIVQGRYREFCQCDFDIAGQFDPMIPDAECLKIMCEILSGLQLGDFLIKVNDRRIVDGMFAVCGVPESKFRAICSSIDKLDKMAWKDVRHEMVVKKGLAPEVADRIGDYVQCHGGVSLVEQMFQDPRLSQNKQALEGLGDLKLLFEYLTLFGIADKISFDLSLARGLDYYTGVIYEAVLLQTPTQAGEEPLNVGSVAAGGR

SEQ ID NO: 6400 - protein, 436 aa, Homo Sapiens; identical to SEQ ID NO: 6398

SEQ ID NO: 6401 - protein, 219 aa, Homo Sapiens
  misc_feature (1)..(1): Xaa can be any naturally occurring amino acid
XASLLSQLLRPPCASCTGAVRCQSQVAEAVLTSQLKAHQEKPNFIIKTPKGTRDLSPQHMVVREKILDLVISCFKRHGAKGMDTPAFELKETLTEKYGEDSGLMYDLKDQGGELLSLRYDLTVPFARYLAMNKVKKMKRYHVGKVWRRESPTIVQGRYREFCQCDFDIAGQFDPMIPDAECLKIMCEILSGLQLGDFLIKESRYCHCFEWKGIDKHLGH

SEQ ID NO: 6402 - protein, 223 aa, Homo Sapiens
MHPQVVILSLILHLADSVAGSVKVGGEAGPSVTLPCHYSGAVTSMCWNRGSCSLFTCQNGIVWTNGTHVTYRKDTRYKLLGDLSRRDVSLTIENTAVSDSGVYCCRVEHRGWFNDMKITVSLEIVPPKVTTTPIVTTVPTVTTVRTSTTVPTTTTVPMTTVPTTTVPTTMSIPTTTTVLTTMTVSTTTSVPTTTSIPTTTSVPVTTTVSTFVPPMPLPRQNHE

SEQ ID NO: 6403 - protein, 364 aa, Homo Sapiens
MHPQVVILSLILHLADSVAGSVKVGGEAGPSVTLPCHYSGAVTSMCWNRGSCSLFTCQNGIVWTNGTHVTYRKDTRYKLLGDLSRRDVSLTIENTAVSDSGVYCCRVEHRGWFNDMKITVSLEIVPPKVTTTPIVTTVPTVTTVRTSTTVPTTTTVPMTTVPTTTVPTTMSIPTTTTVLTTMTVSTTTSVPTTTSIPTTTSVPVTTTVSTFVPPMPLPRQNHEPVATSPSSPQPAETHPTTLQGAIRREPTSSPLYSYTTDGNDTVTESSDGLWNNNQTQLFLEHSLLTANTTKGIYAGVCISVLVLLALLGVIIAKKYFFKKEVQQLSVSFSSLQIKALQNAVEKEVQAEDNIYIENSLYATD

SEQ ID NO: 6404 - protein, 401 aa, Homo Sapiens
MHPQVVILSLILHLADSVAGSVKVGGEAGPSVTLPCHYSGAVTSMCWNRGSCSLFTCQNGIVWTNGTHVTYRKDTRYKLLGDLSRRDVSLTIENTAVSDSGVYCCRVEHRGWFNDMKITVSLEIVPPKVTTTPIVTTVPTVTTVRTSTTVPTTTTVPMTTVPTTTVPTTMSIPTTTTVLTTMTVSTTTSVPTTTSIPTTTSVPVTTTVSTFVPPMPLPRQNHEPVATSPSSPQPAETHPTTLQGAIRREPTSSPLYSYTTDGNDTVTESSDGLWNNNQTQLFLEHSLLTANTTKGIYAGVCISVLVLLALLGVIIAKMFHLAAFKLKLCKMQLKRKSKQKTISTLRIVFMPRTKTQWCSLRVYAHECRRLNRHQHIRRLLDPKTIFLFQFHLAFQHVSDTG

SEQ ID NO: 6405 - protein, 364 aa, Homo Sapiens; identical to SEQ ID NO: 6403

SEQ ID NO: 6406 - protein, 401 aa, Homo Sapiens; identical to SEQ ID NO: 6404

SEQ ID NO: 6407 - protein, 268 aa, Homo Sapiens
MGLSPSAPAVAVQASNASASPPSGCPMHEGKMKGCPVNTEPSGPTCEKKTYSVPAHQERAYEYVECPIRGTAAENKENLDPSNLMPPPNQTPAPDQPFALSTVREESSIPRADSEKKWVYPSEQMFWNAMLKKGWKWKDEDISQKDMYNIIRIHNQNNEQAWKEILKWEALHAAECPCGPSLIRFGGKAKEYSPRARIRSWMGYELPFDRHDWIINRCGTEVRYVIDYYDGGEVNKDYQFTILDVRPALDSLSAVWDRMKVAWWRWTS

SEQ ID NO: 6408 - protein, 268 aa, Homo Sapiens; identical to SEQ ID NO: 6407

SEQ ID NO: 6409 - protein, 268 aa, Homo Sapiens; identical to SEQ ID NO: 6407

SEQ ID NO: 6410 - protein, 131 aa, Homo Sapiens
MNLPSTKVSWAAVTLLLLLLLLPPALLSSGAAAQPLPDCCRQKTCSCRLYELLHGAGNHAAGILTLGKRRSGPPGLQGRLQRLLQASGNHAAGILTMGRRAGAEPAPRPCLGRRCSAPAAASVAPGGQSGI

SEQ ID NO: 6411 - protein, 223 aa, Homo Sapiens
MAAWGCVAALGAARGLCWRAARAAAGLQGRPARRCYAVGPAQPLPRNDFPRIEGVLLLGEPVRWETSLQLIMDVLLSNGSPGAGLATPPYPHLPVLASNMDLLWMAEAKMPSDNPMSDVYGANLFHQYLQKATHDGAPELGAGGTRQQQPSASQSCISILVCTGVYNPRNPQSTEPVLGGGEPPFHGHRDLCFSPGLMEASHVVNDVNEAVQLVFRKEGWALE

SEQ ID NO: 6412 - protein, 423 aa, Homo Sapiens
MAAWGCVAALGAARGLCWRAARAAAGLQGRPARRCYAVGPAQSPPTFGFLLDIDGVLVRGHRVIPAALKAFRRLVNSQGQLRVPVVFVTNAGNILQHSKAQELSALLGCEVDADQVILSHSPMKLFSEYHEKRMLVSGQGPVMENAQGLGFRNVVTVDELRMAFPLLDMVDLERRLKTTPLPRNDFPRIEGVLLLGEPVRWETSLQLIMDVLLSNGSPGAGLATPPYPHLPVLASNMDLLWMAEAKMPRFGHGTFLLCLETIYQKVTGKELRYEGLMGKPSILTYQYAEDLIRRQAERRGWAAPIRKLYAVGDNPMSDVYGANLFHQYLQKATHDGAPELGAGGTRQQQPSASQSCISILVCTGVYNPRNPQSTEPVLGGGEPPFHGHRDLCFSPGLMEASHVVNDVNEAVQLVFRKEGWALE

SEQ ID NO: 6413 - protein, 393 aa, Homo Sapiens
MYAWFFLPSFSQSPPTFGFLLDIDGVLVRGHRVIPAALKAFRRLVNSQGQLRVPVVFVTNAGNILQHSKAQELSALLGCEVDADQVILSHSPMKLFSEYHEKRMLVSGQGPVMENAQGLGFRNVVTVDELRMAFPLLDMVDLERRLKTTPLPRNDFPRIEGVLLLGEPVRWETSLQLIMDVLLSNGSPGAGLATPPYPHLPVLASNMDLLWMAEAKMPRFGHGTFLLCLETIYQKVTGKELRYEGLMGKPSILTYQYAEDLIRRQAERRGWAAPIRKLYAVGDNPMSDVYGANLFHQYLQKATHDGAPELGAGGTRQQQPSASQSCISILVCTGVYNPRNPQSTEPVLGGGEPPFHGHRDLCFSPGLMEASHVVNDVNEAVQLVFRKEGWALE

SEQ ID NO: 6414 - protein, 87 aa, Homo Sapiens
MELAHSLLLNEEAYNQLGEVQKAEFIFEWLRYLEKLLLATSRNDVREKQKTLVEQLLSLLNSSPGPPTRKLLAKNLAILYSIGDTFS

SEQ ID NO: 6415 - protein, 113 aa, Homo Sapiens
MELAHSLLLNEEAYNQLGEVQKAEFIFEWLRYLEKLLLATSRNDVREKQKTLVEQLLSLLNSSPGPPTRKLLAKNLAILYSIGDTFSVHEAIDKCNDLIRSKDDSPSYLPTKL

SEQ ID NO: 6416 - protein, 2046 aa, Homo Sapiens
MELAHSLLLNEEAYNQLGEVQKAEFIFEWLRYLEKLLLATSRNDVREKQKTLVEQLLSLLNSSPGPPTRKLLAKNLAILYSIGDTFSVHEAIDKCNDLIRSKDDSPSYLPTKLAAVVCLGSLYKKLGRILGNTFTDTVGNILKAMKSAESQGRYEIMLSLQNILNGLGAAAAPCHRDVYKAARSCLTDRSMAVRCAAAKCLLELQNEAIFMWSTDLDSVATLCFKSFEGSNYDVRISVSKLLGIILAKAVISKHPGTAASRQSIRRVSLEEVLELLGTGFLRGSSGFLRASGDMLKGTSSVSRDVRVGVTQAYVVFVSTLGGAWLEKNFAAFFSHILSLASPSHPKATQTQIDAVCCRRCVSFILRTTIGGLLGEKAQLAAVKDICQAIWKLKKVMDAVMSDGNLETRLGSTDVAASQHMLVCALQELGNLIHNLGTTAAPLLQDSSTGLLDSILSVILHPSISVRLAAAWCLHCIAVALPSYLTPLLDRCLERLTGHKSSPEAVTGFSFAVAALLGAVKHCPLGIPHGKGKIIMTLAEDLLCSAAQNSRLSAQRTQAGWLLISALMTLGPAVVSHHLARVLLLWKCVFPASPKDLETEKSRGDSFTWQVTLEGRAGALCAIKSFVSHCGDLLTEEVTQRLLPPLPCAVDLLTQLSSILKMYGSPLKTPSVVYRQRLYELLILLPPETYEGNLCAILRELAADLTAPDIQVAASTFLLPPLCHQDDLLILSPFLQETDHRFIEEQLLLGNGVACGSLEYDPYSIYEKDVEGDSVPKPLPPALSVISSASKLFGVVCAHVGETQRLLILEQLLDSIKHTKGARQQVVQLHVVSSVSSFLKYVAGSKGCLGPEEMKRFALTLVMGALESPNPLLRCAAAESWARLAQVVDDGAFTAGLAQVSFDKLKSARDVVTRTGHSLALGSLHRYLGGISSSQHLNSCIGILYTLAQDSTSPDVQTWALHSLSLIIDSAGPLYYVHVEPTLSLIIMLLLNVPPTHAEVHQSLGRCLNALITTLGPELQGNSTSISTLRTSCLLGCAVMQDNPDCLVQAQAISCLQQLHMFAPRHVNLSSLVSCLCVNLCSPYLLLRRAVLACLRQLVQREAAEVSEHAVMLAKDSREELTPDANIREVGLEGALLILLDKETDERLCHDIKETLNYMLTSMAVEKLSLWLKLCKDVLAASADFTAVTCVDTMQEEEGDKGDDASVLTTRRDEKSHPFTNPRWATRVFAAECVCRIINQCENANSAHFDIALAQEMKKRDSRNDFLVLHLADLIRMAFMAATDHSDQLRLSGLEMLLVVIRRFATVPEPEFPGHVILEQYQANVGAALRPAFTSETPPDVTAKACQVCSAWIASGVVSDLNDLRRVHQLLVSSLTKIQAGKEALSHLYNESASTMEILAVLKAWAEVYIIAVQRHKNHRQPLKTTTCLEDGIRNGSCSSDGLLDLVYADLGTLSRLWLAALQDFALLTLPSEFASQLPAEGGAFYTAETSENAKLHYYNSWALILHATALWLTSTGFVVADPDEGASNLSRPVTPTSMCQGSSSGATIKSPEDVYTDRFHLILGISVEFLCSLRSDATMESITACLHALQALLDVPWPRSKIGSDQDLGIELLNVLHRVILTRESPSIQLASLEVVRQIICAAQEHVKEKRRSAEVDDGAAEKETLPEFGEGKDTGGLVPGKSLVFATLELCVCILVRQLPELNPKLTGSPGVKATKPQILLEDGSRLVSAALVILSELPAVCSPEGSISILPTILYLTIGVLRETAVKLPGGQLSSTVAASLQALKGILSSPMARAEKSRTAWTDLLRSALTTILDCWDPVDETHQELDEVSLLTAITVFILSTSPEVTTIPCLQKRCIDKFKATLEIKDPVVQIKTYQLLHSIFQYPNPAVSYPYIYSLASCIMEKLQEIDKRKPENTAELEIFQEGIKVLETLVTVAEEHHRAQLVACLLPILISFLLDENSLGSATSIMRNLHDFALQNLMQIGPQYSSVFKSLVASSPALKARLEAAIKGNQESVKVKIPTSKYTKSPGKNSSIQLKTSFL

SEQ ID NO: 6417 - protein, 1599 aa, Homo Sapiens
  misc_feature (1)..(1): Xaa can be any naturally occurring amino acid
XGEKAQLAAVKDICQAIWKLKKVMDAVMSDGNLETRLGSTDVAASQHMLVCALQELGNLIHNLGTTAAPLLQDSSTGLLDSILSVILHPSISVRLAAAWCLHCIAVALPSYLTPLLDRCLERLTGHKSSPEAVTGFSFAVAALLGAVKHCPLGIPHGKGKIIMTLAEDLLCSAAQNSRLSAQRTQAGWLLISALMTLGPAVVSHHLARVLLLWKCVFPASPKDLETEKSRGDSFTWQVTLEGRAGALCAIKSFVSHCGDLLTEEVTQRLLPPLPCAVDLLTQLSSILKMYGSPLKTPSVVYRQRLYELLILLPPETYEGNLCAILRELAADLTAPDIQVAASTFLLPPLCHQDDLLILSPFLQETDHRFIEEQLLLGNGVACGSLEYDPYSIYEKDVEGDSVPKPLPPALSVISSASKLFGVVCAHVGETQRLLILEQLLDSIKHTKGARQQVVQLHVVSSVSSFLKYVAGSKGCLGPEEMKRFALTLVMGALESPNPLLRCAAAESWARLAQVVDDGAFTAGLAQVSFDKLKSARDVVTRTGHSLALGSLHRYLGGISSSQHLNSCIGILYTLAQDSTSPDVQTWALHSLSLIIDSAGPLYYVHVEPTLSLIIMLLLNVPPTHAEVHQSLGRCLNALITTLGPELQGNSTSISTLRTSCLLGCAVMQDNPDCLVQAQAISCLQQLHMFAPRHVNLSSLVSCLCVNLCSPYLLLRRAVLACLRQLVQREAAEVSEHAVMLAKDSREELTPDANIREVGLEGALLILLDKETDERLCHDIKETLNYMLTSMAVEKLSLWLKLCKDVLAASADFTAVTCVDTMQEEEGDKGDDASVLTTRRDEKSHPFTNPRWATRVFAAECVCRIINQCENANSAHFDIALAQEMKKRDSRNDFLVLHLADLIRMAFMAATDHSDQLRLSGLEMLLVVIRRFATVPEPEFPGHVILEQYQANVGAALRPAFTSETPPDVTAKACQVCSAWIASGVVSDLNDLRRVHQLLVSSLTKIQAGKEALSHLYNESASTMEILAVLKAWAEVYIIAVQRHKNHRQPLKTTTCLEDGIRNGSCSSDGLLDLVYADLGTLSRLWLAALQDFALLTLPSEFASQLPAEGGAFYTAETSENAKLHYYNSWALILHATALWLTSTGFVVADPDEGASNLSRPVTPTSMCQGSSSGATIKSPEDVYTDRFHLILGISVEFLCSLRSDATMESITACLHALQALLDVPWPRSKIGSDQDLGIELLNVLHRVILTRESPSIQLASLEVVRQIICAAQEHVKEKRRSAEVDDGAAEKETLPEFGEGKDTGGLVPGKSLVFATLELCVCILVRQLPELNPKLTGSPGVKATKPQILLEDGSRLVSAALVILSELPAVCSPEVDETHQELDEVSLLTAITVFILSTSPEVTTIPCLQKRCIDKFKATLEIKDPVVQIKTYQLLHSIFQYPNPAVSYPYIYSLASCIMEKLQEIDKRKPENTAELEIFQEGIKVLETLVTVAEEHHRAQLVACLLPILISFLLDENSLGSATSIMRNLHDFALQNLMQIGPQYSSVFKSLVASSPALKARLEAAIKGNQESVKVKIPTSKYTKSPGKNSSIQLKTSFL

SEQ ID NO: 6418 - protein, 124 aa, Homo Sapiens
  misc_feature (1)..(1): Xaa can be any naturally occurring amino acid
XLLLRRAVLACLRQLVQREAAEVSEHAVMLAKDSREELTPDANIREVGLEGALLILLDKETDERLCHDIKETLNYMLTSMAVEKLSLWLKLCKDVLAASAGKYWTLSVKIIKLKFETLHKIVYH

SEQ ID NO: 6419 - protein, 896 aa, Homo Sapiens
  misc_feature (1)..(1): Xaa can be any naturally occurring amino acid
XSHPKATQTQIDAVCCRRCVSFILRTTIGGLLGEKAQLAAVKDICQAIWKLKKVMDVAASQHMLVCALQELGNLIHNLGTTAAPLLQDSSTGLLDSILSVILHPSISVRLAAAWCLHCIAVALPSYLTPLLDRCLERLTGHKSSPEAVTGFSFAVAALLGAVKHCPLGIPHGKGKIIMTLAEDLLCSAAQNSRLSAQRTQAGWLLISALMTLGPAVVSHHLARVLLLWKCVFPASPKDLETEKSRGDSFTWQVTLEGRAGALCAIKSFVSHCGDLLTEEVTQRLLPPLPCAVDLLTQLSSILKMYGSPLKTPSVVYRQRLYELLILLPPETYEGNLCAILRELAADLTAPDIQVAASTFLLPPLCHQDDLLILSPFLQETDHRFIEEQLLLGNGVACGSLEYDPYSIYEKDVEGDSVPKPLPPALSVISSASKLFGVVCAHVGETQRLLILEQLLDSIKHTKGARQQVVQLHVVSSVSSFLKYVAGSKGCLGPEEMKRFALTLVMGALESPNPLLRCAAAESWARLAQVVDDGAFTAGLAQVSFDKLKSARDVVTRTGHSLALGSLHRYLGGISSSQHLNSCIGILYTLAQDSTSPDVQTWALHSLSLIIDSAGPLYYVHVEPTLSLIIMLLLNVPPTHAEVHQSLGRCLNALITTLGPELQGNSTSISTLRTSCLLGCAVMQDNPDCLVQAQAISCLQQLHMFAPRHVNLSSLVSCLCVNLCSPYLLLRRAVLACLRQLVQREAAEVSEHAVMLAKDSREELTPDANIREVGLEGALLILLDKETDERLCHDIKETLNYMLTSMAVEKLSLWLKLCKDVLAASADFTAVTCVDTMQEEEGDKGDDASVLTTRRDEKSHPFTNPRWATRVFAAECVCRIINQCENANSAHFDIALA

SEQ ID NO: 6420 - protein, 199 aa, Homo Sapiens
  misc_feature (1)..(1): Xaa can be any naturally occurring amino acid
XSLIIMLLLNVPPTHAEVHQSLGRCLNALITTLGPELQGNSTSISTLRTSCLLGCAVMQDNPDCLVQAQAISCLQQLHMFAPRHVNLSSLVSCLCEILLDNSVLVNLCSPYLLLRRAVLACLRQLVQREAAEVSEHAVMLAKDSREELTPDANIREVGLEGALLILLDKETDERLCHDIKETLNYMLTSMAVEKLSLWL

SEQ ID NO: 6421 - protein, 208 aa, Homo Sapiens
MESGHLLWALLFMQSLWPQLTDGATRVYYLGIRDVQWNYAPKGRNVITNQPLDSDIVASSFLKSDKNRIGGTYKKTIYKEYKDDSYTDEVAQPAWLGFLGPVLQAEVGDVILIHLKNFATRPYTIHPHGVFYEKDSEGSLYPDGSSGPLKADDSVPPGGSHIYNWTIPEGHAPTDADPACLTWIYHSHVDAPRDIATGLIGPLITCKR

SEQ ID NO: 6422 - protein, 1158 aa, Homo Sapiens
MESGHLLWALLFMQSLWPQLTDGATRVYYLGIRDVQWNYAPKGRNVITNQPLDSDIVASSFLKSDKNRIGGTYKKTIYKEYKDDSYTDEVAQPAWLGFLGPVLQAEVGDVILIHLKNFATRPYTIHPHGVFYEKDSEGSLYPDGSSGPLKADDSVPPGGSHIYNWTIPEGHAPTDADPACLTWIYHSHVDAPRDIATGLIGPLITCKRGALDGNSPPQRQDVDHDFFLLFSVVDENLSWHLNENIATYCSDPASVDKEDETFQESNRMHAINGFVFGNLPELNMCAQKRVAWHLFGMGNEIDVHTAFFHGQMLTTRGHHTDVANIFPATFVTAEMVPWEPGTWLISCQVNSHFRDGMQALYKVKSCSMAPPVDLLTGKVRQYFIEAHEIQWDYGPMGHDGSTGKNLREPGSISDKFFQKSSSRIGGTYWKVRYEAFQDETFQEKMHLEEDRHLGILGPVIRAEVGDTIQVVFYNRASQPFSMQPHGVFYEKDYEGTVYNDGSSYPGLVAKPFEKVTYRWTVPPHAGPTAQDPACLTWMYFSAADPIRDTNSGLVGPLLVCRAGALGADGKQKGVDKEFFLLFTVLDENKSWYSNANQAAAMLDFRLLSEDIEGFQDSNRMHAINGFLFSNLPRLDMCKGDTVAWHLLGLGTETDVHGVMFQGNTVQLQGMRKGAAMLFPHTFVMAIMQPDNLGTFEIYCQAGSHREAGMRAIYNVSQCPGHQATPRQRYQAARIYYIMAEEVEWDYCPDRSWEREWHNQSEKDSYGYIFLSNKDGLLGSRYKKAVFREYTDGTFRIPRPRTGPEEHLGILGPLIKGEVGDILTVVFKNNASRPYSVHAHGVLESTTVWPLAAEPGEVVTYQWNIPERSGPGPNDSACVSWIYYSAVDPIKDMYSGLVGPLAICQKGILEPHGGRSDMDREFALLFLIFDENKSWYLEENVATHGSQDPGSINLQDETFLESNKMHAINGKLYANLRGLTMYQGERVAWYMLAMGQDVDLHTIHFHAESFLYRNGENYRADVVDLFPGTFEVVEMVASNPGTWLMHCHVTDHVHAGMETLFTVFSRTEHLSPLTVITKETEKAVPPRDIEEGNVKMLGMQIPIKNVEMLASVLVAISVTLLLVVLALGGVVWYQHRQRKLRRNRRSILDDSFKLLSFKQ

SEQ ID NO: 6423 - protein, 811 aa, Homo Sapiens
MESGHLLWALLFMQSLWPQLTDGATRVYYLGIRDVQWNYAPKGRNVITNQPLDSDIVASSFLKSDKNRIGGTYKKTIYKEYKDDSYTDEVAQPAWLGFLGPVLQAEVGDVILIHLKNFATRPYTIHPHGVFYEKDSEGSLYPDGSSGPLKADDSVPPGGSHIYNWTIPEGHAPTDADPACLTWIYHSHVDAPRDIATGLIGPLITCKRGALDGNSPPQRQDVDHDFFLLFSVVDENLSWHLNENIATYCSDPASVDKEDETFQESNRMHAINGFVFGNLPELNMCAQKRVAWHLFGMGNEIDVHTAFFHGQMLTTRGHHTDVANIFPATFVTAEMVPWEPGTWLISCQVNSHFRDGMQALYKVKSCSMAPPVDLLTGKVRQYFIEAHEIQWDYGPMGHDGSTGKNLREPGSISDKFFQKSSSRIGGTYWKVRYEAFQDETFQEKMHLEEDRHLGILGPVIRAEVGDTIQVVFYNRASQPFSMQPHGVFYEKDYEGTVYNDDPIRDTNSGLVGPLLVCRAGALGADGKQKGVDKEFFLLFTVLDENKSWYSNANQAAAMLDFRLLSEDIEGFQDSNRMHAINGFLFSNLPRLDMCKGDTVAWHLLGLGTETDVHGVMFQGNTVQLQGMRKGAAMLFPHTFVMAIMQPDNLGTFEIYCQAGSHREAGMRAIYNVSQCPGHQATPRQRYQAARIYYIMAEEVEWDYCPDRSWEREWHNQSEKDSYGYIFLSNKDGLLGSRYKKAVFREYTDGTFRIPRPRTGPEEHLGILGPLIKGEVGDILTVVFKNNASRPYSVHAHGVLESTTVWPLAAEP

SEQ ID NO: 6424 - protein, 891 aa, Homo Sapiens
MHAINGFVFGNLPELNMCAQKRVAWHLFGMGNEIDVHTAFFHGQMLTTRGHHTDVANIFPATFVTAEMVPWEPGTWLISCQVNSHFRDGMQALYKVKSCSMAPPVDLLTGKVRQYFIEAHEIQWDYGPMGHDGSTGKNLREPGSISDKFFQKSSSRIGGTYWKVRYEAFQDETFQEKMHLEEDRHLGILGPVIRAEVGDTIQVVFYNRASQPFSMQPHGVFYEKDYEGTVYNDGSSYPGLVAKPFEKVTYRWTVPPHAGPTAQDPACLTWMYFSAADPIRDTNSGLVGPLLVCRAGALGADGKQKGVDKEFFLLFTVLDENKSWYSNANQAAAMLDFRLLSEDIEGFQDSNRMHAINGFLFSNLPRLDMCKGDTVAWHLLGLGTETDVHGVMFQGNTVQLQGMRKGAAMLFPHTFVMAIMQPDNLGTFEIYCQAGSHREAGMRAIYNVSQCPGHQATPRQRYQAARIYYIMAEEVEWDYCPDRSWEREWHNQSEKDSYGYIFLSNKDGLLGSRYKKAVFREYTDGTFRIPRPRTGPEEHLGILGPLIKGEVGDILTVVFKNNASRPYSVHAHGVLESTTVWPLAAEPGEVVTYQWNIPERSGPGPNDSACVSWIYYSAVDPIKDMYSGLVGPLAICQKGILEPHGGRSDMDREFALLFLIFDENKSWYLEENVATHGSQDPGSINLQDETFLESNKMHAINGKLYANLRGLTMYQGERVAWYMLAMGQDVDLHTIHFHAESFLYRNGENYRADVVDLFPGTFEVVEMVASNPGTWLMHCHVTDHVHAGMETLFTVFSRTEHLSPLTVITKETEKAVPPRDIEEGNVKMLGMQIPIKNVEMLASVLVAISVTLLLVVLALGGVVWYQHRQRKLRRNRRSILDDSFKLLSFKQ

SEQ ID NO: 6425 - protein, 1212 aa, Homo Sapiens
MTQTLPYHLSLLNVLFPGPCSRHFKFRRGKCAQPAWRKVSAPSQDLLITKVMWAMESGHLLWALLFMQSLWPQLTDGATRVYYLGIRDVQWNYAPKGRNVITNQPLDSDIVASSFLKSDKNRIGGTYKKTIYKEYKDDSYTDEVAQPAWLGFLGPVLQAEVGDVILIHLKNFATRPYTIHPHGVFYEKDSEGSLYPDGSSGPLKADDSVPPGGSHIYNWTIPEGHAPTDADPACLTWIYHSHVDAPRDIATGLIGPLITCKRGALDGNSPPQRQDVDHDFFLLFSVVDENLSWHLNENIATYCSDPASVDKEDETFQESNRMHAINGFVFGNLPELNMCAQKRVAWHLFGMGNEIDVHTAFFHGQMLTTRGHHTDVANIFPATFVTAEMVPWEPGTWLISCQVNSHFRDGMQALYKVKSCSMAPPVDLLTGKVRQYFIEAHEIQWDYGPMGHDGSTGKNLREPGSISDKFFQKSSSRIGGTYWKVRYEAFQDETFQEKMHLEEDRHLGILGPVIRAEVGDTIQVVFYNRASQPFSMQPHGVFYEKDYEGTVYNDGSSYPGLVAKPFEKVTYRWTVPPHAGPTAQDPACLTWMYFSAADPIRDTNSGLVGPLLVCRAGALGADGKQKGVDKEFFLLFTVLDENKSWYSNANQAAAMLDFRLLSEDIEGFQDSNRMHAINGFLFSNLPRLDMCKGDTVAWHLLGLGTETDVHGVMFQGNTVQLQGMRKGAAMLFPHTFVMAIMQPDNLGTFEIYCQAGSHREAGMRAIYNVSQCPGHQATPRQRYQAARIYYIMAEEVEWDYCPDRSWEREWHNQSEKDSYGYIFLSNKDGLLGSRYKKAVFREYTDGTFRIPRPRTGPEEHLGILGPLIKGEVGDILTVVFKNNASRPYSVHAHGVLESTTVWPLAAEPGEVVTYQWNIPERSGPGPNDSACVSWIYYSAVDPIKDMYSGLVGPLAICQKGILEPHGGRSDMDREFALLFLIFDENKSWYLEENVATHGSQDPGSINLQDETFLESNKMHAINGKLYANLRGLTMYQGERVAWYMLAMGQDVDLHTIHFHAESFLYRNGENYRADVVDLFPGTFEVVEMVASNPGTWLMHCHVTDHVHAGMETLFTVFSRTEHLSPLTVITKETEKAVPPRDIEEGNVKMLGMQIPIKNVEMLASVLVAISVTLLLVVLALGGVVWYQHRQRKLRRNRRSILDDSFKLLSFKQ

SEQ ID NO: 6426 - protein, 1160 aa, Homo Sapiens
MWAMESGHLLWALLFMQSLWPQLTDGATRVYYLGIRDVQWNYAPKGRNVITNQPLDSDIVASSFLKSDKNRIGGTYKKTIYKEYKDDSYTDEVAQPAWLGFLGPVLQAEVGDVILIHLKNFATRPYTIHPHGVFYEKDSEGSLYPDGSSGPLKADDSVPPGGSHIYNWTIPEGHAPTDADPACLTWIYHSHVDAPRDIATGLIGPLITCKRGALDGNSPPQRQDVDHDFFLLFSVVDENLSWHLNENIATYCSDPASVDKEDETFQESNRMHAINGFVFGNLPELNMCAQKRVAWHLFGMGNEIDVHTAFFHGQMLTTRGHHTDVANIFPATFVTAEMVPWEPGTWLISCQVNSHFRDGMQALYKVKSCSMAPPVDLLTGKVRQYFIEAHEIQWDYGPMGHDGSTGKNLREPGSISDKFFQKSSSRIGGTYWKVRYEAFQDETFQEKMHLEEDRHLGILGPVIRAEVGDTIQVVFYNRASQPFSMQPHGVFYEKDYEGTVYNDGSSYPGLVAKPFEKVTYRWTVPPHAGPTAQDPACLTWMYFSAADPIRDTNSGLVGPLLVCRAGALGADGKQKGVDKEFFLLFTVLDENKSWYSNANQAAAMLDFRLLSEDIEGFQDSNRMHAINGFLFSNLPRLDMCKGDTVAWHLLGLGTETDVHGVMFQGNTVQLQGMRKGAAMLFPHTFVMAIMQPDNLGTFEIYCQAGSHREAGMRAIYNVSQCPGHQATPRQRYQAARIYYIMAEEVEWDYCPDRSWEREWHNQSEKDSYGYIFLSNKDGLLGSRYKKAVFREYTDGTFRIPRPRTGPEEHLGILGPLIKGEVGDILTVVFKNNASRPYSVHAHGVLESTTVWPLAAEPGEVVTYQWNIPERSGPGPNDSACVSWIYYSAVDPIKDMYSGLVGPLAICQKGILEPHGGRSDMDREFALLFLIFDENKSWYLEENVATHGSQDPGSINLQDETFLESNKMHAINGKLYANLRGLTMYQGERVAWYMLAMGQDVDLHTIHFHAESFLYRNGENYRADVVDLFPGTFEVVEMVASNPGTWLMHCHVTDHVHAGMETLFTVFSRTEHLSPLTVITKETEKVPPRDIEEGNVKMLGMQIPIKNVEMLASVLVAISVTLLLVVLALGGVVWYQHRQRKLRRNRRSILDDSFKLLSFKQ

SEQ ID NO: 6427 - protein, 969 aa, Homo Sapiens
MWAMESGHLLWALLFMQSLWPQLTDGATRVYYLGIRDVQWNYAPKGRNVITNQPLDSDIVASSFLKSDKNRIGGTYKKTIYKEYKDDSYTDEVAQPAWLGFLGPVLQAEVGDVILIHLKNFATRPYTIHPHGVFYEKDSEGSLYPDGSSGPLKADDSVPPGGSHIYNWTIPEGHAPTDADPACLTWIYHSHVDAPRDIATGLIGPLITCKRGALDGNSPPQRQDVDHDFFLLFSVVDENLSWHLNENIATYCSDPASVDKEDETFQESNRMHAINGFVFGNLPELNMCAQKRVAWHLFGMGNEIDVHTAFFHGQMLTTRGHHTDVANIFPATFVTAEMVPWEPGTWLISCQVNSHFRDGMQALYKVKSCSMAPPVDLLTGKVRQYFIEAHEIQWDYGPMGHDGSTGKNLREPGSISDKFFQKSSSRIGGTYWKVRYEAFQDETFQEKMHLEEDRHLGILGPVIRAEVGDTIQVVFYNRASQPFSMQPHGVFYEKDYEGTVYNDGTFEIYCQAGSHREAGMRAIYNVSQCPGHQATPRQRYQAARIYYIMAEEVEWDYCPDRSWEREWHNQSEKDSYGYIFLSNKDGLLGSRYKKAVFREYTDGTFRIPRPRTGPEEHLGILGPLIKGEVGDILTVVFKNNASRPYSVHAHGVLESTTVWPLAAEPGEVVTYQWNIPERSGPGPNDSACVSWIYYSAVDPIKDMYSGLVGPLAICQKGILEPHGGRSDMDREFALLFLIFDENKSWYLEENVATHGSQDPGSINLQDETFLESNKMHAINGKLYANLRGLTMYQGERVAWYMLAMGQDVDLHTIHFHAESFLYRNGENYRADVVDLFPGTFEVVEMVASNPGTWLMHCHVTDHVHAGMETLFTVFSRTEHLSPLTVITKETEKAVPPRDIEEGNVKMLGMQIPIKNVEMLASVLVAISVTLLLVVLALGGVVWYQHRQRKLRRNRRSILDDSFKLLSFKQ

SEQ ID NO: 6428 - protein, 63 aa, Homo Sapiens
MWAMESGHLLWALLFMQSLWPQLTDGATRVYYLGIRDVQWNYAPKGRNVITNQPLDSDIYVKM

SEQ ID NO: 6429 - protein, 88 aa, Homo Sapiens
MTSSRLWFSLLLAAAFAGRATALWPWPQNFQTSDQRYVLYPNNFQFQYDVSSAAQPGCSVLDEAFQRYRDLLFGSGSWPRPYLTANMY

SEQ ID NO: 6430 - protein, 143 aa, Homo Sapiens
MTSSRLWFSLLLAAAFAGRATALWPWPQNFQTSDQRYVLYPNNFQFQYDVSSAAQPGCSVLDEAFQRYRDLLFGSGSWPRPYLTGKRHTLEKNVLVVSVVTPGCNQLPTLESVENYTLTINDDQCLLLSETVWGALRGCHGVQ

SEQ ID NO: 6431 - protein, 529 aa, Homo Sapiens
MTSSRLWFSLLLAAAFAGRATALWPWPQNFQTSDQRYVLYPNNFQFQYDVSSAAQPGCSVLDEAFQRYRDLLFGSGSWPRPYLTGKRHTLEKNVLVVSVVTPGCNQLPTLESVENYTLTINDDQCLLLSETVWGALRGLETFSQLVWKSAEGTFFINKTEIEDFPRFPHRGLLLDTSRHYLPLSSILDTLDVMAYNKLNVFHWHLVDDPSFPYESFTFPELMRKGSYNPVTHIYTAQDVKEVIEYARLRGIRVLAEFDTPGHTLSWGPGIPGLLTPCYSGSEPSGTFGPVNPSLNNTYEFMSTFFLEVSSVFPDFYLHLGGDEVDFTCWKSNPEIQDFMRKKGFGEDFKQLESFYIQTLLDIVSSYGKGYVVWQEVFDNKVKIQPDTIIQVWREDIPVNYMKELELVTKAGFRALLSAPWYLNRISYGPDWKDFYIVEPLAFEGTPEQKALVIGGEACMWGEYVDNTNLVPRLWPRAGAVAERLWSNKLTSDLTFAYERLSHFRCELLRRGVQAQPLNVGFCEQEFEQT

SEQ ID NO: 6432 - protein, 509 aa, Homo Sapiens
MTSSRLWFSLLLAAAFAGRATALWPWPQNFQTSDQRYVLYPNNFQFQYDVSSAAQPGCSVLDEAFQRYRDLLFGSGSWPRPYLTGKRHTLEKNVLVVSVVTPGCNQLPTLESVENYTLTINDDQCLLLSETVWGALRGLETFSQLVWKSAEGTFFINKTEIEDFPRFPHRGLLLDTSRHYLPLSSILDTLDVMAYNKLNVFHWHLVDDPSFPYESFTFPELMRKGSYNPVTHIYTAQDVKEVIEYARLRGIRVLAEFDTPGHTLSWGPGIPGLLTPCYSGSEPSGTFGPVNPSLNNTYEFMSTFFLEVSSVFPDFYLHLGGDEVDFTCWKSNPEIQDFMRKKGFGEDFKQLESFYIQTLLDIVSSYGKGYVVWQEVFDNKVKIQPDTIIQVWREDIPVNYMKELELVTKAGFRALLSAPWYLNRISYGPDWKDFYIVEPLAFEGTPEQKALVIGGEACMWGEYVDNTNLVPRLWPRAGAVAERLWSNKLTSDLTFAYERLSHFRCELLR

SEQ ID NO: 6433 - protein, 373 aa, Homo Sapiens
MTSSRLWFSLLLAAAFAGRATALWPWPQNFQTSDQRYVLYPNNFQFQYDVSSAAQPGCSVLDEAFQRYRDLLFGSGSWPRPYLTGKRHTLEKNVLVVSVVTPGCNQLPTLESVENYTLTINDDQCLLLSETVWGALRGLETFSQLVWKSAEGTFFINKTEIEDFPRFPHRGLLLDTSRHYLPLSSILDTLDVMAYNKLNVFHWHLVDDPSFPYESFTFPELMRKGSYNPVTHIYTAQDVKEVIEYARLRGIRVLAEFDTPGHTLSWGPGIPGLLTPCYSGSEPSGTFGPVNPSLNNTYEFMSTFFLEVSSVFPDFYLHLGGDEVDFTCWKSNPEIQDFMRKKGFGEDFKQLESFYIQTFSQTQSYRCGERIFQ

SEQ ID NO: 6434 - protein, 143 aa, Homo Sapiens
MTSSRLWFSLLLAAAFAGRATALWPWPQNFQTSDQRYVLYPNNFQFQYDVSSAAQPGCSVLDEAFQRYRDLLFGSGSWPRPYLTGKRHTLEKNVLVVSVVTPGCNQLPTLESVENYTLTINDDQCLLLSETVWGALRVLYQQD

SEQ ID NO: 6435 - protein, 119 aa, Homo Sapiens
MTSSRLWFSLLLAAAFAGRATALWPWPQNFQTSDQRYVLYPNNFQFQYDVSSAAQPGCSVLDEAFQRYRDLLFGSGSWPRPYLTGLSLSFRLECSGVITAYSNLELQDSSSLPASLMSS

SEQ ID NO: 6436 - protein, 540 aa, Homo Sapiens
MTSSRLWFSLLLAAAFAGRATALWPWPQNFQTSDQRYVLYPNNFQFQYDVSSAAQPGCSVLDEAFQRYRDLLFGSGSWPRPYLTGWPHQAYPVFLGKRHTLEKNVLVVSVVTPGCNQLPTLESVENYTLTINDDQCLLLSETVWGALRGLETFSQLVWKSAEGTFFINKTEIEDFPRFPHRGLLLDTSRHYLPLSSILDTLDVMAYNKLNVFHWHLVDDPSFPYESFTFPELMRKGSYNPVTHIYTAQDVKEVIEYARLRGIRVLAEFDTPGHTLSWGPGIPGLLTPCYSGSEPSGTFGPVNPSLNNTYEFMSTFFLEVSSVFPDFYLHLGGDEVDFTCWKSNPEIQDFMRKKGFGEDFKQLESFYIQTLLDIVSSYGKGYVVWQEVFDNKVKIQPDTIIQVWREDIPVNYMKELELVTKAGFRALLSAPWYLNRISYGPDWKDFYIVEPLAFEGTPEQKALVIGGEACMWGEYVDNTNLVPRLWPRAGAVAERLWSNKLTSDLTFAYERLSHFRCELLRRGVQAQPLNVGFCEQEFEQT

SEQ ID NO: 6437 - protein, 318 aa, Homo Sapiens
  misc_feature (1)..(1): Xaa can be any naturally occurring amino acid
XFQFQYDVSSAAQPGCSVLDEAFQRYRDLLFGSGSWPRPYLTGKRHTLEKNVLVVSVVTPGCNQLPTLESVENYTLTINDDQCLLLSETVWGALRGLETFSQLVWKSAEGTFFINKTEIEDFPRFPHRGLLLDTSRHYLPLSSILDTLDVMAYNKLNVFHWHLVDDPSFPYESFTFPELMRKGSYNPVTHIYTAQDVKEVIEYARLRGIRVLAEFDTPGHTLSWGPGIPGLLTPCYSGSEPSGTFGPVNPSLNNTYEFMSTFFLEVSSVFPDFYLHLGGDEVDFTCWKSNPEIQDFMRKKGFGEDFKQLESFYIQTYP

SEQ ID NO: 6438 - protein, 128 aa, Homo Sapiens
  misc_feature (1)..(1): Xaa can be any naturally occurring amino acid
XFSLLLAAAFAGRATALWPWPQNFQTSDQRYVLYPNNFQFQYDVSSAAQPGCSVLDEAFQRYRDLLFGSGSWPRPYLTGKRHTLEKNVLVVSVVTPGCNQLPTLESVENCIPVPFARRRLLSSFCCGN

SEQ ID NO: 6439 - protein, 331 aa, Homo Sapiens
MAFNKFNVLHWHIVDDQSFPYQSITFPELSNKGSYSLSHVYTPNDVRMVIEYARLRGIRVLPEFDTPGHTLSWGKGQKDLLTPCYSRQNKLDSFGPINPTLNTTYSFLTTFFKEISEVFPDQFIHLGGDEVEFKCWESNPKIQDFMRQKGFGTDFKKLESFYIQKVLDIIATINKGSIVWQEVFDDKAKLAPGTIVEVWKDSAYPEELSRVTASGFPVILSAPWYLDLISYGQDWRKYYKVEPLDFGGTQKQKQLFIGGEACLWGEYVDATNLTPRLWPRASAVGERLWSSKDVRDMDDAYDRLTRHRCRMVERGIAAQPLYAGYCNHENM

SEQ ID NO: 6440 - protein, 35 aa, Homo Sapiens
MDDAYDRLTRHRCRMVERGIAAQPLYAGYCNHENM

SEQ ID NO: 6441 - protein, 556 aa, Homo Sapiens
MELCGLGLPRPPMLLALLLATLLAAMLALLTQVALVVQVAEAARAPSVSAKPGPALWPLPLLVKMTPNLLHLAPENFYISHSPNSTAGPSCTLLEEAFRRYHGYIFGFYKWHHEPAEFQAKTQVQQLLVSITLQSECDAFPNISSDESYTLLVKEPVAVLKANRVWGALRGLETFSQLVYQDSYGTFTINESTIIDSPRFSHRGILIDTSRHYLPVKIILKTLDAMAFNKFNVLHWHIVDDQSFPYQSITFPELSNKGSYSLSHVYTPNDVRMVIEYARLRGIRVLPEFDTPGHTLSWGKGQKDLLTPCYSRQNKLDSFGPINPTLNTTYSFLTTFFKEISEVFPDQFIHLGGDEVEFKCWESNPKIQDFMRQKGFGTDFKKLESFYIQKVLDIIATINKGSIVWQEVFDDKAKLAPGTIVEVWKDSAYPEELSRVTASGFPVILSAPWYLDLISYGQDWRKYYKVEPLDFGGTQKQKQLFIGGEACLWGEYVDATNLTPRLWPRASAVGERLWSSKDVRDMDDAYDRLTRHRCRMVERGIAAQPLYAGYCNHENM

SEQ ID NO: 6442 - protein, 52 aa, Homo Sapiens
  misc_feature (1)..(1): Xaa can be any naturally occurring amino acid
XDATNLTPRLWPRASAVGERLWSSKDVRDMDDAYDRLTRHRCRMVEGLASFL

SEQ ID NO: 6443 - protein, 170 aa, Homo Sapiens
  misc_feature (1)..(1): Xaa can be any naturally occurring amino acid
XFGTDFKKLESFYIQKVLDIIATINKGSIVWQEVFDDKAKLAPGTIVEVWKDSAYPEELSRVTASGFPVILSAPWYLDLISYGQDWRKYYKVEPLDFGGTQKQKQLFIGGEACLWGEYVDATNLTPRLWPRASAVGERLWSSKDVRDMDDAYDRLTRHRCRMVEGLASFL

SEQ ID NO: 6444 - protein, 202 aa, Homo Sapiens
  misc_feature (1)..(1): Xaa can be any naturally occurring amino acid
XNTTYSFLTTFFKEISEVFPDQFIHLGGDEVEFKCWVLDIIATINKGSIVWQEVFDDKAKLAPGTIVEVWKDSAYPEELSRVTASGFPVILSAPWYLDLISYGQDWRKYYKVEPLDFGGTQKQKQLFIGGEACLWGEYVDATNLTPRLWPRASAVGERLWSSKDVRDMDDAYDRLTRHRCRMVERGIAAQPLYAGYCNHENM

SEQ ID NO: 6445 - protein, 70 aa, Homo Sapiens
MGEPGQSPSPRSSHGSPPTLSTLTLLLLLCGHAHSQCKILRCNADSPSYLRTCRNALIRRCIRLRWIIFL

SEQ ID NO: 6446 - protein, 93 aa, Homo Sapiens
MGEPGQSPSPRSSHGSPPTLSTLTLLLLLCGHAHSQCKILRCNAEYVSSTLSLRGGGSSGALRGGGGGGRGGGVGSGGLCRALRSYALCTRRT

SEQ ID NO: 6447 - protein, 426 aa, Homo Sapiens
MGEPGQSPSPRSSHGSPPTLSTLTLLLLLCGHAHSQCKILRCNAEYVSSTLSLRGGGSSGALRGGGGGGRGGGVGSGGLCRALRSYALCTRRTARTCRGDLAFHSAVHGIEDLMIQHNCSRQGPTAPPPPRGPALPGAGSGLPAPDPCDYEGRFSRLHGRPPGFLHCASFGDPHVRSFHHHFHTCRVQGAWPLLDNDFLFVQATSSPMALGANATATRKLTIIFKNMQECIDQKVYQAEVDNLPVAFEDGSINGGDRPGGSSLSIQTANPGNHVEIQAAYIGTTIIIRQTAGQLSFSIKVAEDVAMAFSAEQDLQLCVGGCPPSQRLSRSERNRRGAITIDTARRLCKEGLPVEDAYFHSCVFDVLISGDPNFTVAAQAALEDARAFLPDLEKLHLFPSDAGVPLSSATLLAPLLSGLFVLWLCIQ

SEQ ID NO: 6448 - protein, 313 aa, Homo Sapiens
MIQHNCSRQGPTAPPPPRGPALPGAGSGLPAPDPCDYEGRFSRLHGRPPGFLHCASFGDPHVRSFHHHFHTCRVQGAWPLLDNDFLFVQATSSPMALGANATATRKLTIIFKNMQECIDQKVYQAEVDNLPVAFEDGSINGGDRPGGSSLSIQTANPGNHVEIQAAYIGTTIIIRQTAGQLSFSIKVAEDVAMAFSAEQDLQLCVGGCPPSQRLSRSERNRRGAITIDTARRLCKEGLPVEDAYFHSCVFDVLISGDPNFTVAAQAALEDARAFLPDLEKLHLFPSDAGVPLSSATLLAPLLSGLFVLWLCIQ

SEQ ID NO: 6449 - protein, 200 aa, Homo Sapiens
MQECIDQKVYQAEVDNLPVAFEDGSINGGDRPGGSSLSIQTANPGNHVEIQAAYIGTTIIIRQTAGQLSFSIKVAEDVAMAFSAEQDLQLCVGGCPPSQRLSRSERNRRGAITIDTARRLCKEGLPVEDAYFHSCVFDVLISGDPNFTVAAQAALEDARAFLPDLEKLHLFPSDAGVPLSSATLLAPLLSGLFVLWLCIQ

SEQ ID NO: 6450 - protein, 200 aa, Homo Sapiens; identical to SEQ ID NO: 6449

SEQ ID NO: 6451 - protein, 200 aa, Homo Sapiens; identical to SEQ ID NO: 6449

SEQ ID NO: 6452 - protein, 118 aa, Homo Sapiens
MWVTKLLPALLLQHVLLHLLLLPIAIPYAEGQRKRRNTIHEFKKSAKTTLIKIDPALKIKTKKVNTADQCANRCTRNKGLPFTCKAFVFDKARKQCLWFPFNSMSSGVKKEFGHEFDL

SEQ ID NO: 6453 - protein, 141 aa, Homo Sapiens
MWVTKLLPALLLQHVLLHLLLLPIAIPYAEGQRKRRNTIHEFKKSAKTTLIKIDPALKIKTKKVNTADQCANRCTRNKGLPFTCKAFVFDKARKQCLWFPFNSMSSGVKKEFGHEFDLYENKDYIRNCIIGKGRSYKGTVS

SEQ ID NO: 6454 - protein, 161 aa, Homo Sapiens
MWVTKLLPALLLQHVLLHLLLLPIAIPYAEGQRKRRNTIHEFKKSAKTTLIKIDPALKIKTKKVNTADQCANRCTRNKGLPFTCKAFVFDKARKQCLWFPFNSMSSGVKKEFGHEFDLYENKDYIRNCIIGKGRSYKGTVSITKSGIKCQPWSSMIPHEHR

SEQ ID NO: 6455 - protein, 210 aa, Homo Sapiens
MWVTKLLPALLLQHVLLHLLLLPIAIPYAEGQRKRRNTIHEFKKSAKTTLIKIDPALKIKTKKVNTADQCANRCTRNKGLPFTCKAFVFDKARKQCLWFPFNSMSSGVKKEFGHEFDLYENKDYIRNCIIGKGRSYKGTVSITKSGIKCQPWSSMIPHEHSFLPSSYRGKDLQENYCRNPRGEEGGPWCFTSNPEVRYEVCDIPQCSEGK

SEQ ID NO: 6456 - protein, 728 aa, Homo Sapiens
MWVTKLLPALLLQHVLLHLLLLPIAIPYAEGQRKRRNTIHEFKKSAKTTLIKIDPALKIKTKKVNTADQCANRCTRNKGLPFTCKAFVFDKARKQCLWFPFNSMSSGVKKEFGHEFDLYENKDYIRNCIIGKGRSYKGTVSITKSGIKCQPWSSMIPHEHSFLPSSYRGKDLQENYCRNPRGEEGGPWCFTSNPEVRYEVCDIPQCSEVECMTCNGESYRGLMDHTESGKICQRWDHQTPHRHKFLPERYPDKGFDDNYCRNPDGQPRPWCYTLDPHTRWEYCAIKTCADNTMNDTDVPLETTECIQGQGEGYRGTVNTIWNGIPCQRWDSQYPHEHDMTPENFKCKDLRENYCRNPDGSESPWCFTTDPNIRVGYCSQIPNCDMSHGQDCYRGNGKNYMGNLSQTRSGLTCSMWDKNMEDLHRHIFWEPDASKLNENYCRNPDDDAHGPWCYTGNPLIPWDYCPISRCEGDTTPTIVNLDHPVISCAKTKQLRVVNGIPTRTNIGWMVSLRYRNKHICGGSLIKESWVLTARQCFPSRDLKDYEAWLGIHDVHGRGDEKCKQVLNVSQLVYGPEGSDLVLMKLARPAVLDDFVSTIDLPNYGCTIPEKTSCSVYGWGYTGLINYDGLLRVAHLYIMGNEKCSQHHRGKVTLNESEICAGAEKIGSGPCEGDYGGPLVCEQHKMRMVLGVIVPGRGCAIPNRPGIFVRVAYYAKWIHKIILTYKVPQS

SEQ ID NO: 6457 - protein, 290 aa, Homo Sapiens
MWVTKLLPALLLQHVLLHLLLLPIAIPYAEGQRKRRNTIHEFKKSAKTTLIKIDPALKIKTKKVNTADQCANRCTRNKGLPFTCKAFVFDKARKQCLWFPFNSMSSGVKKEFGHEFDLYENKDYIRNCIIGKGRSYKGTVSITKSGIKCQPWSSMIPHEHSFLPSSYRGKDLQENYCRNPRGEEGGPWCFTSNPEVRYEVCDIPQCSEVECMTCNGESYRGLMDHTESGKICQRWDHQTPHRHKFLPERYPDKGFDDNYCRNPDGQPRPWCYTLDPHTRWEYCAIKTCET

SEQ ID NO: 6458 - protein, 728 aa, Homo Sapiens; identical to SEQ ID NO: 6456

SEQ ID NO: 6459 - protein, 184 aa, Homo Sapiens
MWVTKLLPALLLQHVLLHLLLLPIAIPYAEGQRKRRNTIHEFKKSAKTTLIKIDPALKIKTKKVNTADQCANRCTRNKGLPFTCKAFVFDKARKQCLWFPFNSMSSGVKKEFGHEFDLYENKDYIRNCIIGKGRSYKGTVSITKSGIKCQPWSSMIPHEHSGGDDCLVESTFYSIPFWGHNSAR

SEQ ID NO: 6460 - protein, 205 aa, Homo Sapiens
MWVTKLLPALLLQHVLLHLLLLPIAIPYAEGQRKRRNTIHEFKKSAKTTLIKIDPALKIKTKKVNTADQCANRCTRNKGLPFTCKAFVFDKARKQCLWFPFNSMSSGVKKEFGHEFDLYENKDYIRNCIIGKGRSYKGTVSITKSGIKCQPWSSMIPHEHSYRGKDLQENYCRNPRGEEGGPWCFTSNPEVRYEVCDIPQCSEGK

SEQ ID NO: 6461 - protein, 285 aa, Homo Sapiens
MWVTKLLPALLLQHVLLHLLLLPIAIPYAEGQRKRRNTIHEFKKSAKTTLIKIDPALKIKTKKVNTADQCANRCTRNKGLPFTCKAFVFDKARKQCLWFPFNSMSSGVKKEFGHEFDLYENKDYIRNCIIGKGRSYKGTVSITKSGIKCQPWSSMIPHEHSYRGKDLQENYCRNPRGEEGGPWCFTSNPEVRYEVCDIPQCSEVECMTCNGESYRGLMDHTESGKICQRWDHQTPHRHKFLPERYPDKGFDDNYCRNPDGQPRPWCYTLDPHTRWEYCAIKTCET

SEQ ID NO: 6462 - protein, 723 aa, Homo Sapiens
MWVTKLLPALLLQHVLLHLLLLPIAIPYAEGQRKRRNTIHEFKKSAKTTLIKIDPALKIKTKKVNTADQCANRCTRNKGLPFTCKAFVFDKARKQCLWFPFNSMSSGVKKEFGHEFDLYENKDYIRNCIIGKGRSYKGTVSITKSGIKCQPWSSMIPHEHSYRGKDLQENYCRNPRGEEGGPWCFTSNPEVRYEVCDIPQCSEVECMTCNGESYRGLMDHTESGKICQRWDHQTPHRHKFLPERYPDKGFDDNYCRNPDGQPRPWCYTLDPHTRWEYCAIKTCADNTMNDTDVPLETTECIQGQGEGYRGTVNTIWNGIPCQRWDSQYPHEHDMTPENFKCKDLRENYCRNPDGSESPWCFTTDPNIRVGYCSQIPNCDMSHGQDCYRGNGKNYMGNLSQTRSGLTCSMWDKNMEDLHRHIFWEPDASKLNENYCRNPDDDAHGPWCYTGNPLIPWDYCPISRCEGDTTPTIVNLDHPVISCAKTKQLRVVNGIPTRTNIGWMVSLRYRNKHICGGSLIKESWVLTARQCFPSRDLKDYEAWLGIHDVHGRGDEKCKQVLNVSQLVYGPEGSDLVLMKLARPAVLDDFVSTIDLPNYGCTIPEKTSCSVYGWGYTGLINYDGLLRVAHLYIMGNEKCSQHHRGKVTLNESEICAGAEKIGSGPCEGDYGGPLVCEQHKMRMVLGVIVPGRGCAIPNRPGIFVRVAYYAKWIHKIILTYKVPQS

SEQ ID NO: 6463 - protein, 655 aa, Homo Sapiens
MGRWAWVPSPWPPPGLGPFLLLLLLLLLLPRGFQPQPGGNRTESPEPNATATPAIPTILVTSVTSETPATSAPEAEGPQSGGLPPPPRAVPSSSSPQAQALTEDGRPCRFPFRYGGRMLHACTSEGSAHRKWCATTHNYDRDRAWGYCVEATPPPGGPAALDPCASGPCLNGGSCSNTQDPQSYHCSCPRAFTGKDCGTEKCFDETRYEYLEGGDRWARVRQGHVEQCECFGGRTWCEGTRHTACLSSPCLNGGTCHLIVATGTTVCACPPGFAGRLCNIEPDERCFLGNGTGYRGVASTSASGLSCLAWNSDLLYQELHVDSVGAAALLGLGPHAYCRNPDNDERPWCYVVKDSALSWEYCRLEACESLTRVQLSPDLLATLPEPASPGRQACGRRHKKRTFLRPRIIGGSSSLPGSHPWLAAIYIGDSFCAGSLVHTCWVVSAAHCFSHSPPRDSVSVVLGQHFFNRTTDVTQTFGIEKYIPYTLYSVFNPSDHDLVLIRLKKKGDRCATRSQFVQPICLPEPGSTFPAGHKCQIAGWGHLDENVSGYSSSLREALVPLVADHKCSSPEVYGADISPNMLCAGYFDCKSDACQGDSGGPLACEKNGVAYLYGIISWGDGCGRLHKPGVYTRVANYVDWINDRIRPPRRLVAPS

SEQ ID NO: 6464 - protein, 662 aa, Homo Sapiens
MGRWAWVPSPWPPPGLGPFLLLLLLLLLLPRGFQPQPGGNRTESPEPNATATPAIPTILVTSVTSETPATSAPEAEGPQSGGLPPPPRAVPSSSSPQAQALTEDGRPCRFPFRYGGRMLHACTSEGSAHRKWCATTHNYDRDRAWGYCVEATPPPGGPAALDPCASGPCLNGGSCSNTQDPQSYHCSCPRAFTGKDCGTEKCFDETRYEYLEGGDRWARVRQGHVEQCECFGGRTWCEGTRHTACLSSPCLNGGTCHLIVATGTTVCACPPGFAGRLCNIEPDERCFLGNGTGYRGVASTSASGLSCLAWNSDLLYQELHVDSVGAAALLGLGPHAYCRNPDNDERPWCYVVKDSALSWEYCRLEACDLETEGRESLTRVQLSPDLLATLPEPASPGRQACGRRHKKRTFLRPRIIGGSSSLPGSHPWLAAIYIGDSFCAGSLVHTCWVVSAAHCFSHSPPRDSVSVVLGQHFFNRTTDVTQTFGIEKYIPYTLYSVFNPSDHDLVLIRLKKKGDRCATRSQFVQPICLPEPGSTFPAGHKCQIAGWGHLDENVSGYSSSLREALVPLVADHKCSSPEVYGADISPNMLCAGYFDCKSDACQGDSGGPLACEKNGVAYLYGIISWGDGCGRLHKPGVYTRVANYVDWINDRIRPPRRLVAPS

SEQ ID NO: 6465 - protein, 700 aa, Homo Sapiens
MLKMLSFKLLLLAVALGFFEGDAKFGERNEGSGARRRRCLNGNPPKRLKRRDRRMMSQLELLSGGEMLCGGFYPRLSCCLRSDSPGLGRLENKIFSVTNNTECGKLLEEIKCALCSPHSQSLFHSPEREVLERDLVLPLLCKDYCKEFFYTCRGHIPGFLQTTADEFCFYYARKDGGLCFPDFPRKQVRGPASNYLDQMEEYDKVEEISRKHKHNCFCIQEVVSGLRQPVGALHSGDGSQRLFILEKEGYVKILTPEGEIFKEPYLDIHKLVQSGIKGGDERGLLSLAFHPNYKKNGKLYVSYTTNQERWAIGPHDHILRVVEYTVSRKNPHQVDLRTARVFLEVAELHRKHLGGQLLFGPDGFLYIILGDGMITLDDMEEMDGLSDFTGSVLRLDVDTDMCNVPYSIPRSNPHFNSTNQPPEVFAHGLHDPGRCAVDRHPTDININLTILCSDSNGKNRSSARILQIIKGKDYESEPSLLEFKPFSNGPLVGGFVYRGCQSERLYGSYVFGDRNGNFLTLQQSPVTKQWQEKPLCLGTSGSCRGYFSGHILGFGEDELGEVYILSSSKSMTQTHNGKLYKIVDPKRPLMPEECRATVQPAQTLTSECSRLCRNGYCTPTGKCCCSPGWEGDFCRTAKCEPACRHGGVCVRPNKCLCKKGYLGPQCEQVDRNIRRVTRAGILDQIIDMTSYLLDLTSYIV

SEQ ID NO: 6466 - protein, 320 aa, Homo Sapiens
MLKMLSFKLLLLAVALGFFEGDAKFGERNEGSGARRRRCLNGNPPKRLKRRDRRMMSQLELLSGGEMLCGGFYPRLSCCLRSDSPGLGRLENKIFSVTNNTECGKLLEEIKCALCSPHSQSLFHSPEREVLERDLVLPLLCKDYCKEFFYTCRGHIPGFLQTTADEFCFYYARKDGGLCFPDFPRKQVRGPASNYLDQMEEYDKVEEISRKHKHNCFCIQEVVSGLRQPVGALHSGDGSQRLFILEKEGYVKILTPEGEIFKEPYLDIHKLVQSGIKVGFLNFIYFCAGYVNFILVLPSSLKVFLCNKRKNLAGENKGAT

SEQ ID NO: 6467 - protein, 782 aa, Homo Sapiens
MARARAGALLALWVLGAAAHPQCLDFRPPFRPTQPLRLCAQYSDFGCCDEGRDAELTRRFWALASRVDAAEWAACAGYARDLLCQECSPYAAHLYDAEDPFTPLRTVPGLCQDYCLDMWHKCRGLFRHLSTDQELWALEGNLARFCRYLSLDDTDYCFPYLLVNKNLNSNLGHVVADAKGCLQLCLEEVANGLRNPVAMVHARDGTHRFFVAEQVGLVWAYLPDRSRLGKPFLNISRVVLTSPWEGDERGFLGIAFHPSFQHNRRLYVYYSVGIRSSEWIRISEFRVSEDDENAVDHSSERIILEVKEPASNHNGGQLLFGDDGYLYIFTGDGGMAGDPFGTFGNAQNKSALLGKVLRIDVDRKERGLPYGIPPDNPFVGDPAAQPEVYALGVRNMWRCSFDRGDPSSGTGRGRLFCGDVGQNKFEEVDVVERGGNYGWRAREGFECYDRSLCANTSLNDLLPIFAYPHTVGKSVTGGYVYRGCEYPNLNGLYIFGDFMSGRLMSLQENPGTGQWQYSEICMGHGQTCEFPGLINNYYPYIISFGEDEAGELYFMSTGEPSATAPRGVVYKIIDASRRAPPGKCQIQPAQVKIRSRLIPFVPKEKFIPKTRSTPRPTARAPTRAPRRGRPTAAPPAPTPRPARPTQQPGSRRGGGRRRGRLNSASRAFRDGEVRLVRPAGLSSGSGRVEVFVGGRWGTVCDDSWNISGAAVVCRQLGFAYAVRAVKRAEFGQGGSLPILLDDVRCAGWERNLLECQHNGVGTHNCEHDEDAGVVCSHQNPDL

SEQ ID NO: 6468 - protein, 608 aa, Homo Sapiens
MARARAGALLALWVLGAAAHPQCLDFRPPFRPTQPLRLCAQYSDFGCCDEGRDAELTRRFWALASRVDAAEWAACAGYARDLLCQECSPYAAHLYDAEDPFTPLRTVPGLCQDYCLDMWHKCRGLFRHLSTDQELWALEGNLARFCRYLSLDDTDYCFPYLLVNKNLNSNLGHVVADAKGCLQLCLEEVANGLRNPVAMVHARDGTHRFFVAEQVGLVWAYLPDRSRLGKPFLNISRVVLTSPWEGDERGFLGIAFHPSFQHNRRLYVYYSVGIRSSEWIRISEFRVSEDDENAVDHSSERIILEVKEPASNHNGGQLLFGDDGYLYIFTGDGGMAGDPFGTFGNAQNKSALLGKVLRIDVDRKERGLPYGIPPDNPFVGDPAAQPEVYALGVRNMWRCSFDRGDPSSGTGRGRLFCGDVGQNKFEEVDVVERGGNYGWRAREGFECYDRSLCANTSLNDLLPIFAYPHTVGKSVTGGYVYRGCEYPNLNGLYIFGDFMSGRLMSLQENPGTGQWQYSEICMGHGQTCEFPGLINNYYPYIISFGEDEAGELYFMSTGEPSATAPRGVVYKIIDASSCKARSAMPGYVPAPSVCSSLTSQPFILQWWK

SEQ ID NO: 6469 - protein, 724 aa, Homo Sapiens
MLRTSTPNLCGGLHCRAPWLSSGILCLCLIFLLGQVGLLQGHPQCLDYGPPFQPPLHLEFCSDYESFGCCDQHKDRRIAARYWDIMEYFDLKRHELCGDYIKDILCQECSPYAAHLYDAENTQTPLRNLPGLCSDYCSAFHSNCHSAISLLTNDRGLQESHGRDGTRFCHLLDLPDKDYCFPNVLRNDYLNRHLGMVAQDPQGCLQLCLSEVANGLRNPVSMVHAGDGTHRFFVAEQVGVVWVYLPDGSRLEQPFLDLKNIVLTTPWIGDERGFLGLAFHPKFRHNRKFYIYYSCLDKKKVEKIRISEMKVSRADPNKADLKSERVILEIEEPASNHNGGQLLFGLDGYMYIFTGDGGQAGDPFGLFGNAQNKSSLLGKVLRIDVNRAGSHGKRYRVPSDNPFVSEPGAHPAIYAYGIRNMWRCAVDRGDPITRQGRGRIFCGDVGQNRFEEVDLILKGGNYGWRAKEGFACYDKKLCHNASLDDVLPIYAYGHAVGKSVTGGYVYRGCESPNLNGLYIFGDFMSGRLMALQEDRKNKKWKKQDLCLGSTTSCAFPGLISTHSKFIISFAEDEAGELYFLATSYPSAYAPRGSIYKFVDPSRRAPPGKCKYKPVPVRTKSKRIPFRPLAKTVLDLLKEQSEKAARKSSSATLASGPAQGLSEKGSSKKLASPTSSKNTLRGPGTKKKARVGPHVRQGKRRKSLKSHSGRMRPSAEQKRAGRSLP

SEQ ID NO: 6470 - protein, 543 aa, Homo Sapiens
MLGFLSRGPSMKLCMGLACVLSLWNTVSGIKGEAKKEKGMTFLPTTGKWVIRAPFQLTCLEIKMLRRKKMGHSRAALNPDLLLSGLREEERKEKGVAFLATTELPARSIDLSALNLTELVNGMLSRALKDSKKFFSLLSVTSYSSFAFHKFSVAVYNISNLKTVDPAKFPTRYCYCLNNRTNDLSDFTALLVDIIGNSTSYLTEIFKSTSILSVNQSNESDCIFICVMTGKSGRNLSDFWEIEEKYPIINYTFTSGLSGVLGAATRGTARTSKPTTKSQKTLPSTSPGHWTQSTPWASALRSSPWTETAAPSETEETLNTGRPPELPARATATWFSASHTLPALATRRVARTQWLTADRQTWASISSVPWAQTISEKKPGGSLWETRSSPPTTAGTEEAMNTTSLLAPAAEIMATPGSPSQASPTLGAFTHGTQTPSPTKATAPRYPQTGDLSAEWPFTAGEEPVLVPRPHQVSRCPQPLFKVGAMAAAPLTLAIQRLNPCLMELCQFFQQCLCMSQRSPRTEDMSSFINPYQSSTSKISWKT

SEQ ID NO: 6471 - protein, 531 aa, Homo Sapiens
MLGFLSRGPSMKLCMGLACVLSLWNTVSGIKGEAKKEKGMTFLPTTVSGLREEERKEKGVAFLATTELPARSIDLSALNLTELVNGMLSRALKDSKKFFSLLSVTSYSSFAFHKFSVAVYNISNLKTVDPAKFPTRYCYCLNNRTNDLSDFTALLVDIIGNSTSYLTEIFKSTSILSVNQSNESDCIFICVMTGKSGRNLSDFWEIEEKYPIINYTFTSGLSGVLGAATRGTARTSKPTTKSQKTLPSTSPGHWTQSTPWASALRSSPWTETAAPSETEETLNTGRPPELPARATATWFSASHTLPALATRRVARTQWLTADRQTWASISSVPWAQTISEKKPGGSLWETRSSPPTTAGTEEAMNTTSLLAPAAEIMATPGSPSQASPTLGAFTHGTQTPSPTKATAPRYPQTGDLSAEWPFTAGEEPVLVPRPHQVSRCPQPLFKVGAMAAAPLTLAIQRLNPCLMELCQFFQQCLCMSQRSPRTEDMRYCLEYYSWFLKNATYICQRVKRVSHSHTLKQKCLENICKSV

SEQ ID NO: 6472 - protein, 97 aa, Homo Sapiens
MKAQTALSFFLILITSLSGSQGIFPLAFFIYVPMNEQIVIGRLDEDIILPSSFERGSEVVIHWKYQDSYKVHSYYKGSDHLESQDPRYANRTSLFYN

SEQ ID NO: 6473 - protein, 136 aa, Homo Sapiens
MKAQTALSFFLILITSLSGSQGIFPLAFFIYVPMNEQIVIGRLDEDIILPSSFERGSEVVIHWKYQDSYKVHSYYKGSDHLESQDPRYANRTSLFYNEIQNGNASLFFRRVSLLDEGIYTCYVGTAIQVITNKVVL

SEQ ID NO: 6474 - protein, 145 aa, Homo Sapiens
MKAQTALSFFLILITSLSGSQGIFPLAFFIYVPMNEQIVIGRLDEDIILPSSFERGSEVVIHWKYQDSYKVHSYYKGSDHLESQDPRYANRTSLFYNEIQNGNASLFFRRVSLLDEGIYTCYVGTAIQVITNKVVLKVGVFLTPV

SEQ ID NO: 6475 - protein, 414 aa, Homo Sapiens
MKAQTALSFFLILITSLSGSQGIFPLAFFIYVPMNEQIVIGRLDEDIILPSSFERGSEVVIHWKYQDSYKVHSYYKGSDHLESQDPRYANRTSLFYNEIQNGNASLFFRRVSLLDEGIYTCYVGTAIQVITNKVVLKVGVFLTPVMKYEKRNTNSFLICSVLSVYPRPIITWKMDNTPISENNMEETGSLDSFSINSPLNITGSNSSYECTIENSLLKQTWTGRWTMKDGLHKMQSEHVSLSCQPVNDYFSPNQDFKVTWSRMKSGTFSVLAYYLSSSQNTIINESRFSWNKELINQSDFSMNLMDLNLSDSGEYLCNISSDEYTLLTIHTVHVEPSQETASHNKGLWILVPSAILAAFLLIWSVKCCRAQLEARRSRHPADGAQQERCCVPPGERCPSAPDNGEENVPLSGKV

SEQ ID NO: 6476 - protein, 414 aa, Homo Sapiens; identical to SEQ ID NO: 6475

SEQ ID NO: 6477 - protein, 397 aa, Homo Sapiens
MKAQTALSFFLILITSLSGSQGIFPLAFFIYVPMNEQIVIGRLDEDIILPSSFERGSEVVIHWKYQDSYKVHSYYKGSDHLESQDPRYANRTSLFYNEIQNGNASLFFRRVSLLDEGIYTCYVGTAIQVITNKVVLKVGVFLTPVMKYEKRNTNSFLICSVLSVYPRPIITWKMDNTPISENNMEETGSLDSFSINSPLNITGSNSSYECTIENSLLKQTWTGRWTMKDGLHKMQSEHVSLSCQPVNDYFSPNQDFKVTWSRMKSGTFSVLAYYLSSSQNTIINESRFSWNKELINQSDFSMNLMDLNLSDSGEYLCNISSDEYTLLTIHTVHVEPSQETASHNKGLWILVPSAILAAFLLIWSVKCCRERCCVPPGERCPSAPDNGEENVPLSGKV

SEQ ID NO: 6478 - protein, 414 aa, Homo Sapiens; identical to SEQ ID NO: 6475

SEQ ID NO: 6479 - protein, 414 aa, Homo Sapiens; identical to SEQ ID NO: 6475

SEQ ID NO: 6480 - protein, 128 aa, Homo Sapiens
MNEQIVIGRLDEDIILPSSFERGSEVVIHWKYQDSYKVHSYYKGSDHLESQDPRYANRTSLFYNEIQNGNASLFFRRVSLLDEGIYTCYVGTAIQVITNKVVLKVGVFLTPVMKYEKRNTNSFLICSV

SEQ ID NO: 6481 - protein, 350 aa, Homo Sapiens
MVMWNILKPRTHLLCMTNMFCTRHEGTDSTVFLPHSHNISEWISRRVSLLDEGIYTCYVGTAIQVITNKVVLKVGVFLTPVMKYEKRNTNSFLICSVLSVYPRPIITWKMDNTPISENNMEETGSLDSFSINSPLNITGSNSSYECTIENSLLKQTWTGRWTMKDGLHKMQSEHVSLSCQPVNDYFSPNQDFKVTWSRMKSGTFSVLAYYLSSSQNTIINESRFSWNKELINQSDFSMNLMDLNLSDSGEYLCNISSDEYTLLTIHTVHVEPSQETASHNKGLWILVPSAILAAFLLIWSVKCCRAQLEARRSRHPADGAQQERCCVPPGERCPSAPDNGEENVPLSGKV

SEQ ID NO: 6482 - protein, 328 aa, Homo Sapiens
  misc_feature (1)..(1): Xaa can be any naturally occurring amino acid
XIQNGNASLFFRRVSLLDEGIYTCYVGTAIQVITNKVVLKVGVFLTPVMKYEKRNTNSFLICSVLSVYPRPIITWKMDNTPISENNMEETGSLDSFSINSPLNITGSNSSYECTIENSLLKQTWTGRWTMKDGLHKMQSEHVSLSCQPVNDYFSPNQDFKVTWSRMKSGTFSVLAYYLSSSQNTIINESRFSWNKELINQSDFSMNLMDLNLSDSGEYLCNISSDEYTLLTIHTVHVEPSQETASHNKGLWILVPSAILAAFLLIWSVKCCRAQLEARRSRHPADGAQQERCCVPPGERCPSAPDNGEENVVRHYFLYQTIYSIKMLL

SEQ ID NO: 6483 - protein, 39 aa, Homo Sapiens
MAASLRLLGAASGLRYWSRRLRPAAGSFAAGSIFPSRCC

SEQ ID NO: 6484 - protein, 336 aa, Homo Sapiens
MAASLRLLGAASGLRYWSRRLRPAAGSFAAVCSRSVASKTPVGFIGLGNMGNPMAKNLMKHGYPLIIYDVFPDACKEFQDAGEQVVSSPADVAEKADRIITMLPTSINAIEAYSGANGILKKVKKGSLLIDSSTIDPAVSKELAKEVEKMGAVFMDAPVSGGVGAARSGNLTFMVGGVEDEFAAAQELLGCMGSNVVYCGAVGTGQAAKICNNMLLAISMIGTAEAMNLGIRLGLDPKLLAKILNMSSGRCWSSDTYNPVPGVMDGVPSANNYQGGFGTTLMAKDLGLAQDSATSTKSPILLGSLAHQIYRMMCAKGYSKKDFSSVFQFLREEETF

SEQ ID NO: 6485 - protein, 206 aa, Homo Sapiens
  misc_feature (1)..(1): Xaa can be any naturally occurring amino acid
XELPHTLKLPGLPLFPNKFLISLVLLILVSSPADVAEKADRIITMLPTSINAIEAYSGANGILKKVKKGSLLIDSSTIDPAVSKELAKEVEKMGAVFMDAPVSGGVGAARSGNLTFMVGGVEDEFAAAQELLGCMGSNVVYCGAVGTGQAAKICNNMLLAISMIGTAEAMNLGIRLGLDPKLLAKILNMSSGRCWSSDTYNPVPGV

SEQ ID NO: 6486 - protein, 163 aa, Homo Sapiens
MAAAVVLAAGLRAARRAVAATGVRGGQVRGAAGVTDGNEVAKAQQATPGGAAPTIFSRILDKSLPADILYEDQQCLVFRDVAPQAPVHFLVIPKKPIPRISQAEEEDQQLLGHLLLVAKQTAKAEGLGDGYRLVINDGKLGAQSVYHLHIHVLGGRQLQWPPG

SEQ ID NO: 6487 - protein, 365 aa, Homo Sapiens
MAVMAPRTLLLLLSGALALTQTWAGSHSMRYFFTSVSRPGRGEPRFIAVGYVDDTQFVRFDSDAASQRMEPRAPWIEQEGPEYWDQETRNVKAQSQTDRVDLGTLRGYYNQSEAGSHTIQIMYGCDVGSDGRFLRGYRQDAYDGKDYIALNEDLRSWTAADMAAQITKRKWEAAHEAEQLRAYLDGTCVEWLRRYLENGKETLQRTDPPKTHMTHHPISDHEATLRCWALGFYPAEITLTWQRDGEDQTQDTELVETRPAGDGTFQKWAAVVVPSGEEQRYTCHVQHEGLPKPLTLRWELSSQPTIPIVGIIAGLVLLGAVITGAVVAAVMWRRKSSDRKGGSYTQAASSDSAQGSDVSLTACKV

SEQ ID NO: 6488 - protein, 299 aa, Homo Sapiens
MAVMAPRTLLLLLSGALALTQTWAGSHSMRYFFTSVSRPGRGEPRFIAVGYVDDTQFVRFDSDAASQRMEPRAPWIEQEGPEYWDQETRNVKAQSQTDRVDLGTLRGYYNQSEAGSHTIQIMYGCDVGSDGRFLRGYRQDAYDGKDYIALNEDLRSWTAADMAAQITKRKWEAAHEAEQLRAYLDGTCVEWLRRYLENGKETLQRTDPPKTHMTHHPISDHEATLRCWALGFYPAEITLTWQRDGEDQTQDTELVETRPAGDGTFQKWAAVVVPSGEEQRYTCHVQHEGLPKPLTLRWV

SEQ ID NO: 6489 - protein, 365 aa, Homo Sapiens; identical to SEQ ID NO: 6487

SEQ ID NO: 6490 - protein, 371 aa, Homo Sapiens
MAVMAPRTLLLLLSGALALTQTWAGSHSMRYFFTSVSRPGRGEPRFIAVGYVDDTQFVRFDSDAASQRMEPRAPWIEQEGPEYWDQETRNVKAQSQTDRVDLGTLRGYYNQSEAGSHTIQIMYGCDVGSDGRFLRGYRQDAYDGKDYIALNEDLRSWTAADMAAQITKRKWEAAHEAEQLRAYLDGTCVEWLRRYLENGKETLQRTDPPKTHMTHHPISDHEATLRCWALGFYPAEITLTWQRDGEDQTQDTELVETRPAGDGTFQKWAAVVVPSGEEQRYTCHVQHEGLPKPLTLRWELSSQPTIPIVGIIAGLVLLGAVITGAVVAAVMWRRKSSGGEGVKDRKGGSYTQAASSDSAQGSDVSLTACKV

SEQ ID NO: 6491 - protein, 325 aa, Homo Sapiens
MAVMAPRTLLLLLSGALALTQTWAGSHSMRYFFTSVSRPGRGEPRFIAVGYVDDTQFVRFDSDAASQRMEPRAPWIEQEGPEYWDQETRNVKAQSQTDRVDLGTLRGYYNQSEAGSHTIQIMYGCDVGSDGRFLRGYRQDAYDGKDYIALNEDLRSWTAADMAAQITKRKWEAAHEAEQLRAYLDGTCVEWLRRYLENGKETLQRTDPPKTHMTHHPISDHEATLRCWALGFYPAEITLTWQRDGEDQTQDTELVETRPAGDGTFQKWAAVVVPSGEEQRYTCHVQHEGLPKPLTLRWDRKGGSYTQAASSDSAQGSDVSLTACK

SEQ ID NO: 6492 - protein, 131 aa, Homo Sapiens
MRVMAPRALLLLLSGGLALTETWACSHSMRYFDTAVSRPGRGEPRFISVGYVDDTQFVRFDSDAASPRGEPRAPWVEQEGPEYWDRETQKYKRQAQADRVSLRNLRGYYNQSEDEDVWLRPGARRAPPPRV

SEQ ID NO: 6493 - protein, 366 aa, Homo Sapiens
MRVMAPRALLLLLSGGLALTETWACSHSMRYFDTAVSRPGRGEPRFISVGYVDDTQFVRFDSDAASPRGEPRAPWVEQEGPEYWDRETQKYKRQAQADRVSLRNLRGYYNQSEDGSHTLQRMSGCDLGPDGRLLRGYDQSAYDGKDYIALNEDLRSWTAADTAAQITQRKLEAARAAEQLRAYLEGTCVEWLRRYLENGKETLQRAEPPKTHVTHHPLSDHEATLRCWALGFYPAEITLTWQRDGEDQTQDTELVETRPAGDGTFQKWAAVVVPSGQEQRYTCHMQHEGLQEPLTLSWEPSSQPTIPIMGIVAGLAVLVVLAVLGAVVTAMMCRRKSSGGKGGSCSQAACSNSAQGSDESLITCKA

SEQ ID NO: 6494 - protein, 372 aa, Homo Sapiens
MRVMAPRALLLLLSGGLALTETWACSHSMRYFDTAVSRPGRGEPRFISVGYVDDTQFVRFDSDAASPRGEPRAPWVEQEGPEYWDRETQKYKRQAQADRVSLRNLRGYYNQSEDGSHTLQRMSGCDLGPDGRLLRGYDQSAYDGKDYIALNEDLRSWTAADTAAQITQRKLEAARAAEQLRAYLEGTCVEWLRRYLENGKETLQRAEPPKTHVTHHPLSDHEATLRCWALGFYPAEITLTWQRDGEDQTQDTELVETRPAGDGTFQKWAAVVVPSGQEQRYTCHMQHEGLQEPLTLSWEPSSQPTIPIMGIVAGLAVLVVLAVLGAVVTAMMCRRKSSGHFLPTGGKGGSCSQAACSNSAQGSDESLITCKA

SEQ ID NO: 6495 - protein, 244 aa, Homo Sapiens
MSGCDLGPDGRLLRGYDQSAYDGKDYIALNEDLRSWTAADTAAQITQRKLEAARAAEQLRAYLEGTCVEWLRRYLENGKETLQRAEPPKTHVTHHPLSDHEATLRCWALGFYPAEITLTWQRDGEDQTQDTELVETRPAGDGTFQKWAAVVVPSGQEQRYTCHMQHEGLQEPLTLSWEPSSQPTIPIMGIVAGLAVLVVLAVLGAVVTAMMCRRKSSGGKGGSCSQAACSNSAQGSDESLITCK

SEQ ID NO: 6496 - protein, 261 aa, Homo Sapiens
  misc_feature (1)..(1): Xaa can be any naturally occurring amino acid
XRVMAPRALLLLLSGGLALTETWACSHSMRYFDTAVSRPGRGEPRFISVGYVDDTQFVRFDSDAASPRGEPRAPWVEQEGPEYWDRETQKYKRQAQADRVSLRNLRGYYNQSEDGSHTLQRMSGCDLGPDGRLLRGYDQSAYDGKDYIALNEDLRSWTAADTAAQITQRKLEAARAAEQLRAYLEGTCVEWLRRYLENGKETLQRAEPPKTHVTHHPLSDHEASRRWNLPEVGSCGGAFWTRAEIHVPYAARGAARAPHPE

SEQ ID NO: 6497 - protein, 250 aa, Homo Sapiens
MALRAGLVLGFHTLMTLLSPQEAGATKADHMGSYGPAFYQSYGASGQFTHEFDEEQLFSVDLKKSEAVWRLPEFGDFARFDPQGGLAGIAAIKAHLDILVERSNRSRAINVPPRVTVLPKSRVELGQPNILICIVDNIFPPVINITWLRNGQTVTEGVAQTSFYSQPDHLFRKFHYLPFVPSAEDVYDCQVEHWGLDAPLLRHWELQVPIPPPDAMETLVCALGLAIGLVGFLVGTVLIIMGTYVSSVPR

SEQ ID NO: 6498 - protein, 86 aa, Homo Sapiens
MALRAGLVLGFHTLMTLLSPQEAGATKGRAGRHRRNQSPSGHPGGALQPQQSHQRASTGDRAPQVSGGAGPAQHPHLHRGQHLPPC

SEQ ID NO: 6499 - protein, 23 aa, Homo Sapiens
MRPEDRMFHIRAVILRALSLAFL

SEQ ID NO: 6500 - protein, 209 aa, Homo Sapiens
MRPEDRMFHIRAVILRALSLAFLLSLRGAGAIKADHVSTYAAFVQTHRPTGEFMFEFDEDEMFYVDLDKKETVWHLEEFGQAFSFEAQGGLANIAILNNNLNTLIQRSNHTQATNDPPEVTVFPKEPVELGQPNTLICHIDKFFPPVLNVTWLCNGELVTEGVAESLFLPRTDYSFHKFHYLTFVPSAEDFYDCRVEHWGLDQPLLKHW

SEQ ID NO: 6501 - protein, 260 aa, Homo Sapiens
MRPEDRMFHIRAVILRALSLAFLLSLRGAGAIKADHVSTYAAFVQTHRPTGEFMFEFDEDEMFYVDLDKKETVWHLEEFGQAFSFEAQGGLANIAILNNNLNTLIQRSNHTQATNDPPEVTVFPKEPVELGQPNTLICHIDKFFPPVLNVTWLCNGELVTEGVAESLFLPRTDYSFHKFHYLTFVPSAEDFYDCRVEHWGLDQPLLKHWEAQEPIQMPETTETVLCALGLVLGLVGIIVGTVLIIKSLRSGHDPRAQGTL

SEQ ID NO: 6502 - protein, 128 aa, Homo Sapiens
  misc_feature (1)..(1): Xaa can be any naturally occurring amino acid
XNTLICHIDKFFPPVLNVTWLCNGELVTEGVAESLFLPRTDYSFHKFHYLTFVPSAEDFYDCRVEHWGLDQPLLKHWEAQEPIQMPETTETVLCALGLVLGLVGIIVGTVLIIKSLRSGHDPRAQGTL

SEQ ID NO: 6503 - protein, 24 aa, Homo Sapiens
MILNKALLLGALALTTVMSPCGGE

SEQ ID NO: 6504 - protein, 255 aa, Homo Sapiens
MILNKALLLGALALTTVMSPCGGEDIVADHVASCGVNLYQFYGPSGQYTHEFDGDEQFYVDLERKETAWRWPEFSKFGGFDPQGALRNMAVAKHNLNIMIKRYNSTAATNEVPEVTVFSKSPVTLGQPNTLICLVDNIFPPVVNITWLSNGQSVTEGVSETSFLSKSDHSFFKISYLTFLPSADEIYDCKVEHWGLDQPLLKHWEPEIPAPMSELTETVVCALGLSVGLMGIVVGTVFIIQGLRSVGASRHQGPL

SEQ ID NO: 6505 - protein, 255 aa, Homo Sapiens; identical to SEQ ID NO: 6504

SEQ ID NO: 6506 - protein, 255 aa, Homo Sapiens; identical to SEQ ID NO: 6504

SEQ ID NO: 6507 - protein, 214 aa, Homo Sapiens
MILNKALLLGALALTTVMSPCGGEDIVADHVASCGVNLYQFYGPSGQYTHEFDGDEQFYVDLERKETAWRWPEFSKFGGFDPQGALRNMAVAKHNLNIMIKRYNSTAATNEVPEVTVFSKSPVTLGQPNTLICLVDNIFPPVVNITWLSNGQSVTEGVSETSFLSKSDHSFFKISYLTFLPSADEIYDCKVEHWGLDQPLLKHWGASPSTGAEE

SEQ ID NO: 6508 - protein, 53 aa, Homo Sapiens
MILNKALLLGALALTTVMSPCGGEDIVGSISDSLLLYRDGQWVCKTKVEKSDS

SEQ ID NO: 6509 - protein, 136 aa, Homo Sapiens
MSWKKALRIPGDLRVATVTLMLAMLSSLLAEGRDSPEDFVFQFKGMCYFTNGTERVRLVTRYIYNREEYARFDSDVGVYRAVTPQGRPDAEYWNSQKEVLEGTRAELDTVCRHNYEVAFRGILQRRGMVTGLSRSW

SEQ ID NO: 6510 - protein, 269 aa, Homo Sapiens
MSWKKALRIPGDLRVATVTLMLAMLSSLLAEGRDSPEDFVFQFKGMCYFTNGTERVRLVTRYIYNREEYARFDSDVGVYRAVTPQGRPDAEYWNSQKEVLEGTRAELDTVCRHNYEVAFRGILQRRVEPTVTISPSRTEALNHHNLLVCSVTDFYPGQIKVRWFRNDQEETAGVVSTPLIRNGDWTFQILVMLEMTPQRGDVYTCHVEHPSLQSPITVEWRAQSESAQSKMLSGVGGFVLGLIFLGLGLIIRQRSQKGPQGPPPAGLLH

SEQ ID NO: 6511 - protein, 261 aa, Homo Sapiens
MSWKKALRIPGDLRVATVTLMLAMLSSLLAEGRDSPEDFVFQFKGMCYFTNGTERVRLVTRYIYNREEYARFDSDVGVYRAVTPQGRPDAEYWNSQKEVLEGTRAELDTVCRHNYEVAFRGILQRRVEPTVTISPSRTEALNHHNLLVCSVTDFYPGQIKVRWFRNDQEETAGVVSTPLIRNGDWTFQILVMLEMTPQRGDVYTCHVEHPSLQSPITVEWRAQSESAQSKMLSGVGGFVLGLIFLGLGLIIRQRSQKGLLH

SEQ ID NO: 6512 - protein, 261 aa, Homo Sapiens; identical to SEQ ID NO: 6511

SEQ ID NO: 6513 - protein, 224 aa, Homo Sapiens
MSWKKALRIPGDLRVATVTLMLAMLSSLLAEGRDSPEDFVFQFKGMCYFTNGTERVRLVTRYIYNREEYARFDSDVGVYRAVTPQGRPDAEYWNSQKEVLEGTRAELDTVCRHNYEVAFRGILQRRVEPTVTISPSRTEALNHHNLLVCSVTDFYPGQIKVRWFRNDQEETAGVVSTPLIRNGDWTFQILVMLEMTPQRGDVYTCHVEHPSLQSPITVEWRLLH

SEQ ID NO: 6514 - protein, 134 aa, Homo Sapiens
MSWKKALRIPGDLRVATVTLMLAMLSSLLAEGRDSPVEPTVTISPSRTEALNHHNLLVCSVTDFYPGQIKVRWFRNDQEETAGVVSTPLIRNGDWTFQILVMLEMTPQRGDVYTCHVEHPSLQSPITVEWRLLH

SEQ ID NO: 6515 - protein, 275 aa, Homo Sapiens
MALQIPGGFWAAAVTVMLVMLSTPVAEARDFPKDFLVQFKGMCYFTNGTERVRGVARYIYNREEYGRFDSDVGEFQAVTELGRSIEDWNNYKDFLEQERAAVDKVCRHNYEAELRTTLQRQVEPTVTISPSRTEALNHHNLLVCSVTDFYPAQIKVRWFRNDQEETAGVVSTSLIRNGDWTFQILVMLEITPQRGDIYTCQVEHPSLQSPITVEWRAQSESAQSKMLSGIGGFVLGLIFLGLGLIIRHRGQKGPRGPPPAGNISAMIQSGERAQA

SEQ ID NO: 6516 - protein, 264 aa, Homo Sapiens
MALQIPGGFWAAAVTVMLVMLSTPVAEARDFPKDFLVQFKGMCYFTNGTERVRGVARYIYNREEYGRFDSDVGEFQAVTELGRSIEDWNNYKDFLEQERAAVDKVCRHNYEAELRTTLQRQVEPTVTISPSRTEALNHHNLLVCSVTDFYPAQIKVRWFRNDQEETAGVVSTSLIRNGDWTFQILVMLEITPQRGDIYTCQVEHPSLQSPITVEWRAQSESAQSKMLSGIGGFVLGLIFLGLGLIIRHRGQKGPRGPPPAGLLH

SEQ ID NO: 6517 - protein, 227 aa, Homo Sapiens
MALQIPGGFWAAAVTVMLVMLSTPVAEARDFPKDFLVQFKGMCYFTNGTERVRGVARYIYNREEYGRFDSDVGEFQAVTELGRSIEDWNNYKDFLEQERAAVDKVCRHNYEAELRTTLQRQVEPTVTISPSRTEALNHHNLLVCSVTDFYPAQIKVRWFRNDQEETAGVVSTSLIRNGDWTFQILVMLEITPQRGDIYTCQVEHPSLQSPITVEWRPRGPPPAGLLH

SEQ ID NO: 6518 - protein, 218 aa, Homo Sapiens
  misc_feature (1)..(1): Xaa can be any naturally occurring amino acid
XLQIPGGFWAAAVTVMLVMLSTPVAEARDFPKDFLVQFKGMCYFTNGTERVRGVARYIYNREEYGRFDSDVGEFQAVTELGRSIEDWNNYKDFLEQERAAVDKVCRHNYEAELRTTLQRQVEPTVTISPSRTEALNHHNLLVCSVTDFYPAQIKVRWFRNDQEETAGVVSTSLIRNGDWTFQILVMLEITPQRGDIYTCQVEHPSLQSPITVEWRLLH

SEQ ID NO: 6519 - protein, 240 aa, Homo Sapiens
AIGSFHCGCEPGYQLKGRKCMDVNECRQNVCRPDQHCKNTRGGYKCIDLCPNGMTKAENGTCIDIDECKDGTHQCRYNQICENTRGSYRCVCPRGYRSQGVGRPCMDIDECENTDACQHECKNTFGSYQCICPPGYQLTHNGKTCQDIDECLEQNVHCGPNRMCFNMRGSYQCIDTPCPPNYQRDPVSGFCLKNCPPNDLECALSPYALEYKLVSLPFGIATNQDLIRLVAYTQDGVMHP

SEQ ID NO: 6520 - protein, 5635 aa, Homo Sapiens
MISWEVVHTVFLFALLYSSLAQDASPQSEIRAEEIPEGASTLAFVFDVTGSMYDDLVQVIEGASKILETSLKRPKRPLFNFALVPFHDPEIGPVTITTDPKKFQYELRELYVQGGGDCPEMSIGAIKIALEISLPGSFIYVFTDARSKDYRLTHEVLQLIQQKQSQVVFVLTGDCDDRTHIGYKVYEEIASTSSGQVFHLDKKQVNEVLKWVEEAVQASKVHLLSTDHLEQAVNTWRIPFDPSLKEVTVSLSGPSPMIEIRNPLGKLIKKGFGLHELLNIHNSAKVVNVKEPEAGMWTVKTSSSGRHSVRITGLSTIDFRAGFSRKPTLDFKKTVSRPVQGIPTYVLLNTSGISTPARIDLLELLSISGSSLKTIPVKYYPHRKPYGIWNISDFVPPNEAFFLKVTGYDKDDYLFQRVSSVSFSSIVPDAPKVTMPEKTPGYYLQPGQIPCSVDSLLPFTLSFVRNGVTLGVDQYLKESASVNLDIAKVTLSDEGFYECIAVSSAGTGRAQTFFDVSEPPPVIQVPNNVTVTPGERAVLTCLIISAVDYNLTWQRNDRDVRLAEPARIRTLANLSLELKSVKFNDAGEYHCMVSSEGGSSAASVFLTVQEPPKVTVMPKNQSFTGGSEVSIMCSATGYPKPKIAWTVNDMFIVGSHRYRMTSDGTLFIKNAAPKDAGIYGCLASNSAGTDKQNSTLRYIEAPKLMVVQSELLVALGDITVMECKTSGIPPPQVKWFKGDLELRPSTFLIIDPLLGLLKIQETQDLDAGDYTCVAINEAGRATGKITLDVGSPPVFIQEPADVSMEIGSNVTLPCYVQGYPEPTIKWRRLDNMPIFSRPFSVSSISQLRTGALFILNLWASDKGTYICEAENQFGKIQSETTVTVTGLVAPLIGISPSVANVIEGQQLTLPCTLLAGNPIPERRWIKNSAMLLQNPYITVRSDGSLHIERVQLQDGGEYTCVASNVAGTNNKTTSVVVHVLPTIQHGQQILSTIEGIPVTLPCKASGNPKPSVIWSKKGELISTSSAKFSAGADGSLYVVSPGGEESGEYVCTATNTAGYAKRKVQLTVYVRPRVFGDQRGLSQDKPVEISVLAGEEVTLPCEVKSLPPPIITWAKETQLISPFSPRHTFLPSGSMKITETRTSDSGMYLCVATNIAGNVTQAVKLNVHVPPKIQRGPKHLKVQVGQRVDIPCNAQGTPLPVITWSKGGSTMLVDGEHHVSNPDGTLSIDQATPSDAGIYTCVATNIAGTDETEITLHVQEPPTVEDLEPPYNTTFQERVANQRIEFPCPAKGTPKPTIKWLHNGRELTGREPGISILEDGTLLVIASVTPYDNGEYICVAVNEAGTTERKYNLKVHVPPVIKDKEQVTNVSVLLNQLTNLFCEVEGTPSPIIMWYKDNVQVTESSTIQTVNNGKILKLFRATPEDAGRYSCKAINIAGTSQKYFNIDVLVPPTIIGTNFPNEVSVVLNRDVALECQVKGTPFPDIHWFKDGKPLFLGDPNVELLDRGQVLHLKNARRNDKGRYQCTVSNAAGKQAKDIKLTIYIPPSIKGGNVTTDISVLINSLIKLECETRGLPMPAITWYKDGQPIMSSSQALYIDKGQYLHIPRAQVSDSATYTCHVANVAGTAEKSFHVDVYVPPMIEGNLATPLNKQVVIAHSLTLECKAAGNPSPILTWLKDGVPVKANDNIRIEAGGKKLEIMSAQEIDRGQYICVATSVAGEKEIKYEVDVLVPPAIEGGDETSYFIVMVNNLLELDCHVTGSPPPTIMWLKDGQLIDERDGFKILLNGRKLVIAQAQVSNTGLYRCMAANTAGDHKKEFEVTVHVPPTIKSSGLSERVVVKYKPVALQCIANGIPNPSITWLKDDQPVNTAQGNLKIQSSGRVLQIAKTLLEDAGRYTCVATNAAGETQQHIQLHVHEPPSLEDAGKMLNETVLVSNPVQLECKAAGNPVPVITWYKDNRLLSGSTSMTFLNRGQIIDIESAQISDAGIYKCVAINSAGATELFYSLQVHVAPSISGSNNMVAVVVNNPVRLECEARGIPAPSLTWLKDGSPVSSFSNGLQVLSGGRILALTSAQISDTGRYTCVAVNAAGEKQRDIDLRVYVPPNIMGEEQNVSVLISQAVELLCQSDAIPPPTLTWLKDGHPLLKKPGLSISENRSVLKIEDAQVQDTGRYTCEATNVAGKTEKNYNVNIWVPPNIGGSDELTQLTVIEGNLISLLCESSGIPPPNLIWKKKGSPVLTDSMGRVRILSGGRQLQISIAEKSDAALYSCVASNVAGTAKKEYNLQVYIRPTITNSGSHPTEIIVTRGKSISLECEVQGIPPPTVTWMKDGHPLIKAKGVEILDEGHILQLKNIHVSDTGRYVCVAVNVAGMTDKKYDLSVHAPPSIIGNHRSPENISVVEKNSVSLTCEASGIPLPSITWFKDGWPVSLSNSVRILSGGRMLRLMQTTMEDAGQYTCVVRNAAGEERKIFGLSVLVPPHIVGENTLEDVKVKEKQSVTLTCEVTGNPVPEITWHKDGQPLQEDEAHHIISGGRFLQITNVQVPHTGRYTCLASSPAGHKSRSFSLNVFVSPTIAGVGSDGNPEDVTVILNSPTSLVCEAYSYPPATITWFKDGTPLESNRNIRILPGGRTLQILNAQEDNAGRYSCVATNEAGEMIKHYEVKVYIPPIINKGDLWGPGLSPKEVKIKVNNTLTLECEAYAIPSASLSWYKDGQPLKSDDHVNIAANGHTLQIKEAQISDTGRYTCVASNIAGEDELDFDVNIQVPPSFQKLWEIGNMLDTGRNGEAKDVIINNPISLYCETNAAPPPTLTWYKDGHPLTSSDKVLILPGGRVLQIPRAKVEDAGRYTCVAVNEAGEDSLQYDVRVLVPPIIKGANSDLPEEVTVLVNKSALIECLSSGSPAPRNSWQKDGQPLLEDDHHKFLSNGRILQILNTQITDIGRYVCVAENTAGSAKKYFNLNVHVPPSVIGPKSENLTVVVNNFISLTCEVSGFPPPDLSWLKNEQPIKLNTNTLIVPGGRTLQIIRAKVSDGGEYTCIAINQAGESKKKFSLTVYVPPSIKDHDSESLSVVNVREGTSVSLECESNAVPPPVITWYKNGRMITESTHVEILADGQMLHIKKAEVSDTGQYVCRAINVAGRDDKNFHLNVYVPPSIEGPEREVIVETISNPVTLTCDATGIPPPTIAWLKNHKRIENSDSLEVRILSGGSKLQIARSQHSDSGNYTCIASNMEGKAQKYYFLSIQVPPSVAGAEIPSDVSVLLGENVELVCNANGIPTPLIQWLKDGKPIASGETERIRVSANGSTLNIYGALTSDTGKYTCVATNPAGEEDRIFNLNVYVTPTIRGNKDEAEKLMTLVDTSINIECRATGTPPPQINWLKNGLPLPLSSHIRLLAAGQVIRIVRAQVSDVAVYTCVASNRAGVDNKHYNLQVFAPPNMDNSMGTEEITVLKGSSTSMACITDGTPAPSMAWLRDGQPLGLDAHLTVSTHGMVLQLLKAETEDSGKYTCIASNEAGEVSKHFILKVLEPPHINGSEEHEEISVIVNNPLELTCIASGIPAPKMTWMKDGRPLPQTDQVQTLGGGEVLRISTAQVEDTGRYTCLASSPAGDDDKEYLVRVHVPPNIAGTDEPRDITVLRNRQVTLECKSDAVPPPVITWLRNGERLQATPRVRILSGGRYLQINNADLGDTANYTCVASNIAGKTTREFILTVNVPPNIKGGPQSLVILLNKSTVLECIAEGVPTPRITWRKDGAVLAGNHARYSILENGFLHIQSAHVTDTGRYLCMATNAAGTDRRRIDLQVHVPPSIAPGPTNMTVIVNVQTTLACEATGIPKPSINWRKNGHLLNVDQNQNSYRLLSSGSLVIISPSVDDTATYECTVTNGAGDDKRTVDLTVQVPPSIADEPTDFLVTKHAPAVITCTASGVPFPSIHWTKNGIRLLPRGDGYRILSSGAIEILATQLNHAGRYTCVARNAAGSAHRHVTLHVHEPPVIQPQPSELHVILNNPILLPCEATGTPSPFITWQKEGINVNTSGRNHAVLPSGGLQISRAVREDAGTYMCVAQNPAGTALGKIKLNVQVPPVISPHLKEYVIAVDKPITLSCEADGLPPPDITWHKDGRAIVESIRQRVLSSGSLQIAFVQPGDAGHYTCMAANVAGSSSTSTKLTVHVPPRIRSTEGHYTVNENSQAILPCVADGIPTPAINWKKDNVLLANLLGKYTAEPYGELILENVVLEDSGFYTCVANNAAGEDTHTVSLTVHVLPTFTELPGDVSLNKGEQLRLSCKATGIPLPKLTWTFNNNIIPAHFDSVNGHSELVIERVSKEDSGTYVCTAENSVGFVKAIGFVYVKEPPVFKGDYPSNWIEPLGGNAILNCEVKGDPTPTIQWNRKGVDIEISHRIRQLGNGSLAIYGTVNEDAGDYTCVATNEAGVVERSMSLTLQSPPIITLEPVETVINAGGKIILNCQATGEPQPTITWSRQGHSISWDDRVNVLSNNSLYIADAQKEDTSEFECVARNLMGSVLVRVPVIVQVHGGFSQWSAWRACSVTCGKGIQKRSRLCNQPLPANGGKPCQGSDLEMRNCQNKPCPVDGSWSEWSLWEECTRSCGRGNQTRTRTCNNPSVQHGGRPCEGNAVEIIMCNIRPCPVHGAWSAWQPWGTCSESCGKGTQTRARLCNNPPPAFGGSYCDGAETQMQVCNERNCPIHGKWATWASWSACSVSCGGGARQRTRGCSDPVPQYGGRKCEGSDVQSDFCNSDPCPTHGNWSPWSGWGTCSRTCNGGQMRRYRTCDNPPPSNGGRACGGPDSQIQRCNTDMCPVDGSWGSWHSWSQCSASCGGGEKTRKRLCDHPVPVKGGRPCPGDTTQVTRCNVQACPGGPQRARGSVIGNINDVEFGIAFLNATITDSPNSDTRIIRAKITNVPRSLGSAMRKIVSILNPIYWTTAKEIGEAVNGFTLTNAVFKRETQVEFATGEILQMSHIARGLDSDGSLLLDIVVSGYVLQLQSPAEVTVKDYTEDYIQTGPGQLYAYSTRLFTIDGISIPYTWNHTVFYDQAQGRMPFLVETLHASSVESDYNQIEETLGFKIHASISKGDRSNQCPSGFTLDSVGPFCADEDECAAGNPCSHSCHNAMGTYYCSCPKGLTIAADGRTCQDIDECALGRHTCHAGQDCDNTIGSYRCVVRCGSGFRRTSDGLSCQDINECQESSPCHQRCFNAIGSFHCGCEPGYQLKGRKCMDVNECRQNVCRPDQHCKNTRGGYKCIDLCPNGMTKAENGTCIDIDECKDGTHQCRYNQICENTRGSYRCVCPRGYRSQGVGRPCMDINECEQVPKPCAHQCSNTPGSFKCICPPGQHLLGDGKSCAGLERLPNYGTQYSSYNLARFSPVRNNYQPQQHYRQYSHLYSSYSEYRNSRTSLSRTRRTIRKTCPEGSEASHDTCVDIDECENTDACQHECKNTFGSYQCICPPGYQLTHNGKTCQDIDECLEQNVHCGPNRMCFNMRGSYQCIDTPCPPNYQRDPVSGFCLKNCPPNDLECALSPYALEYKLVSLPFGIATNQDLIRLVAYTQDGVMHPRTTFLMVDEEQTVPFALRDENLKGVVYTTRPLREAETYRMRVRASSYSANGTIEYQTTFIVYIAVSAYPY

SEQ ID NO: 6521 - protein, 595 aa, Homo Sapiens
MILAPEGSSSGKLRIPAAQERDAGTYTCRAVNELGDASAEIQLAVGHAPQLTELPRDVTVELGRSALLACRATGRPPPTVTWRRGDGQPLGLRLGAGRGSRSRQPDSGVLFFESVAPEDQAPYVCEARNVFGKVQAEARLIVTGHAPPQIASSAPTVRVLEGQPVSLPCIVLAGRPLPERHWLKDGRPLPPGSRHSIRADGSLHLDRALQEHAGRYSCVATNTAGSQHRDVELVVQVPPRIHPTATHHITNEGVAASLPCVASGVPAPTITWTKETNALTSRGPHYNVSKEGTLLIAQPSAQDAGAYVCTATNTVGFSSQEMRLSVNTKPRIHMNGSRNADVPLQVTAKAGEEVTLDCEAKGSPPPLVTWTKDSRPVPPITNRYGLLPSGSLRLAQVQVGDSGHYECTASNPAGSASHRYVLGVQGRTSWQPQSLPVPHHPACLSGLSVPLLQPTPRSVRLCHLSLRAPLPPPFATPTSCLSQACLSSSTLSLHLSPYPLRGPGDAVQRPPTTQGRAQWGLGFGRTGVRGEPMKVGLRGSLPGTRGPAGSPGCGDGKRPVRCHRAPPAGSILMPPRGPSEPLLPPLPSTRHFVHL

SEQ ID NO: 6522 - protein, 5059 aa, Homo Sapiens
MPGAPLLRLLTAVSAAVAVAVAGAPGTVMPPTTGDATLAFVFDVTGSMWDELMQVIDGASRILERSLSRRSQAIANYALVPFHDPDIGPVTLTADPTVFQRELRELYVQGGGDCPEMSVGAIKAAVEVANPGSFIYVFSDARAKDYHKKEELLRLLQLKQSQVVFVLTGDCGDRTHPGYLAYEEIAATSSGQVFHLDKQQVTEVLKWVESAIQASKVHLLSTDHEEEGEHTWRLPFDPSLKEVTISLSGPGPEIEVQDPLGRILQEDEGLNVLLNIPDSAKVVAFKPEHPGLWSIKVYSSGRHSVRITGVSNIDFRAGFSTQPLLDLNHTLEWPLQGVPISLVINSTGLKAPGRLDSVELAQSSGKPLLTLPTKPLSNGSTHQLWGGPPFHTPKERFYLKVKGKDHEGNPLLRVSGVSYSGVAPGAPLVSMAPRIHGYLHQPLLVSCSVHSALPFRLQLRRGEARLGEERHFQESGNSSWEILRASKAEEGTYECTAVSRAGTGRAKAQIVVTDPPPQLVPAPNVTVSPGETAVLSCRVLGEAPYNLTWVRDWRVLPASTGRVAQLADLSLEISGIIPTDGGRYQCVASNANGVTRASVWLLVREAPQVSIHTSSQHFSQGVEVKVSCSASGYPTPHISWSRESQALQEDSRIHVDAQGTLIIQGVAPEDAGNYSCQATNEVGTDQETVTLYYTDPPSVSAVNAVVLVAVGEEAVLVCEASGVPPPRVIWYRGGLEMILAPEGSSSGKLRIPAAQERDAGTYTCRAVNELGDASAEIQLAVGHAPQLTELPRDVTVELGRSALLACRATGRPPPTVTWRRGDGQPLGLRLGAGRGSRSRQPDSGVLFFESVAPEDQAPYVCEARNVFGKVQAEARLIVTGHAPPQIASSAPTVRVLEGQPVSLPCIVLAGRPLPERHWLKDGRPLPPGSRHSIRADGSLHLDRALQEHAGRYSCVATNTAGSQHRDVELVVQVPPRIHPTATHHITNEGVAASLPCVASGVPAPTITWTKETNALTSRGPHYNVSKEGTLLIAQPSAQDAGAYVCTATNTVGFSSQEMRLSVNTKPRIHMNGSRNADVPLQVTAKAGEEVTLDCEAKGSPPPLVTWTKDSRPVPPITNRYGLLPSGSLRLAQVQVGDSGHYECTASNPAGSASHRYVLGVQVPPQVQPGPRVLKVLVGEALDLNCVAEGNPEPQLSWSKDGVVLQGRGPQGSVHFAAIRTSDAGRYRCEASNSAGVDAWEVELRVLEPPHWGADETSGLLERVAGENASLPCPARGTPKPQVTWRKGPSSEPLHGQPGVAVLEEGSLFLASVSPADSGDYECQATNEVGSTSRRAKLVVYVPPSIREDGRKANVSGMAGQSLTLECDANGFPVPEIVWLKDAQLIPKVGGHRLLDEGQSLHFPRIQEGDSGLYSCRAENQAGTAQRDFHLLVLTPPSVLGAGAAQEVLGLAGADVELQCWTSGVPTPQVEWTKDRQPVLPGGPHLQVQEDGQVLRITGSHVGDEGRYQCVAFSPAGQQARDFQLRVHAPPTIWGSNETGEVAVMEDHLVQLLCEARGVPTPNITWFKDGALLPTSTKVVYTRGGRQLQLGRAQSSDAGVYTCKASNAVGAAEKATRLDVYVPPTIEGAGGRPYVVKAVAGRPVALECVARGHPSPTLSWHHEGLPVAESNESRLETDGSVLRLESPGEASSGLYSCVASSPAGEAVLQYSVEVQVPPQLLVAEGLGQVTTIVGQPLELPCQASGSPVPTIQWLQNGRPAEELAGVQVASQGTTLHIDHVELDHSGLFACQATNEAGTAGAEVEVSVHEFPSVSIIGGENITAPFLQPVTLQCIGDGVPTPSLRWWKDGVALAAFGGNLQIEKVDLRDEGIYTCAATNLAGESKREVALKVLVPPNIEPGPVNKAVLENASVTLECLASGVPPPDVSWFKGHQPVSSWMGVTVSVDGRVLRIEQAQLSDAGSYRCVASNVAGSTELRYGLRVNVPPRITLPPSLPGPVLVNTPVRLTCNATGAPSPTLMWLKDGNPVSPAGTPGLQVFPGGRVLTLASARASDSGRYSCVAVSAVGEDRQDVVLQVHMPPSILGEELNVSVVANESVALECQSHAMPPPVLSWWKDGRPLEPRPGVHLSADKALLQVDRADVWDAGHYTCEALNQAGHSEKHYNLNVWVAPVFPLRESHTLTVREGHPTRLSCECRGVPFPKISWRKDGQPLPGEGAGLQHVSAVGRLLYLGQAQLAQEGTYTCECSNVVGNSSQDLQLEVHVPPQIAGPREPPTQVSVVQDGVATLECNATGKPPPTVTWERDGQPVGAELGLQLQNQGQSLHVERAQAAHTGRYSCVAENLAGRAERKFELSVLVPPELIGDLDPLTNITAALHSPLTLLCEAMGIPPPAIRWFRGEEPVSPGEDTYLLAGGWMLKMTQTQEQDSGLYSCLASNEAGEARRNFSVEVLVPPSIENEDLEEVIKVLDGQTAHLMCNVTGHPQPKLTWFKDGRPLARGDAHHISPDGVLLQVLQANLSSAGHYSCIAANAVGEKTKHFQLSVLLAPTILGGAEDSADEEVTVTVNNPISLICEALAFPSPNITWMKDGAPFEASRNIQLLPGTHGLQILNAQKEDAGQYTCVVTNELGEAVKNYHVEVLIPPSISKDDPLAEVGVKEVKTKVNSTLTLECESWAVPPPTIRWYKDGQPVTPSSRLQVLGEGRLLQIQPTQVSDSGRYLCVATNVAGEDDQDFNVLIQVPPMFQKVGDFSAAFEILSREEEARGGVTEYREIVENNPAYLYCDTNAIPPPDLTWYREDQPLSAGDEVSVLQGGRVLQIPLVRAENAGRYSCKASNEVGEDWLHYELLVLTPPVILGDTEELVEEVTVNASSTVSLQCPALGNPVPTISWLQNGLPFSPSPRLQVLEDGQVLQVSTAEVADAASYMCVAENQAGSAEKLFTLRVQVPPRIAGLDLEQVTAILNSSVSLPCDVHAHPNPEVTWYKDSQALSLGEEVFLLPGTHTLQLGRARLSDSGMYTCEALNAAGRDQKLVQLSVLVPPAFRQAPRGPQDAVLVRVGDKAVLSCETDALPEPTVTWYKDGQPLVLAQRTQALRGGQRLEIQEAQVSDKGLYSCKVSNVAGEAVRTFTLTVQVPPTFENPKTETVSQVAGSPLVLTCDVSGVPAPTVTWLKDRMPVESSAVHGVVSRGGRLQLSRLQPAQAGTYTCVAENTQAEARKDFVVAVLVAPRIRSSGVAREHHVLEGQEVRLDCEADGQPPPDVAWLKDGSPLGQDMGPHLRFYLDGGSLVLKGLRASDAGAYTCVAHNPAGEDARLHTVNVLVPPTIKQGADGSGTLVSRPGELVTMVCPVRGSPPIHVSWLKDGLPLPLSQRTLLHGSGHTLRISKVQLADAGIFTCVAASPAGVADRNFTLQVQVPPVLEPVEFQNDVVVVRGSLVELPCEARGVPLPLVSWMKDGEPLLSQSLEQGPSLQLEAVGAGDSGTYSCVAVSEAGEARRHFQLTVMEPPHIEDSGQPTELSLTPGAPMELLCDAQGTPQPNITWHKDGQALTRLENNSRATRVLRVENVQVRDAGLYTCLAESPAGAIEKSFRVRVQAPPNIVGPRGPRFVVGLAPGQLVLECSVEAEPAPKITWHRDGIVLQEDAHTQFPERGRFLQLQALSTADSGDYSCTARNAAGSTSVAFRVEIHTVPTIRSGPPAVNVSVNQTALLPCQADGVPAPLVSWRKDRVPLDPRSPRFEILPEGSLRIQPVLAQDAGHYLCLASNSAGSDRQGRDLRVLALLPCEASGSPKPLVVWWKDGQKLDFRLQQGAYRLLPSNALLLTAPGPQDSAQFECVVSNEVGEAHRLYQVTVHVPPTIADDQTDFTVTMMAPVVLTCHSTGIPAPTVSWSKAGAQLGARGSGYRVSPSGALEIGQALPIHAGRYTCSARNSAGVAHKHVFLTVQASPVVKPLPSVVRAVAEEEVLLPCEASGIPRPTITWQKEGLNVATGVSTQVLPGGQLRIAHASPEDAGNYLCIAKNSAGSAMGKTRLVVQVPPVIENGLPDLSTTEGSHAFLPCKARGSPEPNITWDKDGQPVSGAEGKFTIQPSGELLVKNLEGQDAGTYTCTAENAVGRARRRVHLTILVLPVFTTLPGDRSLRLGDRLWLRCAARGSPTPRIGWTVNDRPVTEGVSEQDGGSTLQRAAVSREDSGTYVCWAENRVGRTQAVSFVHVKEAPVLQGEAFSYLVEPVGGSIQLDCVVRGDPVPDIHWIKDGLPLRGSHLRHQLQNGSLTIRRTERDDAGRYQCLAENEMGVAKKVVILVLQSAPVFQVEPQDMTVRSGDDVALRCQATGEPTPTIEWLQAGQPLRASRRLRTLPDGSLWLENVETGDAGTYDCVAHNLLGSATARAFLVVRGEPQGSWGSMTGVINGRKFGVATLNTSVMQEAHSGVSSIHSSIRHVPANVGPLMRVLVVTIAPIYWALARESGEALNGHSLTGGRFRQESHVEFATGELLTMTQVARGLDPDGLLLLDVVVNGVVPESLADADLQVQDFEEHYVQTGPGQLFVGSTQRFFQGGLPSFLRCNHSIQYNAARGPQPQLVQHLRASAISSAFDPEAEALRFQLATALQAEENEVGCPEGFELDSQGAFCVDRDECSGGPSPCSHACLNAPGRFSCTCPTGFALAWDDRNCRDVDECAWDAHLCREGQRCVNLLGSYRCLPDCGPGFRVADGAGCEDVDECLEGLDDCHYNQLCENTPGGHRCSCPRGYRMQGPSLPCLDVNECLQLPKACAYQCHNLQGSYRCLCPPGQTLLRDGKACTSLERNGQNVTTVSHRGPLLPWLRPWASIPGTSYHAWVSLRPGPMALSSVGRAWCPPGFIRQNGVCTDLDECRVRNLCQHACRNTEGSYQCLCPAGYRLLPSGKNCQDINECEEESIECGPGQMCFNTRGSYQCVDTPCPATYRQGPSPGTCFRRCSQDCGTGGPSTLQYRLLPLPLGVRAHHDVARLTAFSEVGVPANRTELSMLEPDPRSPFALRPLRAGLGAVYTRRALTRAGLYRLTVRAAAPRHQSVFVLLIAVSPYPY

SEQ ID NO: 6523 - protein, 309 aa, Homo Sapiens
  misc_feature (1)..(1): Xaa can be any naturally occurring amino acid
XPGQLFVGSTQRFFQGGLPSFLRCNHSIQYNAARGPQPQLVQHLRASAISSAFDPEAEALRFQLATALQAEENEVGCPEGFELDSQGAFCVDVDECAWDAHLCREGQRCVNLLGSYRCLPDCGPGFRVADGAGCEDVDECLEGLDDCHYNQLCENTPGGHRCSCPRGYRMQGPSLPCLDVNECLQLPKACAYQCHNLQGSYRCLCPPGQTLLRDGKACTSLERNGQNVTTVSHRGPLLPWLRPWASIPGTSYHAWVSLRPGPMALSSVGRAWCPPGFIRQNGVCTDLDECRVRNLCQHACRNTEGSYQC

SEQ ID NO: 6524 - protein, 479 aa, Homo Sapiens
  misc_feature (1)..(1): Xaa can be any naturally occurring amino acid
XVHAHPNPEVTWYKDSQALSLGEEVFLLPGTHTLQLGRARLSDSGMYTCEALNAAGRDQKLVQLSVLVPPAFRQAPRGPQDAVLVRVGDKAVLSCETDALPEPTVTWYKDGQPLVLAQRTQALRGGQRLEIQEAQVSDKGLYSCKVSNVAGEAVRTFTLTVQVPPTFENPKTETVSQVAGSPLVLTCDVSGVPAPTVTWLKDRMPVESSAVHGVVSRGGRLQLSRLQPAQAGTYTCVAENTQAEARKDFVVAVLVAPRIRSSGVAREHHVLEGQEVRLDCEADGQPPPDVAWLKDGSPLGQDMGPHLRFYLDGGSLVLKGLRASDAGAYTCVAHNPAGEDARLHTVNVLVPPTIKQGADGSGTLVSRPGELVTMVCPVRGSPPIHVSWLKDGLPLPLSQRTLLHGSGHTLRISKVQLADAGIFTCVAASPAGVADRNFTLQCPLSWSRWSSRMTWWWFVAPWWNSRARPGAFPCLSCRG

SEQ ID NO: 6525 - protein, 325 aa, Homo Sapiens
MAAMRKALPRRLVGLASLRAVSTSSMGTLPKRVKIVEVGPRDGLQNEKNIVSTPVKIKLIDMLSEAGLSVIETTSFVSPKWVPQMGDHTEVLKGIQKFPGINYPVLTPNLKGFEAAVAAGAKEVVIFGAASELFTKKNINCSIEESFQRFDAILKAAQSANISVRGYVSCALGCPYEGKISPAKVAEVTKKFYSMGCYEISLGDTIGVGTPGIMKDMLSAVMQEVPLAALAVHCHDTYGQALANTLMALQMGVSVVDSSVAGLGGCPYAQGASGNLATEDLVYMLEGLGIHTGVNLQKLLEAGNFICQALNRKTSSKVAQATCKL

SEQ ID NO: 6526 - protein, 254 aa, Homo Sapiens
MAAMRKALPRRLVGLASLRAVSTSSMGTLPKRVKIVEVGPRDGLQNEKNIVSTPVKIKLIDMLSEAGLSVIETTSFVSPKWVPQMGDHTEVLKGIQKFPGINYPVLTPNLKGFEAAVTKKFYSMGCYEISLGDTIGVGTPGIMKDMLSAVMQEVPLAALAVHCHDTYGQALANTLMALQMGVSVVDSSVAGLGGCPYAQGASGNLATEDLVYMLEGLGIHTGVNLQKLLEAGNFICQALNRKTSSKVAQATCKL

SEQ ID NO: 6527 - protein, 77 aa, Homo Sapiens
MLEARREWSRKVFPWSGATQQPGTPFHSPSQTLRRSAGQRPAGVPVPADVLLWTSSRLCVPPLMCSSPCPATCVSAC

SEQ ID NO: 6528 - protein, 182 aa, Homo Sapiens
  misc_feature (1)..(1): Xaa can be any naturally occurring amino acid
XKALPRRLVGLASLRAVSTSSMGTLPKRVKIVEVGPRDGLQNEKVTKKFYSMGCYEISLGDTIGVGTPGIMKDMLSAVMQEVPLAALAVHCHDTYGQALANTLMALQMGVSVVDSSVAGLGGCPYAQGASGNLATEDLVYMLEGLGIHTGVNLQKLLEAGNFICQALNRKTSSKVAQATCKL

SEQ ID NO: 6529 - protein, 53 aa, Homo Sapiens
MEIFIEVFSHFLLQLTELTLNMCLELPTGSLEKSLMISSQVLQIPVANSTKQR

SEQ ID NO: 6530 - protein, 139 aa, Homo Sapiens
MSISSALAMVFMGAKGNTAAQMSQALCFSKIGGEDGDIHRGFQSLLVAINRTDTEYVLRTANGLFGEKSYDFLTGFTDSCGKFYQATIKQLDFVNDTEKSTTRVNSWVADKTKGENILLFYFDNILNSFIVSSLQNCQI

SEQ ID NO: 6531 - protein, 442 aa, Homo Sapiens
MSALGAVIALLLWGQLFAVDSGNDVTDIADDGCPKPPEIAHGYVEHSVRYQCKNYYKLRTEGDGVYTLNDKKQWINKAVGDKLPECEADDGCPKPPEIAHGYVEHSVRYQCKNYYKLRTEGDGEAMPCSLPHVNLRVTFTSPADVGKEGMLMMMSPSPRVYTLNNEKQWINKAVGDKLPECEAVCGKPKNPANPVQRILGGHLDAKGSFPWQAKMVSHHNLTTGATLINEQWLLTTAKNLFLNHSENATAKDIAPTLTLYVGKKQLVEIEKVVLHPNYSQVDIGLIKLKQKVSVNERVMPICLPSKDYAEVGRVGYVSGWGRNANFKFTDHLKYVMLPVADQDQCIRHYEGSTVPEKKTPKSPVGVQPILNEHTFCAGMSKYQEDTCYGDAGSAFAVHDLEEDTWYATGILSFDKSCAVAEYGVYVKVTSIQDWVQKTIAEN

SEQ ID NO: 6532 - protein, 406 aa, Homo Sapiens
MSALGAVIALLLWGQLFAVDSGNDVTDIADDGCPKPPEIAHGYVEHSVRYQCKNYYKLRTEGDGVYTLNDKKQWINKAVGDKLPECEADDGCPKPPEIAHGYVEHSVRYQCKNYYKLRTEGDGVYTLNNEKQWINKAVGDKLPECEAVCGKPKNPANPVQRILGGHLDAKGSFPWQAKMVSHHNLTTGATLINEQWLLTTAKNLFLNHSENATAKDIAPTLTLYVGKKQLVEIEKVVLHPNYSQVDIGLIKLKQKVSVNERVMPICLPSKDYAEVGRVGYVSGWGRNANFKFTDHLKYVMLPVADQDQCIRHYEGSTVPEKKTPKSPVGVQPILNEHTFCAGMSKYQEDTCYGDAGSAFAVHDLEEDTWYATGILSFDKSCAVAEYGVYVKVTSIQDWVQKTIAEN

SEQ ID NO: 6533 - protein, 347 aa, Homo Sapiens
MSALGAVIALLLWGQLFAVDSGNDVTDIADDGCPKPPEIAHGYVEHSVRYQCKNYYKLRTEGDGVYTLNDKKQWINKAVGDKLPECEAVCGKPKNPANPVQRILGGHLDAKGSFPWQAKMVSHHNLTTGATLINEQWLLTTAKNLFLNHSENATAKDIAPTLTLYVGKKQLVEIEKVVLHPNYSQVDIGLIKLKQKVSVNERVMPICLPSKDYAEVGRVGYVSGWGRNANFKFTDHLKYVMLPVADQDQCIRHYEGSTVPEKKTPKSPVGVQPILNEHTFCAGMSKYQEDTCYGDAGSAFAVHDLEEDTWYATGILSFDKSCAVAEYGVYVKVTSIQDWVQKTIAEN

SEQ ID NO: 6534 - protein, 88 aa, Homo Sapiens
MSALGAVIALLLWGQLFAVDSGNDVTDIADDGCPKPPEIAHGYVEHSVRYQCKNYYKLRTEGDGVYTLNNEKQWINKAVGDKLPECEA

SEQ ID NO: 6535 - protein, 92 aa, Homo Sapiens
MSALGAVIALLLWGQLFAVDSGNDVTDIADDGCPKPPEIAHGYVEHSVRYQCKNYYKLRTEGDGVYTLNNEKQWINKAVGDKLPECEAAHTE

SEQ ID NO: 6536 - protein, 222 aa, Homo Sapiens
MSALGAVIALLLWGQLFAVDSGNDVTDIADDGCPKPPEIAHGYVEHSVRYQCKNYYKLRTEGDGVYTLNNEKQWINKAVGDKLPECEAGATLINEQWLLTTAKNLFLNHSENATAKDIAPTLTLYVGKKQLVEIEKVVLHPNYSQVDIGLIKLKQKVSVNERVMPICLPSKDYAEVGRVGYVSGWGRNANFKFTDHLKYVMLPVADQDQCIRHYEGSTVPEK

SEQ ID NO: 6537 - protein, 91 aa, Homo Sapiens
MSALGAVIALLLWGQLFAVDSGNDVTDIADDGCPKPPEIAHGYVEHSVRYQCKNYYKLRTEGDGVYTLNNEKQWINKAVGDKLPECEAGGC

SEQ ID NO: 6538 - protein, 347 aa, Homo Sapiens
MSALGAVIALLLWGQLFAVDSGNDVTDIADDGCPKPPEIAHGYVEHSVRYQCKNYYKLRTEGDGVYTLNNEKQWINKAVGDKLPECEAVCGKPKNPANPVQRILGGHLDAKGSFPWQAKMVSHHNLTTGATLINEQWLLTTAKNLFLNHSENATAKDIAPTLTLYVGKKQLVEIEKVVLHPNYSQVDIGLIKLKQKVSVNERVMPICLPSKDYAEVGRVGYVSGWGRNANFKFTDHLKYVMLPVADQDQCIRHYEGSTVPEKKTPKSPVGVQPILNEHTFCAGMSKYQEDTCYGDAGSAFAVHDLEEDTWYATGILSFDKSCAVAEYGVYVKVTSIQDWVQKTIAEN

SEQ ID NO: 6539 - protein, 347 aa, Homo Sapiens; identical to SEQ ID NO: 6538

SEQ ID NO: 6540 - protein, 281 aa, Homo Sapiens
MSRISQMTAARSPPRLHMAMWSTRFATSVRTNPVQRILGGHLDAKGSFPWQAKMVSHHNLTTGATLINEQWLLTTAKNLFLNHSENATAKDIAPTLTLYVGKKQLVEIEKVVLHPNYSQVDIGLIKLKQKVSVNERVMPICLPSKDYAEVGRVGYVSGWGRNANFKFTDHLKYVMLPVADQDQCIRHYEGSTVPEKKTPKSPVGVQPILNEHTFCAGMSKYQEDTCYGDAGSAFAVHDLEEDTWYATGILSFDKSCAVAEYGVYVKVTSIQDWVQKTIAEN

SEQ ID NO: 6541 - protein, 281 aa, Homo Sapiens; identical to SEQ ID NO: 6540

SEQ ID NO: 6542 - protein, 365 aa, Homo Sapiens
  misc_feature (1)..(1): Xaa can be any naturally occurring amino acid
XALGAVIALLLWGQLFAVDSGNDVTDIADDGCPKPPEIAHGYVEHSVRYQCKNYYKLRTEGDGVYTLNDKKQWINKAVGDKLPECEADDGCPKPPEIAHGYVEHSVRYQCKNYYKLRTEGDGVYTLNNEKQWINKAVGDKLPECEAGATLINEQWLLTTAKNLFLNHSENATAKDIAPTLTLYVGKKQLVEIEKVVLHPNYSQVDIGLIKLKQKVSVNERVMPICLPSKDYAEVGRVGYVSGWGRNANFKFTDHLKYVMLPVADQDQCIRHYEGSTVPEKKTPKSPVGVQPILNEHTFCAGMSKYQEDTCYGDAGSAFAVHDLEEDTWYATGILSFDKSCAVAEYGVYVKVTSIQDWVQKTIAEN

SEQ ID NO: 6543 - protein, 149 aa, Homo Sapiens
  misc_feature (1)..(1): Xaa can be any naturally occurring amino acid
XALGAVIALLLWGQLFAVDSGNDVTDIADDGCPKPPEIAHGYVEHSVRYQCKNYYKLRTEGDGVYTLNDKKQWINKAVGDKLPECEADDGCPKPPEIAHGYVEHSVRYQCKNYYKLRTEGDGVYTLNNEKQWINKAVGDKLPECEAGGC

SEQ ID NO: 6544 - protein, 404 aa, Homo Sapiens
  misc_feature (1)..(1): Xaa can be any naturally occurring amino acid
XALGAVIALLLWGQLFAVDSGNDVTDIADDGCPKPPEIAHGYVEHSVRYQCKNYYKLRTEGDGVYTLNDKKQWINKAVGDKLPECEADDGCPKPPEIAHGYVEHSVRYQCKNYYKLRTEGDVYTLNNEKQWINKAVGDKLPECEAVCGKPKNPANPVQRILGGHLDAKGSFPWQAKMVSHHNLTTGATLINEQWLLTTAKNLFLNHSENATAKDIAPTLTLYVGKKQLVEIEKVVLHPNYSQVDIGLIKLKQKVSVNERVMPICLPSKDYAEVGRVGYVSGWGRNANFKFTDHLKYVMLPVADQDQCIRHYEGSTVPEKKTPKSPVGVQPILNEHTFCAGMSKYQEDTCYGDAGSAFAVHDLEEDTWYATGILSFDKSCAVAEYGVYVKVTSIQDWVQKTIAEN

SEQ ID NO: 6545 - protein, 348 aa, Homo Sapiens
MSDLGAVISLLLWGRQLFALYSGNDVTDISDDRFPKPPEIANGYVEHLFRYQCKNYYRLRTEGDGVYTLNDKKQWINKAVGDKLPECEAVCGKPKNPANPVQRILGGHLDAKGSFPWQAKMVSHHNLTTGATLINEQWLLTTAKNLFLNHSENATAKDIAPTLTLYVGKKQLVEIEKVVLHPNYHQVDIGLIKLKQKVLVNERVMPICLPSKNYAEVGRVGYVSGWGQSDNFKLTDHLKYVMLPVADQYDCITHYEGSTCPKWKAPKSPVGVQPILNEHTFCVGMSKYQEDTCYGDAGSAFAVHDLEEDTWYAAGILSFDKSCAVAEYGVYVKVTSIQHWVQKTIAEN

SEQ ID NO: 6546 - protein, 117 aa, Homo Sapiens
MSDLGAVISLLLWGRQLFALYSGNDVTDISDDRFPKPPEIANGYVEHLFRYQCKNYYRLRTEGDGVYTLNDKKQWINKAVGDKLPECEAVCGKPKNPANPVQRILGGHLVRGWDPKL

SEQ ID NO: 6547 - protein, 281 aa, Homo Sapiens
MSRIFQMTASRSPLRLQMAMWSTCFATSVRTNPVQRILGGHLDAKGSFPWQAKMVSHHNLTTGATLINEQWLLTTAKNLFLNHSENATAKDIAPTLTLYVGKKQLVEIEKVVLHPNYHQVDIGLIKLKQKVLVNERVMPICLPSKNYAEVGRVGYVSGWGQSDNFKLTDHLKYVMLPVADQYDCITHYEGSTCPKWKAPKSPVGVQPILNEHTFCVGMSKYQEDTCYGDAGSAFAVHDLEEDTWYAAGILSFDKSCAVAEYGVYVKVTSIQHWVQKTIAEN

SEQ ID NO: 6548 - protein, 485 aa, Homo Sapiens
MLLRSKPALPPPLMLLLLGPLGPLSPGALPRPAQAQDVVDLDFFTQEPLHLVSPSFLSVTIDANLATDPRFLILLGSPKLRTLARGLSPAYLRFGGTKTDFLIFDPKKESTFEERSYWQSQVNQDICKYGSIPPDVEEKLRLEWPYQEQLLLREHYQKKFKNSTYSKPNSFLKKADIFINGSQLGEDFIQLHKLLRKSTFKNAKLYGPDVGQPRRKTAKMLKSFLKAGGEVIDSVTWHHYYLNGRTATKEDFLNPDVLDIFISSVQKVFQVVESTRPGKKVWLGETSSAYGGGAPLLSDTFAAGFMWLDKLGLSARMGIEVVMRQVFFGAGNYHLVDENFDPLPDYWLSLLFKKLVGTKVLMASVQGSKRRKLRVYLHCTNTDNPRYKEGDLTLYAINLHNVTKYLRLPYPFSNKQVDKYLLRPLGPHGLLSKSVQLNGLTLKMVDDQTLPPLMEKPLRPGSSLGLPAFSYSFFVIRNAKVAACI

SEQ ID NO: 6549 - protein, 226 aa, Homo Sapiens
MLLRSKPALPPPLMLLLLGPLGPLSPGALPRPAQAQDVVDLDFFTQEPLHLVSPSFLSVTIDANLATDPRFLILLGSPKLRTLARGLSPAYLRFGGTKTDFLIFDPKKESTFEERSYWQSQVNQDICKYGSIPPDVEEKLRLEWPYQEQLLLREHYQKKFKNSTYSRSSVDVLYTFANCSGLDLIFGLNALLRTADLQWNSSNAQLLLDYCSSKGYNISWELGNAS

SEQ ID NO: 6550 - protein, 543 aa, Homo Sapiens
MLLRSKPALPPPLMLLLLGPLGPLSPGALPRPAQAQDVVDLDFFTQEPLHLVSPSFLSVTIDANLATDPRFLILLGSPKLRTLARGLSPAYLRFGGTKTDFLIFDPKKESTFEERSYWQSQVNQDICKYGSIPPDVEEKLRLEWPYQEQLLLREHYQKKFKNSTYSRSSVDVLYTFANCSGLDLIFGLNALLRTADLQWNSSNAQLLLDYCSSKGYNISWELGNEPNSFLKKADIFINGSQLGEDFIQLHKLLRKSTFKNAKLYGPDVGQPRRKTAKMLKSFLKAGGEVIDSVTWHHYYLNGRTATKEDFLNPDVLDIFISSVQKVFQVVESTRPGKKVWLGETSSAYGGGAPLLSDTFAAGFMWLDKLGLSARMGIEVVMRQVFFGAGNYHLVDENFDPLPDYWLSLLFKKLVGTKVLMASVQGSKRRKLRVYLHCTNTDNPRYKEGDLTLYAINLHNVTKYLRLPYPFSNKQVDKYLLRPLGPHGLLSKSVQLNGLTLKMVDDQTLPPLMEKPLRPGSSLGLPAFSYSFFVIRNAKVAACI

SEQ ID NO: 6551 - protein, 543 aa, Homo Sapiens; identical to SEQ ID NO: 6550

SEQ ID NO: 6552 - protein, 380 aa, Homo Sapiens
MLLRSKPALPPPLMLLLLGPLGPLSPGALPRPAQAQDVVDLDFFTQEPLHLVSPSFLSVTIDANLATDPRFLILLGSPKLRTLARGLSPAYLRFGGTKTDFLIFDPKKESTFEERSYWQSQVNQDICKYGSIPPDVEEKLRLEWPYQEQLLLREHYQKKFKNSTYSRSSVDVLYTFANCSGLDLIFGLNALLRTADLQWNSSNAQLLLDYCSSKGYNISWELGNEPNSFLKKADIFINGSQLGEDFIQLHKLLRKSTFKNAKLYGPDVGQPRRKTAKMLKSFLKAGGEVIDSVTWHHYYLNGRTATKEDFLNPDVLDIFISSVQKVFQVVESTRPGKKVWLGETSSAYGGGAPLLSDTFAAGFMIIGYLFCSRNWWAPRC

SEQ ID NO: 6553 - protein, 469 aa, Homo Sapiens
MLLRSKPALPPPLMLLLLGPLGPLSPGALPRPAQAQDVVDLDFFTQEPLHLVSPSFLSVTIDANLATDPRFLILLGSPKLRTLARGLSPAYLRFGGTKTDFLIFDPKKESTFEERSYWQSQVNQDICKYGSIPPDVEEKLRLEWPYQEQLLLREHYQKKFKNSTYSRSSVDVLYTFANCSGLDLIFGLNALLRTADLQWNSSNAQLLLDYCSSKGYNISWELGNEPNSFLKKADIFINGSQLGEDFIQLHKLLRKSTFKNAKLYGPDVGQPRRKTAKMLKSFLKAGGEVIDSVTWHHYYLNGRTATKEDFLNPDVLDIFISSVQKVFQDYWLSLLFKKLVGTKVLMASVQGSKRRKLRVYLHCTNTDNPRYKEGDLTLYAINLHNVTKYLRLPYPFSNKQVDKYLLRPLGPHGLLSKSVQLNGLTLKMVDDQTLPPLMEKPLRPGSSLGLPAFSYSFFVIRNAKVAACI

SEQ ID NO: 6554 - protein, 168 aa, Homo Sapiens
MLLRSKPALPPPLMLLLLGPLGPLSPGALPRPAQAQDVVDLDFFTQEPLHLVSPSFLSVTIDANLATDPRFLILLGSPKLRTLARGLSPAYLRFGGTKTDFLIFDPKKESTFEERSYWQSQVNQDICKYGSIPPDVEEKLRLEWPYQEQLLLREHYQKKFKNSTYSTS

SEQ ID NO: 6555 - protein, 389 aa, Homo Sapiens
ARSLDKLYNFADCSGLHLIFALNALRRNPNNSWNSSSALSLLKYSASKKYNISWELGNEPNNYRTMHGRAVNGSQLGKDYIQLKSLLQPIRIYSRASLYGPNIGRPRKNVIALLDGFMKVAGSTVDAVTWQHCYIDGRVVKVMDFLKTRLLDTLSDQIRKIQKVVNTYTPGKKIWLEGVVTTSAGGTNNLSDSYAAGFLWLNTLGMLANQGIDVVIRHSFFDHGYNHLVDQNFNPLPDYWLSLLYKRLIGPKVLAVHVAGLQRKPRPGRVIRDKLRIYAHCTNHHNHNYVRGSITLFIINLHRSRKKIKLAGTLRDKLVHQYLLQPYGQEGLKSKSVQLNGQPLVMVDDGTLPELKPRPLRAGRTLVIPPVTMGFYVVKNVNALACRYR

SEQ ID NO: 6556 - protein, 149 aa, Homo Sapiens
MRVLCAFPEAMPSSNSRPPACLAPGALYLALLLHLSLSSQAGDRRPLPVDRAAGLKEKTLILLDVSTKNPVRTVNENFLSLQLDPSIIHDGWLDFLSSKRLVTLARGLSPAFLRFGGKRTDFLQFQNLRNPAKSRGGPGPDYYLKNYED

SEQ ID NO: 6557 - protein, 592 aa, Homo Sapiens
MRVLCAFPEAMPSSNSRPPACLAPGALYLALLLHLSLSSQAGDRRPLPVDRAAGLKEKTLILLDVSTKNPVRTVNENFLSLQLDPSIIHDGWLDFLSSKRLVTLARGLSPAFLRFGGKRTDFLQFQNLRNPAKSRGGPGPDYYLKNYEDDIVRSDVALDKQKGCKIAQHPDVMLELQREKAAQMHLVLLKEQFSNTYSNLILTARSLDKLYNFADCSGLHLIFALNALRRNPNNSWNSSSALSLLKYSASKKYNISWELGNEPNNYRTMHGRAVNGSQLGKDYIQLKSLLQPIRIYSRASLYGPNIGRPRKNVIALLDGFMKVAGSTVDAVTWQHCYIDGRVVKVMDFLKTRLLDTLSDQIRKIQKVVNTYTPGKKIWLEGVVTTSAGGTNNLSDSYAAGFLWLNTLGMLANQGIDVVIRHSFFDHGYNHLVDQNFNPLPDYWLSLLYKRLIGPKVLAVHVAGLQRKPRPGRVIRDKLRIYAHCTNHHNHNYVRGSITLFIINLHRSRKKIKLAGTLRDKLVHQYLLQPYGQEGLKSKSVQLNGQPLVMVDDGTLPELKPRPLRAGRTLVIPPVTMGFYVVKNVNALACRYR

SEQ ID NO: 6558 - protein, 548 aa, Homo Sapiens
MRVLCAFPEAMPSSNSRPPACLAPGALYLALLLHLSLSSQAGDRRPLPVDRAAGLKEKTLILLDVSTKNPVRTVNENFLSLQLDPSIIHDGWLDFLSSKRLVTLARGLSPAFLRFGGKRTDFLQFQNLRNPAKSRGGPGPDYYLKNYEDDIVRSDVALDKQKGCKIAQHPDVMLELQREKAAQMHLVLLKEQFSNTYSNLILTARSLDKLYNFADCSGLHLIFALNALRRNPNNSWNSSSALSLLKYSASKKYNISWELGNEPNNYRTMHGRAVNGSQLGKDYIQLKSLLQPIRIYSRASLYGPNIGRPRKNVIALLDGFMKVAGSTVDAVTWQHCYIDGRVVKVMDFLKTRLLDTLSDQIRKIQKVVNTYTPGKKIWLEGVVTTSAGGTNNLSDSYAAGFLWLNTLGMLANQGIDVVIRHSFFDHGYNHLVDQNFNPLPDYWLSLLYKRLIGPKVLAVHVAGLQRKPRPGRVIRDKLRIYAHCTNHHNHNYVRGSITLFIINLHRSRKKIKLAGTLRDKLVHQYLLQPYGQEGLKSKTQRCQYCGII

SEQ ID NO: 6559 - protein, 534 aa, Homo Sapiens
MRVLCAFPEAMPSSNSRPPACLAPGALYLALLLHLSLSSQAGDRRPLPVDRAAGLKEKTLILLDVSTKNPVRTVNENFLSLQLDPSIIHDGWLDFLSSKRLVTLARGLSPAFLRFGGKRTDFLQFQNLRNPAKSRGGPGPDYYLKNYEDDIVRSDVALDKQKGCKIAQHPDVMLELQREKAAQMHLVLLKEQFSNTYSNLILTEPNNYRTMHGRAVNGSQLGKDYIQLKSLLQPIRIYSRASLYGPNIGRPRKNVIALLDGFMKVAGSTVDAVTWQHCYIDGRVVKVMDFLKTRLLDTLSDQIRKIQKVVNTYTPGKKIWLEGVVTTSAGGTNNLSDSYAAGFLWLNTLGMLANQGIDVVIRHSFFDHGYNHLVDQNFNPLPDYWLSLLYKRLIGPKVLAVHVAGLQRKPRPGRVIRDKLRIYAHCTNHHNHNYVRGSITLFIINLHRSRKKIKLAGTLRDKLVHQYLLQPYGQEGLKSKSVQLNGQPLVMVDDGTLPELKPRPLRAGRTLVIPPVTMGFYVVKNVNALACRYR

SEQ ID NO: 6560 - protein, 480 aa, Homo Sapiens
MRVLCAFPEAMPSSNSRPPACLAPGALYLALLLHLSLSSQAGDRRPLPVDRAAGLKEKTLILLDVSTKNPVRTVNENFLSLQLDPSIIHDGWLDFLSSKRLVTLARGLSPAFLRFGGKRTDFLQFQNLRNPAKSRGGPGPDYYLKNYEDEPNNYRTMHGRAVNGSQLGKDYIQLKSLLQPIRIYSRASLYGPNIGRPRKNVIALLDGFMKVAGSTVDAVTWQHCYIDGRVVKVMDFLKTRLLDTLSDQIRKIQKVVNTYTPGKKIWLEGVVTTSAGGTNNLSDSYAAGFLWLNTLGMLANQGIDVVIRHSFFDHGYNHLVDQNFNPLPDYWLSLLYKRLIGPKVLAVHVAGLQRKPRPGRVIRDKLRIYAHCTNHHNHNYVRGSITLFIINLHRSRKKIKLAGTLRDKLVHQYLLQPYGQEGLKSKSVQLNGQPLVMVDDGTLPELKPRPLRAGRTLVIPPVTMGFYVVKNVNALACRYR

SEQ ID NO: 6561 - protein, 254 aa, Homo Sapiens [sequence omitted]

SEQ ID NO: 6562 - protein, 462 aa, Homo Sapiens
MARVLGAPVALGLWSLCWSLAIATPLPPTSAHGNVAEGETKPDPDVTERCSDGWSFDATTLDDNGTMLFFKGEFVWKSHKWDRELISERWKNFPSPVDAAFRQGHNSVFLIKGDKVWVYPPEKKEKGYPKLLQDEFPGIPSPLDAAVECHRGECQAEGVLFFQGDREWFWDLATGTMKERSWPAVGNCSSALRWLGRYYCFQGNQFLRFDPVRGEVPPRYPRDVRDYFMPCPGRGHGHRNGTGHGNSTHHGPEYMRCSPHLVLSALTSDNHGATYAFSGTHYWRLDTSRDGWHSWPIAHQWPQGPSAVDAAFSWEEKLYLVQGTQVYVFLTKGGYTLVSGYPKRLEKEVGTPHGIILDSVDAAFICPGSSRLHIMAGRRLWWLDLKSGAQATWTELPWPHEKVDGALCMEKSLGPNSCSANGPGLYLIHGPNLYCYSDVEKLNAAKALPQPQNVTSLLGCTH

SEQ ID NO: 6563 - protein, 699 aa, Homo Sapiens
MGHHRPWLHASVLWAGVASLLLPPAMTQQLRGDGLGFRNRNNSTGVAGLSEEASAELRHHLHSPRDHPDENKDVSTENGHHFWSHPDREKEDEDVSKEYGHLLPGHRSQDHKVGDEGVSGEEVFAEHGGQARGHRGHGSEDTEDSAEHRHHLPSHRSHSHQDEDEDEVVSSEHHHHILRHGHRGHDGEDDEGEEEEEEEEEEEEASTEYGHQAHRHRGHGSEEDEDVSDGHHHHGPSHRHQGHEEDDDDDDDDDDDDDDDDVSIEYRHQAHRHQGHGIEEDEDVSDGHHHRDPSHRHRSHEEDDNDDDDVSTEYGHQAHRHQDHRKEEVEAVSGEHHHHVPDHRHQGHRDEEEDEDVSTERWHQGPQHVHHGLVDEEEEEEEITVQFGHYVASHQPRGHKSDEEDFQDEYKTEVPHHHHHRVPREEDEEVSAELGHQAPSHRQSHQDEETGHGQRGSIKEMSHHPPGHTVVKDRSHLRKDDSEEEKEKEEDPGSHEEDDESSEQGEKGTHHGSRDQEDEEDEEEGHGLSLNQEEEEEEDKEEEEEEEDEERREERAEVGAPLSPDHSEEEEEEEEGLEEDEPRFTIIPNPLDRREEAGGASSEEESGEDTGPQDAQEYGNYQPGSLCGYCSFCNRCTECESCHCDEENMGEHCDQCQHCQFCYLCPLVCETVCAPGSYVDYFSSSLYQALADMLETPEP

SEQ ID NO: 6564 - protein, 676 aa, Homo Sapiens
MGHHRPWLHASVLWAGVASLLLPPAMTQQLRGDGLGFRNRNNSTGVAGLSEEASAELRHHLHSPRDHPDENKDVSTENGHHFWSHPDREKEDEDVSKEYGHLLPGHRSQDHKVGDEGVSGEEVFAEHGGQARGHRGHGSEDTEDSAEHRHHLPSHRSHSHQDEDEDEVVSSEHHHHILRHGHRGHDGEDDEGEEEEEEEEEEEEASTEYGHQAHRHRGHGSEEDEDVSDGHHHHGPSHRHQGHEEDDDDDDDDDDDDDDDDVSIEYRHQAHRHQGHGIEEDEDVSDGHHHRDPSHRHRSHEEDDNDDDDVSTEYGHQAHRHQDHRKEEVEAVSGEHHHHVPDHRHQGHRDEEEDEDVSTERWHQGPQHVHHGLVDEEEEEEEITVQFGHYVASHQPRGHKSDEEDFQDEYKTEVPHHHHHRVPREEDEEVSAELGHQAPSHRQSHQDEETGHGQRGSIKEMSHHPPGHTVVKDRSHLRKDDSEEEKEKEEDPGSHEEDDESSEQGEKGTHHGSRDQEDEEDEEEGHGLSLNQEEEEEEDKEEEEEEEDEERREERAEVGAPLSPDHSEEEEEEEEGLEEDEPRFTIIPNPLDRREEAGGASSEEESGEDTGPQDAQEYGNYQPGSLCGYCSFCNHCQFCYLCPLVCETVCAPGSYVDYFSSSLYQALADMLETPEP

SEQ ID NO: 6565 - protein, 96 aa, Homo Sapiens
  misc_feature (1)..(1): Xaa can be any naturally occurring amino acid
XSEEESGEDTGPQDAQEYGNYQPGSLCGYCSFCNRCTECESCHCDEENMGEHCDQCQGPGRHAGNAGTLTQSLDCDAGVPPPAFQPLSTSYIYFSE

SEQ ID NO: 6566 - protein, 525 aa, Homo Sapiens
MKALIAALLLITLQYSCAVSPTDCSAVEPEAEKALDLINKRRRDGYLFQLLRIADAHLDRVENTTVYYLVLDVQESDCSVLSRKYWNDCEPPDSRRPSEIVIGQCKVIATRHSHESQDLRVIDFNCTTSSVSSALANTKDSPVLIDFFEDTERYRKQANKALEKYKEENDDFASFRVDRIERVARVRGGEGTGYFVDFSVRNCPRHHFPRHPNVFGFCRADLFYDVEALDLESPKNLVINCEVFDPQEHENINGVPPHLGHPFHWGGHERSSTTKPPFKPHGSRDHHHPHKPHEHGPPPPPDERDHSHGPPLPQGPPPLLPMSCSSCQHATFGTNGAQRHSHNNNSSDLHPHKHHSHEQHPHGHHPHAHHPHEHDTHRQHPHGHHPHGHHPHGHHPHGHHPHGHHPHCHDFQDYGPCDPPPHNQGHCCHGHGPPPGHLRRRGPGKGPRPFHCRQIGSVYRLPPLRKGEVLPLPEANFPSFPLPHHKHPLKPDNQPFPQSVSESCPGKFKSGFPQVSMFFTHTFPK

SEQ ID NO: 6567 - protein, 111 aa, Homo Sapiens
MDGPRQDATLDEEEDMVIIYNRVPKTASTSFTNIAYDLCAKNKYHVLHINTTKNNPVMSLQDQVRFVKNITSWKEMKPGFYHGHVSYLDFAKFGVKKKPIYINVIRDPIER

SEQ ID NO: 6568 - protein, 229 aa, Homo Sapiens
MGLLRIMMPPKLQLLAVVAFAVAMLFLENQIQKLEESRSKLERAIARHEVREIEQRHTMDGPRQDATLDEEEDMVIIYNRVPKTASTSFTNIAYDLCAKNKYHVLHINTTKNNPVMSLQDQVRFVKNITSWKEMKPGFYHGHVSYLDFAKFGVKKKPIYINVIRDPIERLVSYYYFLRFGDDYRPGLRRRKQGDKKTFDECVAEGGSDCAPEKLWLQIPFFCGHSSECW

SEQ ID NO: 6569 - protein, 356 aa, Homo Sapiens
MGLLRIMMPPKLQLLAVVAFAVAMLFLENQIQKLEESRSKLERAIARHEVREIEQRHTMDGPRQDATLDEEEDMVIIYNRVPKTASTSFTNIAYDLCAKNKYHVLHINTTKNNPVMSLQDQVRFVKNITSWKEMKPGFYHGHVSYLDFAKFGVKKKPIYINVIRDPIERLVSYYYFLRFGDDYRPGLRRRKQGDKKTFDECVAEGGSDCAPEKLWLQIPFFCGHSSECWNVGSRWAMDQAKYNLINEYFLVGVTEELEDFIMLLEAALPRFFRGATELYRTGKKSHLRKTTEKKLPTKQTIAKLQQSDIWKMENEFYEFALEQFQFIRAHAVREKDGDLYILAQNFFYEKIYPKSN

SEQ ID NO: 6570 - protein, 83 aa, Homo Sapiens
MAALLLGAVLLVAQPQLVPSRPAELGQQELLRKAGTLQDDVRDGVAPNGSAQQLPQTIIIGVRKGGTRALLEMLSLHPDVAAA

SEQ ID NO: 6571 - protein, 83 aa, Homo Sapiens; identical to SEQ ID NO: 6570

SEQ ID NO: 6572 - protein, 307 aa, Homo Sapiens
MAALLLGAVLLVAQPQLVPSRPAELGQQELLRKAGTLQDDVRDGVAPNGSAQQLPQTIIIGVRKGGTRALLEMLSLHPDVAAAENEVHFFDWEEHYSHGLGWYLSQMPFSWPHQLTVEKTPAYFTSPKVPERVYSMNPSIRLLLILRDPSERVLSDYTQVFYNHMQKHKPYPSIEEFLVRDGRLNVDYKALNRSLYHVHMQNWLRFFPLRHIHIVDGDRLIRDPFPEIQKVERFLKLSPQINASNFYFNKTKGFYCLRDSGRDRCLHESKGRAHPQVDPKLLNKLHEYFHEPNKKFFELVGRTFDWH

SEQ ID NO: 6573 - protein, 411 aa, Homo Sapiens
MRRRRAGGRTMVERASKFVLVVAGSVCFMLILYQYAGPGLSLGAPGGRAPPDDLDLFPTPDPHYEKKYYFPVRELERSLRFDMKGDDVIVFLHIQKTGGTTFGRHLVQNVRLEVPCDCRPGQKKCTCYRPNRRETWLFSRFSTGWSCGLHADWTELTNCVPGVLDRRDSAALRTPRKFYYITLLRDPVSRYLSEWRHVQRGATWKTSLHMCDGRTPTPEELPPCYEGTDWSGCTLQEFMDCPYNLANNRQVRMLADLSLVGCYNLSFIPEGKRAQLLLESAKKNLRGMAFFGLTEFQRKTQYLFERTFNLKFIRPFMQYNSTRAGGVEVDEDTIRRIEELNDLDMQLYDYAKDLFQQRYQYKRQLERREQRLRSREERLLHRAKEALPREDADEPGRVPTEDYMSHIIEKW

SEQ ID NO: 6574 - protein, 471 aa, Homo Sapiens
MDERFNKWLLTPVLTLLFVVIMYQYVSPSCTSSCTNFGEQPRAGEAGPPAVPGPARRAQAPPEEWERRPQLPPPPRGPPEGPRGAAAPEEEDEEPGDPREGEEEEEEDEPDPEAPENGSLPRFVPRFNFSLKDLTRFVDFNIKGRDVIVFLHIQKTGGTTFGRHLVKNIRLEQPCSCKAGQKKCTCHRPGKKETWLFSRFSTGWSCGLHADWTELTNCVPAIMEKKDCPRNHSHTRNFYYITMLRDPVSRYLSEWKHVQRGATWKTSLHMCDGRSPTPDELPTCYPGDDWSGVSLREFMDCTYNLANNRQVRMLADLSLVGCYNLTFMNESERNTILLQSAKNNLKNMAFFGLTEFQRKTQFLFERTFNLKFISPFTQFNITRASNVEINEGARQRIEDLNFLDMQLYEYAKDLFQQRYHHTKQLEHQRDRQKRREERRLQREHRDHQWPKEDGAAEGTVTEDYNSQVVRW

SEQ ID NO: 6575 - protein, 236 aa, Homo Sapiens
RNFYYITMLRDPVSRYLSEWKHVQRGATWKTSLHMCDGRSPTPDELPTCYPGDDWSGVSLREFMDCTYNLANNRQVRMLADLSLVGCYNLTFMNESERNTILLQSAKNNLKNMAFFGLTEFQRKTQFLFERTFNLKFISPFTQFNITRASNVEINEGARQRIEDLNFLDMQLYEYAKDLFQQRYHHTKQLEHQRDRQKRREERRLQREHRDHQWPKEDGAAEGTVTEDYNSQVVRW

SEQ ID NO: 6576 - protein, 333 aa, Homo Sapiens
MANLGTLQLLPPRFKRFSCLSLPNIWITGMPVPATSVPCPSAGPHRTMKVLLLTGLGALFFAYYWDDNFDPASLQGARVLLTGANAGVGEELAYHYARLGSHLVLTAHTEALLQKVVGNCRKLGAPKVFYIAADMASPEAPESVVQFALDKLGGLDYLVLNHIGGAPAGTRARSPQATRWLMQVNFVSYVQLTSRALPSLTDSKGSLVVVSSLLGRVPTSFSTPYSAAKFALDGFFGSLRRELDVQDVNVAITMCVLGLRDRASAAEAVRGVTRVKAAPGPKAALAVIRGGATRAAGVFYPWRFRLLCLLRRWLPRPRAWFIRQELNVTAAAA

SEQ ID NO: 6577 - protein, 199 aa, Homo Sapiens
MASPEAPESVVQFALDKLGGLDYLVLNHIGGAPAGTRARSPQATRWLMQVNFVSYVQLTSRALPSLTDSKGSLVVVSSLLGRVPTSFSTPYSAAKFALDGFFGSLRRELDVQDVNVAITMCVLGLRDRASAAEAVRGVTRVKAAPGPKAALAVIRGGATRAAGVFYPWRFRLLCLLRRWLPRPRAWFIRQELNVTAAAA

SEQ ID NO: 6578 - protein, 75 aa, Homo Sapiens
MKVLLLTGLGALFFAYYWDDNFDPASLQGARVLLTGANAGVGEELAYHYARLGSHLVLTAHTEALLQKAGWTTSC

SEQ ID NO: 6579 - protein, 75 aa, Homo Sapiens; identical to SEQ ID NO: 6578

SEQ ID NO: 6580 - protein, 87 aa, Homo Sapiens
MKVLLLTGLGALFFAYYWDDNFDPASLQGARVLLTGANAGVGEELAYHYARLGSHLVLTAHTEALLQKARWLTLVVSTLGGRGKWIT

SEQ ID NO: 6581 - protein, 143 aa, Homo Sapiens
MKVLLLTGLGALFFAYYWDDNFDPASLQGARVLLTGANAGVGEELAYHYARLGSHLVLTAHTEALLQKVVGNCRKLGAPKVFYIAADMASPEAPESVVQFALDKLGGLDYLVLNHIGGAPAGTRARSPQATRWLMQVNFVSYV

SEQ ID NO: 6582 - protein, 286 aa, Homo Sapiens
MKVLLLTGLGALFFAYYWDDNFDPASLQGARVLLTGANAGVGEELAYHYARLGSHLVLTAHTEALLQKVVGNCRKLGAPKVFYIAADMASPEAPESVVQFALDKLGGLDYLVLNHIGGAPAGTRARSPQATRWLMQVNFVSYVQLTSRALPSLTDSKGSLVVVSSLLGRVPTSFSTPYSAAKFALDGFFGSLRRELDVQDVNVAITMCVLGLRDRASAAEAVRGVTRVKAAPGPKAALAVIRGGATRAAGVFYPWRFRLLCLLRRWLPRPRAWFIRQELNVTAAAA

SEQ ID NO: 6583 - protein, 286 aa, Homo Sapiens; identical to SEQ ID NO: 6582

SEQ ID NO: 6584 - protein, 286 aa, Homo Sapiens; identical to SEQ ID NO: 6582

SEQ ID NO: 6585 - protein, 315 aa, Homo Sapiens
MKVLLLTGLGALFFAYYWDDNFDPASLQGARVLLTGANAGVGEELAYHYARLGSHLVLTAHTEALLQKVVGNCRKLGAPKVFYIAADMASPEAPESVVQFALDKLGGLDYLVLNHIGGAPAGTRARSPQATRWLMQVNFVSYVQLTSRALPSLTDSKGSLVVVSSLLGRVPTSFSTPYSAAKFALDGFFGSLRRELDVQDVNVAITMCVLGLRDRASAAEAVRSSTSRPRQPEHRGVPLQSQTAMFLPPTVPGARTLTETPLRGWPQPKMKSSRQKSKTEKNDGHLEPVTAWEVQVPRVRRLCRGLARPHLFGHD

SEQ ID NO: 6586 - protein, 32 aa, Homo Sapiens
MKVLLLTGLGALFFAYYWDDNFDPASRERECC

SEQ ID NO: 6587 - protein, 205 aa, Homo Sapiens
MKVLLLTGLGALFFAYYWDDNFDPGGLDYLVLNHIGGAPAGTRARSPQATRWLMQVNFVSYVQLTSRALPSLTDSKGSLVVVSSLLGRVPTSFSTPYSAAKFALDGFFGSLRRELDVQDVNVAITMCVLGLRDRASAAEAVRGVTRVKAAPGPKAALAVIRGGATRAAGVFYPWRFRLLCLLRRWLPRPRAWFIRQELNVTAAAA

SEQ ID NO: 6588 - protein, 234 aa, Homo Sapiens
MKVLLLTGLGALFFAYYWDDNFDPGGLDYLVLNHIGGAPAGTRARSPQATRWLMQVNFVSYVQLTSRALPSLTDSKGSLVVVSSLLGRVPTSFSTPYSAAKFALDGFFGSLRRELDVQDVNVAITMCVLGLRDRASAAEAVRSSTSRPRQPEHRGVPLQSQTAMFLPPTVPGARTLTETPLRGWPQPKMKSSRQKSKTEKNDGHLEPVTAWEVQVPRVRRLCRGLARPHLFGHD

SEQ ID NO: 6589 - protein, 47 aa, Homo Sapiens
MKVLLLTGLGALFFAYYWDDNFDPGGRELPEAGRPQGLLHRGGHGLP

SEQ ID NO: 6590 - protein, 189 aa, Homo Sapiens
MKVLLLTGLGALFFAYYWDDNFDPGKLCELRATDVAGAAQPDGQQGLPGGGVLAARPRAHVVLHSLLGGQVCAGRLLRLPAAGAGRAGRERGHHHVRPGPPRSRLRRRGSQGSHEGQGGPGAQGSPGRDPRRRHARGRRLLPVAFPPAVLAPALATAPAGLVYPPGAQRHGRGSLSTGGCPSSPRRQCS

SEQ ID NO: 6591 - protein, 152 aa, Homo Sapiens
MQVNFVSYVQLTSRALPSLTDSKGSLVVVSSLLGRVPTSFSTPYSAAKFALDGFFGSLRRELDVQDVNVAITMCVLGLRDRASAAEAVRGVTRVKAAPGPKAALAVIRGGATRAAGVFYPWRFRLLCLLRRWLPRPRAWFIRQELNVTAAAA

SEQ ID NO: 6592 - protein, 152 aa, Homo Sapiens; identical to SEQ ID NO: 6591

SEQ ID NO: 6593 - protein, 181 aa, Homo Sapiens
MQVNFVSYVQLTSRALPSLTDSKGSLVVVSSLLGRVPTSFSTPYSAAKFALDGFFGSLRRELDVQDVNVAITMCVLGLRDRASAAEAVRSSTSRPRQPEHRGVPLQSQTAMFLPPTVPGARTLTETPLRGWPQPKMKSSRQKSKTEKNDGHLEPVTAWEVQVPRVRRLCRGLARPHLFGHD

SEQ ID NO: 6594 - protein, 135 aa, Homo Sapiens
  misc_feature (1)..(1): Xaa can be any naturally occurring amino acid
XLGALFFAYYWDDNFDPGGLDYLVLNHIGGAPAGTRARSPQATRWLMQVNFVSYVQLTSRALPSLTDSKGSLVVVSSLLGRVPTSFSTPYSAAKFALDGFFGSLRRELDVQDVNVAITMCVLGLRDRASAAEAVR

SEQ ID NO: 6595 - protein, 256 aa, Homo Sapiens
MKFLLDILLLLPLLIVCSLESFVKLFIPKRRKSVTGEIVLITGAGHGIGRLTAYEFAKLKSKLVLWDINKHGLEETAAKCKGLGAKVHTFVVDCSNREDIYSSAKKTTKAFLPAMTKNNHGHIVTVASAAGHVSVPFLLAYCSSKFAAVGFHKTLTDELAALQITGVKTTCLCPNFVNTGFIKNPSTSLGPTLEPEEVVNRLMHGILTEQKMIFIPSSIAFLTTLERILPERFLAVLKRKISVKFDAVIGYKMKAQ

SEQ ID NO: 6596 - protein, 300 aa, Homo Sapiens
MKFLLDILLLLPLLIVCSLESFVKLFIPKRRKSVTGEIVLITGAGHGIGRLTAYEFAKLKSKLVLWDINKHGLEETAAKCKGLGAKVHTFVVDCSNREDIYSSAKKVKAEIGDVSILVNNAGVVYTSDLFATQDPQIEKTFEVNVLAHFWTTKAFLPAMTKNNHGHIVTVASAAGHVSVPFLLAYCSSKFAAVGFHKTLTDELAALQITGVKTTCLCPNFVNTGFIKNPSTSLGPTLEPEEVVNRLMHGILTEQKMIFIPSSIAFLTTLERILPERFLAVLKRKISVKFDAVIGYKMKAQ

SEQ ID NO: 6597 - protein, 341 aa, Homo Sapiens
MRKVVLITGASSGIGLALCKRLLAEDDELHLCLACRNMSKAEAVCAALLASHPTAEVTIVQVDVSNLQSVFRASKELKQRFQRLDCIYLNAGIMPNPQLNIKALFFGLFSRKVIHMFSTAEGLLTQGDKITADGLQEVFETNVFGHFILIRELEPLLCHSDNPSQLIWTSSRSARKSNFSLEDFQHSKGKEPYSSSKYATDLLSVALNRNFNQQGLYSNVACPGTALTNLTYGILPPFIWTLLMPAILLLRFFANAFTLTPYNGTEALVWLFHQKPESLNPLIKYLSATTGFGRNYIMTQKMDLDEDTAEKFYQKLLELEKHIRVTIQKTDNQARLSGSCL

SEQ ID NO: 6598 - protein, 111 aa, Homo Sapiens
MRKVVLITGASSGIGLALCKRLLAEDDELHLCLACRNMSKAEAVCAALLASHPTAEVTIVQVDVSNLQSVFRASKELKQRFQRLDCIYLNAGIMPNPQLNIKALFFGLFSS

SEQ ID NO: 6599 - protein, 109 aa, Homo Sapiens
MRKVVLITGASSGIGLALCKRLLAEDDELHLCLACRNMSKAEAVCAALLASHPTAEVTIVQVDVSNLQSVFRASKELKQRMIKKWLYVICVEDHVSEIRLYISKCWDHA

SEQ ID NO: 6600 - protein, 84 aa, Homo Sapiens
MRKVVLITGASSGIGLALCKRLLAEDDELHLCLACRNMSKAEAVCAALLASHPTAEVTIVQVDVSNLQSVFRASKELKQRYISC

SEQ ID NO: 6601 - protein, 62 aa, Homo Sapiens
  misc_feature (1)..(1): Xaa can be any naturally occurring amino acid
XSLEDFQHSKGKEPYSSSKYATDLLSVALNRNFNQQVLYSSVYVIKYLPHYMEVGLSITIFR

SEQ ID NO: 6602 - protein, 49 aa, Homo Sapiens
MMKLIINSLYKNKEIFLRELISNASDALDKIRLISLTDENALSGNEELT

SEQ ID NO: 6603 - protein, 803 aa, Homo Sapiens
MRALWVLGLCCVLLTFGSVRADDEVDVDGTVEEDLGKSREGSRTDDEVVQREEEAIQLDGLNASQIRELREKSEKFAFQAEVNRMMKLIINSLYKNKEIFLRELISNASDALDKIRLISLTDENALSGNEELTVKIKCDKEKNLLHVTDTGVGMTREELVKNLGTIAKSGTSEFLNKMTEAQEDGQSTSELIGQFGVGFYSAFLVADKVIVTSKHNNDTQHIWESDSNEFSVIADPRGNTLGRGTTITLVLKEEASDYLELDTIKNLVKKYSQFINFPIYVWSSKTETVEEPMEEEEAAKEEKEESDDEAAVEEEEEEKKPKTKKVEKTVWDWELMNDIKPIWQRPSKEVEEDEYKAFYKSFSKESDDPMAYIHFTAEGEVTFKSILFVPTSAPRGLFDEYGSKKSDYIKLYVRRVFITDDFHDMMPKYLNFVKGVVDSDDLPLNVSRETLQQHKLLKVIRKKLVRKTLDMIKKIADDKYNDTFWKEFGTNIKLGVIEDHSNRTRLAKLLRFQSSHHPTDITSLDQYVERMKEKQDKIYFMAGSSRKEAESSPFVERLLKKGYEVIYLTEPVDEYCIQALPEFDGKRFQNVAKEGVKFDESEKTKESREAVEKEFEPLLNWMKDKALKDKIEKAVVSQRLTESPCALVASQYGWSGNMERIMKAQAYQTGKDISTNYYASQKKTFEINPRHPLIRDMLRRIKEDEDDKTVLDLAVVLFETATLRSGYLLPDTKAYGDRIERMLRLSLNIDPDAKVEEEPEEEPEETAEDTTEDTEQDEDEEMDVGTDEEEETAKESTAEKDEL

SEQ ID NO: 6604 - protein, 315 aa, Homo Sapiens [sequence omitted]

SEQ ID NO: 6605 - protein, 315 aa, Homo Sapiens [sequence omitted]

SEQ ID NO: 6606 - protein, 53 aa, Homo Sapiens
MRALWVLGLCCVLLTFGSVRADDEVDVDGTVEEDLGKSREGSRTDDEVVQRSR

SEQ ID NO: 6607 - protein, 147 aa, Homo Sapiens
  misc_feature (1)..(1): Xaa can be any naturally occurring amino acid
XQYGWSGNMERIMKAQAYQTGKDISTNYYASQKKTFEINPRHPLIRDMLRRIKEDEDDKTVLDLAVVLFETATLRSGYLLPDTKAYGDRIERMLRLSLNIDPDAKVEEEPEEEPEETAEDTTEDTEQDEDEEMDVGTDEEEETAKMS

SEQ ID NO: 6608 - protein, 471 aa, Homo Sapiens
MAREMTILGSAVLTLLLAGYLAQQYLPLPTPKVIGIDLGTTYCSVGVFFPGTGKVKVIPDENGHISIPSMVSFTDNDVYVGYESVELADSNPQNTIYDAKRFIGKIFTAEELEAEIGRYPFKVLNKNGMVEFSVTSNETITVSPEYVGSRLLLKLKEMAEAYLGMPVANAVISVPAEFDLKQRNSTIEAANLAGLKILRVINEPTAAAMAYGLHKADVFHVLVIDLGGGTLDVSLLNKQGGMFLTRAMSGNNKLGGQDFNQRLLQYLYKQIYQTYGFVPSRKEEIHRLRQAVEMVKLNLTLHQSAQLSVLLTVEEQDRKEPHSSDTELPKDKLSSADDHRVNSGFGRGLSDKKSGESQVLFETEISRKLFDTLNEDLFQKILVPIQQVLKEGHLEKTEIDEVVLVGGSTRIPRIRQVIQEFFGKDPNTSVDPDLAVVTGVAIQAGIDGGSWPLQVSALEIPNKHLQKTNFN

SEQ ID NO: 6609 - protein, 654 aa, Homo Sapiens
MKLSLVAAMLLLLSAARAEEEDKKEDVGTVVGIDLGTTYSCVGVFKNGRVEIIANDQGNRITPSYVAFTPEGERLIGDAAKNQLTSNPENTVFDAKRLIGRTWNDPSVQQDIKFLPFKVVEKKTKPYIQVDIGGGQTKTFAPEEISAMVLTKMKETAEAYLGKKVTHAVVTVPAYFNDAQRQATKDAGTIAGLNVMRIINEPTAAAIAYGLDKREGEKNILVFDLGGGTFDVSLLTIDNGVFEVVATNGDTHLGGEDFDQRVMEHFIKLYKKKTGKDVRKDNRAVQKLRREVEKAKRALSSQHQARIEIESFYEGEDFSETLTRAKFEELNMDLFRSTMKPVQKVLEDSDLKKSDIDEIVLVGGSTRIPKIQQLVKEFFNGKEPSRGINPDEAVAYGAAVQAGVLSGDQDTGDLVLLDVCPLTLGIETVGGVMTKLIPRNTVVPTKKSQIFSTASDNQPTVTIKVYEGERPLTKDNHLLGTFDLTGIPPAPRGVPQIEVTFEIDVNGILRVTAEDKGTGNKNKITITNDQNRLTPEEIERMVNDAEKFAEEDKKLKERIDTRNELESYAYSLKNQIGDKEKLGGKLSSEDKETMEKAVEEKIEWLESHQDADIEDFKAKKKELEEIVQPIISKLYGSAGPPPTGEEDTAEKDEL

SEQ ID NO: 6610 - protein, 236 aa, Homo Sapiens
ISTHFAPGDFQGFALVNPQRNSRLTGEFTVEPVPEGAQLSFGNFAQLGHESFYWQLPETYQGDKGEAYFARMRRAHQNRTSLSEEQLRAAVTAGRIPEPPEGRDWAQRASQVDEAQRRMDAEIWQLLSSFAAQPQPPPQGLSPHPQPAAALRAAPPPSSSSSSSSSSASLSFSPGSQFSLSYEGFSLLPGSLYYWQLPRAFLGDKVAAYGGKLRYTLSYTAGPQGSPLSDPDVQIT

SEQ ID NO: 6611 - protein, 4391 aa, Homo Sapiens
MGWRAAGALLLALLLHGRLLAVTHGLRAYDGLSLPEDIETVTASQMRWTHSYLSDDEDMLADSISGDDLGSGDLGSGDFQMVYFRALVNFTRSIEYSPQLEDAGSREFREVSEAVVDTLESEYLKIPGDQVVSVVFIKELDGWVFVELDVGSEGNADGAQIQEMLLRVISSGSVASYVTSPQGFQFRRLGTVPQFPRACTEAEFACHSYNECVALEYRCDRRPDCRDMSDELNCEEPVLGISPTFSLLVETTSLPPRPETTIMRQPPVTHAPQPLLPGSVRPLPCGPQEAACRNGHCIPRDYLCDGQEDCEDGSDELDCGPPPPCEPNEFPCGNGHCALKLWRCDGDFDCEDRTDEANCPTKRPEEVCGPTQFRCVSTNMCIPASFHCDEESDCPDRSDEFGCMPPQVVTPPRESIQASRGQTVTFTCVAIGVPTPIINWRLNWGHIPSHPRVTVTSEGGRGTLIIRDVKESDQGAYTCEAMNARGMVFGIPDGVLELVPQRGPCPDGHFYLEHSAACLPCFCFGITSVCQSTRRFRDQIRLRFDQPDDFKGVNVTMPAQPGTPPLSSTQLQIDPSLHEFQLVDLSRRFLVHDSFWALPEQFLGNKVDSYGGSLRYNVRYELARGMLEPVQRPDVVLMGAGYRLLSRGHTPTQPGALNQRQVQFSEEHWVHESGRPVQRAELLQVLQSLEAVLIQTVYNTKMASVGLSDIAMDTTVTHATSHGRAHSVEECRCPIGYSGLSCESCDAHFTRVPGGPYLGTCSGCNCNGHASSCDPVYGHCLNCQHNTEGPQCNKCKAGFFGDAMKATATSCRPCPCPYIDASRRFSDTCFLDTDGQATCDACAPGYTGRRCESCAPGYEGNPIQPGGKCRPVNQEIVRCDERGSMGTSGEACRCKNNVVGRLCNECADGSFHLSTRNPDGCLKCFCMGVSRHCTSSSWSRAQLHGASEEPGHFSLTNAASTHTTNEGIFSPTPGELGFSSFHRLLSGPYFWSLPSRFLGDKVTSYGGELRFTVTQRSQPGSTPLHGQPLVVLQGNNIILEHHVAQEPSPGQPSTFIVPFREQAWQRPDGQPATREHLLMALAGIDTLLIRASYAQQPAESRVSGISMDVAVPEETGQDPALEVEQCSCPPGYRGPSCQDCDTGYTRTPSGLYLGTCERCSCHGHSEACEPETGACQGCQHHTEGPRCEQCQPGYYGDAQRGTPQDCQLCPCYGDPAAGQAAHTCFLDTDGHPTCDACSPGHSGRHCERCAPGYYGNPSQGQPCQRDSQVPGPIGCNCDPQGSVSSQCDAAGQCQCKAQVEGLTCSHCRPHHFHLSASNPDGCLPCFCMGITQQCASSAYTRHLISTHFAPGDFQGFALVNPQRNSRLTGEFTVEPVPEGAQLSFGNFAQLGHESFYWQLPETYQGDKVAAYGGKLRYTLSYTAGPQGSPLSDPDVQITGNNIMLVASQPALQGPERRSYEIMFREEFWRRPDGQPATREHLLMALADLDELLIRATFSSVPLAASISAVSLEVAQPGPSNRPRALEVEECRCPPGYIGLSCQDCAPGYTRTGSGLYLGHCELCECNGHSDLCHPETGACSQCQHNAAGEFCELCAPGYYGDATAGTPEDCQPCACPLTNPENMFSRTCESLGAGGYRCTACEPGYTGQYCEQCGPGYVGNPSVQGGQCLPETNQAPLVVEVHPARSIVPQGGSHSLRCQVSGSPPHYFYWSREDGRPVPSGTQQRHQGSELHFPSVQPSDAGVYICTCRNLHQSNTSRAELLVTEAPSKPITVTVEEQRSQSVRPGADVTFICTAKSKSPAYTLVWTRLHNGKLPTRAMDFNGILTIRNVQLSDAGTYVCTGSNMFAMDQGTATLHVQASGTLSAPVVSIHPPQLTVQPGQLAEFRCSATGSPTPTLEWTGGPGGQLPAKAQIHGGILRLPAVEPTDQAQYLCRAHSSAGQQVARAVLHVHGGGGPRVQVSPERTQVHAGRTVRLYCRAAGVPSATITWRKEGGSLPPQARSERTDIATLLIPAITTADAGFYLCVATSPAGTAQARIQVVVLSASDASPPPVKIESSSPSVTEGQTLDLNCVVAGSAHAQVTWYRRGGSLPPHTQVHGSRLRLPQVSPADSGEYVCRVENGSGPKEASITVSVLHGTHSGPSYTPVPGSTRPIRIEPSSSHVAEGQTLDLNCVVPGQAHAQVTWHKRGGSLPARHQTHGSLLRLHQVTPADSGEYVCHVVGTSGPLEASVLVTIEASVIPGPIPPVRIESSSSTVAEGQTLDLSCVVAGQAHAQVTWYKRGGSLPARHQVRGSRLYIFQASPADAGQYVCRASNGMEASITVTVTGTQGANLAYPAGSTQPIRIEPSSSQVAEGQTLDLNCVVPGQSHAQVTWHKRGGSLPVRHQTHGSLLRLYQASPADSGEYVCRVLGSSVPLEASVLVTIEPAGSVPALGVTPTVRIESSSSQVAEGQTLDLNCLVAGQAHAQVTWHKRGGSLPARHQVHGSRLRLLQVTPADSGEYVCRVVGSSGTQEASVLVTIQQRLSGSHSQGVAYPVRIESSSASLANGHTLDLNCLVASQAPHTITWYKRGGSLPSRHQIVGSRLRIPQVTPADSGEYVCHVSNGAGSRETSLIVTIQGSGSSHVPSVSPPIRIESSSPTVVEGQTLDLNCVVARQPQAIITWYKRGGSLPSRHQTHGSHLRLHQMSVADSGEYVCRANNNIDALEASIVISVSPSAGSPSAPGSSMPIRIESSSSHVAEGETLDLNCVVPGQAHAQVTWHKRGGSLPSHHQTRGSRLRLHHVSPADSGEYVCRVMGSSGPLEASVLVTIEASGSSAVHVPAPGGAPPIRIEPSSSRVAEGQTLDLKCVVPGQAHAQVTWHKRGGNLPARHQVHGPLLRLNQVSPADSGEYSCQVTGSSGTLEASVLVTIEPSSPGPIPAPGLAQPIYIEASSSHVTEGQTLDLNCVVPGQAHAQVTWYKRGGSLPARHQTHGSQLRLHLVSPADSGEYVCRAASGPGPEQEASFTVTVPPSEGSSYRLRSPVISIDPPSSTVQQGQDASFKCLIHDGAAPISLEWKTRNQELEDNVHISPNGSIITIVGTRPSNHGTYRCVASNAYGVAQSVVNLSVHGPPTVSVLPEGPVWVKVGKAVTLECVSAGEPRSSARWTRISSTPAKLEQRTYGLMDSHAVLQISSAKPSDAGTYVCLAQNALGTAQKQVEVIVDTGAMAPGAPQVQAEEAELTVEAGHTATLRCSATGSPAPTIHWSKLRSPLPWQHRLEGDTLIIPRVAQQDSGQYICNATSPAGHAEATIILHVESPPYATTVPEHASVQAGETVQLQCLAHGTPPLTFQWSRVGSSLPGRATARNELLHFERAAPEDSGRYRCRVTNKVGSAEAFAQLLVQGPPGSLPATSIPAGSTPTVQVTPQLETKSIGASVEFHCAVPSDRGTQLRWFKEGGQLPPGHSVQDGVLRIQNLDQSCQGTYICQAHGPWGKAQASAQLVIQALPSVLINIRTSVQTVVVGHAVEFECLALGDPKPQVTWSKVGGHLRPGIVQSGGVVRIAHVELADAGQYRCTATNAAGTTQSHVLLLVQALPQISMPQEVRVPAGSAAVFPCIASGYPTPDISWSKLDGSLPPDSRLENNMLMLPSVRPQDAGTYVCTATNRQGKVKAFAHLQVPERVVPYFTQTPYSFLPLPTIKDAYRKFEIKITFRPDSADGMLLYNGQKRVPGSPTNLANRQPDFISFGLVGGRPEFRFDAGSGMATIRHPTPLALGHFHTVTLLRSLTQGSLIVGDLAPVNGTSQGKFQGLDLNEELYLGGYPDYGAIPKAGLSSGFIGCVRELRIQGEEIVFHDLNLTAHGISHCPTCRDRPCQNGGQCHDSESSSYVCVCPAGFTGSRCEHSQALHCHPEACGPDATCVNRPDGRGYTCRCHLGRSGLRCEEGVTVTTPSLSGAGSYLALPALTNTHHELRLDVEFKPLAPDGVLLFSGGKSGPVEDFVSLAMVGGHLEFRYELGSGLAVLRSAEPLALGRWHRVSAERLNKDGSLRVNGGRPVLRSSPGKSQGLNLHTLLYLGGVEPSVPLSPATNMSAHFRGCVGEVSVNGKRLDLTYSFLGSQGIGQCYDSSPCERQPCQHGATCMPAGEYEFQCLCRDGFKGDLCEHEENPCQLREPCLHGGTCQGTRCLCLPGFSGPRCQQGSGHGIAESDWHLEGSGGNDAPGQYGAYFHDDGFLAFPGHVFSRSLPEVPETIELEVRTSTASGLLLWQGVEVGEAGQGKDFISLGLQDGHLVFRYQLGSGEARLVSEDPINDGEWHRVTALREGRRGSIQVDGEELVSGRSPGPNVAVNAKGSVYIGGAPDVATLTGGRFSSGITGCVKNLVLHSARPGAPPPQPLDLQHRAQAGANTRPCPS

SEQ ID NO: 6612 - protein, 109 aa, Homo Sapiens
  misc_feature (1)..(1): Xaa can be any naturally occurring amino acid
XGTPPLTFQWSRVGSSLPGRATARNELLHFERAAPEDSGRYRCRVTNKVGSAEAFAQLLVQESRTWTRAAKGRIYARPMDLGGRPRPVPSWLSKVGGWLQASAKSREQR

SEQ ID NO: 6613 - protein, 307 aa, Homo Sapiens
  misc_feature (1)..(1): Xaa can be any naturally occurring amino acid
XNMLMLPSVRPQDAGTYVCTATNRQGKVKAFAHLQVPERVVPYFTQTPYSFLPLPTIKDAYRKFEIKITFRPDSADGLLLYSGMLLYNGQKRVPGSPTNLANRQPDFISFGLVGGRPEFRFDAGSGMATIRHPTPLALGHFHTVTLLRSLTQGSLIVGDLAPVNGTSQGKFQGLDLNEELYLGGYPDYGAIPKAGLSSGFIGCVRELRIQGEEIVFHDLNLTAHGISHCPTCRDRPCQNGGQCHDSESSSYVCVCPAGFTGSRCEHSQALHCHPEACGPDATCVNRPDGRGYTCRCHLGRSGLRCEE

SEQ ID NO: 6614 - protein, 197 aa, Homo Sapiens
  misc_feature (1)..(1): Xaa can be any naturally occurring amino acid
XTPSGLYLGTCERCSCHGHSEACEPETGACQGCQHHTEGPRCEQCQPGYYGDAQRGTPQDCQLCPCYGDPAAGQAAHTCFLDTDGHPTCDACSPGHSGRHCERCAPGYYGNPSQGQPCQRDSQVPGPIGCNCDPQGSVSSQCDAAGQCQCKVSPNPCPCGACSAPLPRPCGEIRQHLVEAETWAWGAGHGGQGRGCP

SEQ ID NO: 6615 - protein, 242 aa, Homo Sapiens
MAETEALSKLREDFRMQNKSVFILGASGETGRVLLKEILEQGLFSKVTLIGRRKLTFDEEAYKNVNQEVVDFEKLDDYASAFQGHDVGFCCLGTTRGKAGAEGFVRVDRDYVLKSAELAKAGGCKHFNLLSSKGADKSSNFLYLQVKGEVEAKVEELKFDRYSVFRPGVLLCDRQESRPGEWLVRKFFGSLPDSWASGHSVPVVTVVRAMLNNVVRPRDKQMELLENKAIHDLGKAHGSLKP

SEQ ID NO: 6616 - protein, 242 aa, Homo Sapiens; identical to SEQ ID NO: 6615

SEQ ID NO: 6617 - protein, 242 aa, Homo Sapiens; identical to SEQ ID NO: 6615

SEQ ID NO: 6618 - protein, 196 aa, Homo Sapiens
MAETEALSKLREDFRMQNKSVFILGASGETGRVLLKEILEQGLFSKVTLIGRRKLTFDEEAYKNVNQEVVDFEKLDDYASAFQGHDVGFCCLGTTRGKAGAGEVEAKVEELKFDRYSVFRPGVLLCDRQESRPGEWLVRKFFGSLPDSWASGHSVPVVTVVRAMLNNVVRPRDKQMELLENKAIHDLGKAHGSLKP

SEQ ID NO: 6619 - protein, 133 aa, Homo Sapiens
MAETEALSKLREDFRMQNKSVFILGASGETGRVLLKEILEQGLFSKVTLIGRRKLTFDEEAYKNVNQEVVDFEKLDDYASAFQGHDVGFCCLGTTRGKAGAVRKAYALFPFCWPVISRILFLLTLFLCACCNA

SEQ ID NO: 6620 - protein, 133 aa, Homo Sapiens; identical to SEQ ID NO: 6619

SEQ ID NO: 6621 - protein, 133 aa, Homo Sapiens; identical to SEQ ID NO: 6619

SEQ ID NO: 6622 - protein, 276 aa, Homo Sapiens
MAGPAALSAAAAAALAAALLLLRREDPGPGAGPSMAETEALSKLREDFRMQNKSVFILGASGETGRVLLKEILEQGLFSKVTLIGRRKLTFDEEAYKNVNQEVVDFEKLDDYASAFQGHDVGFCCLGTTRGKAGAEGFVRVDRDYVLKSAELAKAGGCKHFNLLSSKGADKSSNFLYLQVKGEVEAKVEELKFDRYSVFRPGVLLCDRQESRPGEWLVRKFFGSLPDSWASGHSVPVVTVVRAMLNNVVRPRDKQMELLENKAIHDLGKAHGSLKP

SEQ ID NO: 6623 - protein, 57 aa, Homo Sapiens
MKFFVFALVLALMISMISADSHEKRHHGYRRKFHEKHHSHREFPFYGDYGSNYLYDN

SEQ ID NO: 6624 - protein, 57 aa, Homo Sapiens; identical to SEQ ID NO: 6623

SEQ ID NO: 6625 - protein, 57 aa, Homo Sapiens; identical to SEQ ID NO: 6623

SEQ ID NO: 6626 - protein, 41 aa, Homo Sapiens
MKFFVFALILALMLSMTGADSHAKEKHHSHRGYRSNYLYDN

SEQ ID NO: 6627 - protein, 51 aa, Homo Sapiens
MKFFVFALILALMLSMTGADSHAKRHHGYKRKFHEKHHSHRGYRSNYLYDN

SEQ ID NO: 6628 - protein, 51 aa, Homo Sapiens; identical to SEQ ID NO: 6627

SEQ ID NO: 6629 - protein, 221 aa, Homo Sapiens
GKLPVLLLGRSSELRPGEFVVAIGSPFSLQNTVTTGIVSTTQRGGKELGLRNSDMDYIQTDAIINYGNSGGPLVNLDGEVIGINTLKVTAGISFAIPSDKIKKFLTESHDRQAKGKAITKKKYIGIRMMSLTSSKAKELKDRHRDFPDVISGAYIIEVIPDTPAEAGGLKENDVIISINGQSVVSANDVSDVIKRESTLNMVVRRGNEDIMITVIPEEIDP

SEQ ID NO: 6630 - protein, 480 aa, Homo Sapiens
MQIPRAALLPLLLLLLAAPASAQLSRAGRSAPLAAGCPDRCEPARCPPQPEHCEGGRARDACGCCEVCGAPEGAACGLQEGPCGEGLQCVVPFGVPASATVRRRAQAGLCVCASSEPVCGSDANTYANLCQLRAASRRSERLHRPPVIVLQRGACGQGQEDPNSLRHKYNFIADVVEKIAPAVVHIELFRKLPFSKREVPVASGSGFIVSEDGLIVTNAHVVTNKHRVKVELKNGATYEAKIKDVDEKADIALIKIDHQGKLPVLLLGRSSELRPGEFVVAIGSPFSLQNTVTTGIVSTTQRGGKELGLRNSDMDYIQTDAIINYGNSGGPLVNLDGEVIGINTLKVTAGISFAIPSDKIKKFLTESHDRQAKGKAITKKKYIGIRMMSLTSSKAKELKDRHRDFPDVISGAYIIEVIPDTPAEAGGLKENDVIISINGQSVVSANDVSDVIKRESTLNMVVRRGNEDIMITVIPEEIDP

SEQ ID NO: 6631 - protein, 453 aa, Homo Sapiens
MQARALLLAALAALALAREPPAAPCPARCDVSRCPSPRCPGGYVPDLCNCCLVCAASEGEPCGGPLDSPCGESLECVRGLCRCRWSHAVCGTDGHTYANVCALQAASRRALQLSGTPVRQLQKGACPLGLHQLSSPRYKFNFIADVVEKIAPAVVHIELFLRHPLFGRNVPLSSGSGFIMSEAGLIITNAHVVSSNSAAPGRQQLKVQLQNGDSYEATIKDIDKKSDIATIKIHPKKKLPVLLLGHSADLRPGEFVVAIGSPFALQNTVTTGIVSTAQREGRELGLRDSDMDYIQTDAIINYGNSGGPLVNLDGEVIGINTLKVTAGISFAIPSDRITRFLTEFQDKQIKDWKKRFIGIRMRTITPSLVDELKASNPDFPEVSSGIYVQEVAPNSPSQRGGIQDGDIIVKVNGRPLVDSSELQEAVLTESPLLLEVRRGNDDLLFSIAPEVVM

SEQ ID NO: 6632 - protein, 357 aa, Homo Sapiens
MQARALLLAALAALALAREPPAAPCPARCDVSRCPSPRCPGGYVPDLCNCCLVCAASEGEPCGGPLDSPCGESLECVRGLCRCRWSHAVCGTDGHTYANVCALQAASRRALQLSGTPVRQLQKGACPLGLHQLSSPRYKFNFIADVVEKIAPAVVHIELFLRHPLFGRNVPLSSGSGFIMSEAGLIITNAHVVSSNSAAPGRQQLKVQLQNGDSYEATIKDIDKKSDIATIKIHPKKKLPVLLLGHSADLRPGEFVVAIGSPFALQNTVTTGIVSTAQREGRELGLRDSDMDYIQTDAIINYGNSGGPLVNLDGEVIGINTLKVTAGISFAIPSDRITRFLTEFQDKQIKAPSLAVH

SEQ ID NO: 6633 - protein, 476 aa, Homo Sapiens
MIRPQLRTAGLGRCLLPGLLLLLVPVLWAGAEKLHTQPSCPAVCQPTRCPALPTCALGTTPVFDLCRCCRVCPAAEREVCGGAQGQPCAPGLQCLQPLRPGFPSTCGCPTLGGAVCGSDRRTYPSMCALRAENRAARRLGKVPAVPVQWGNCGDTGTRSAGPLRRNYNFIAAVVEKVAPSVVHVQLWGRLLHGSRLVPVYSGSGFIVSEDGLIITNAHVVRNQQWIEVVLQNGARYEAVVKDIDLKLDLAVIKIESNAELPVLMLGRSSDLRAGEFVVALGSPFSLQNTATAGIVSTKQRGGKELGMKDSDMDYVQIDATINYGNSGGPLVNLDGDVIGVNSLRVTDGISFAIPSDRVRQFLAEYHEHQMKGKAFSNKKYLGLQMLSLTVPLSEELKMHYPDFPDVSSGVYVCKVVEGTAAQSSGLRDHDVIVNINGKPITTTTDVVKALDSDSLSMAVLRGKDNLLLTVIPETIN

SEQ ID NO: 6634 - protein, 69 aa, Homo Sapiens
MAAHLLPICALFLTLLDMAQGFRGPLLPNRPFTTVWNANTQWCLERHGVDVDVSVFDVVANPGQTFRGP

SEQ ID NO: 6635 - protein, 103 aa, Homo Sapiens
MAAHLLPICALFLTLLDMAQGFRGPLLPNRPFTTVWNANTQWCLERHGVDVDVSVFDVVANPGQTFRGPDMTIFYSSQLGTYPYYTPTGEPVFGGLPQNASLI

SEQ ID NO: 6636 - protein, 435 aa, Homo Sapiens
MAAHLLPICALFLTLLDMAQGFRGPLLPNRPFTTVWNANTQWCLERHGVDVDVSVFDVVANPGQTFRGPDMTIFYSSQLGTYPYYTPTGEPVFGGLPQNASLIAHLARTFQDILAAIPAPDFSGLAVIDWEAWRPRWAFNWDTKDIYRQRSRALVQAQHPDWPAPQVEAVAQDQFQGAARAWMAGTLQLGRALRPRGLWGFYGFPDCYNYDFLSPNYTGQCPSGIRAQNDQLGWLWGQSRALYPSIYMPAVLEGTGKSQMYVQHRVAEAFRVAVAAGDPNLPVLPYVQIFYDTTNHFLPLDELEHSLGESAAQGAAGVVLWVSWENTRTKESCQAIKEYMDTTLGPFILNVTSGALLCSQALCSGHGRCVRRTSHPKALLLLNPASFSIQLTPGGGPLSLRGALSLEDQAQMAVEFKCRCYPGWQAPWCERKSMW

SEQ ID NO: 6637 - protein, 435 aa, Homo Sapiens; identical to SEQ ID NO: 6636

SEQ ID NO: 6638 - protein, 405 aa, Homo Sapiens
MAAHLLPICALFLTLLDMAQGFRGPLLPNRPFTTVWNANTQWCLERHGVDVDVSVFDVVANPGQTFRGPDMTIFYSSQLGTYPYYTPTGEPVFGGLPQNASLIAHLARTFQDILAAIPAPDFSGLAVIDWEAWRPRWAFNWDTKDIYRQRSRALVQAQHPDWPAPQVEAVAQDQFQGAARAWMAGTLQLGRALRPRGLWGFYGFPDCYNYDFLSPNYTGQCPSGIRAQNDQLGWLWGQSRALYPSIYMPAVLEGTGKSQMYVQHRVAEAFRVAVAAGDPNLPVLPYVQIFYDTTNHFLPLESCQAIKEYMDTTLGPFILNVTSGALLCSQALCSGHGRCVRRTSHPKALLLLNPASFSIQLTPGGGPLSLRGALSLEDQAQMAVEFKCRCYPGWQAPWCERKSMW

SEQ ID NO: 6639 - protein, 435 aa, Homo Sapiens; identical to SEQ ID NO: 6636

SEQ ID NO: 6640 - protein, 435 aa, Homo Sapiens; identical to SEQ ID NO: 6636

SEQ ID NO: 6641 - protein, 253 aa, Homo Sapiens
MAGTLQLGRALRPRGLWGFYGFPDCYNYDFLSPNYTGQCPSGIRAQNDQLGWLWGQSRALYPSIYMPAVLEGTGKSQMYVQHRVAEAFRVAVAAGDPNLPVLPYVQIFYDTTNHFLPLDELEHSLGESAAQGAAGVVLWVSWENTRTKESCQAIKEYMDTTLGPFILNVTSGALLCSQALCSGHGRCVRRTSHPKALLLLNPASFSIQLTPGGGPLSLRGALSLEDQAQMAVEFKCRCYPGWQAPWCERKSMW

SEQ ID NO: 6642 - protein, 176 aa, Homo Sapiens
MYVQHRVAEAFRVAVAAGDPNLPVLPYVQIFYDTTNHFLPLDELEHSLGESAAQGAAGVVLWVSWENTRTKESCQAIKEYMDTTLGPFILNVTSGALLCSQALCSGHGRCVRRTSHPKALLLLNPASFSIQLTPGGGPLSLRGALSLEDQAQMAVEFKCRCYPGWQAPWCERKSMW

SEQ ID NO: 6643 - protein, 48 aa, Homo Sapiens
MRAGPGPTVTLALVLAVSWAMELKPTAPPIFTGRPFVVAWDVPTQDCG

SEQ ID NO: 6644 - protein, 76 aa, Homo Sapiens
MRAGPGPTVTLALVLAVSWAMELKPTAPPIFTGRPFVVAWDVPTQDCGPRLKVPLDLNAFDVQASPNEGFVNQNIT

SEQ ID NO: 6645 - protein, 81 aa, Homo Sapiens
MRAGPGPTVTLALVLAVSWAMELKPTAPPIFTGRPFVVAWDVPTQDCGPRLKVPLDLNAFDVQASPNEGFVNQNITIFYRD

SEQ ID NO: 6646 - protein, 117 aa, Homo Sapiens
MRAGPGPTVTLALVLAVSWAMELKPTAPPIFTGRPFVVAWDVPTQDCGPRLKVPLDLNAFDVQASPNEGFVNQNITIFYRDRLGLYPRFDSAGRSVHGGVPQNVSLWAHRKMLQKRV

SEQ ID NO: 6647 - protein, 121 aa, Homo Sapiens
MRAGPGPTVTLALVLAVSWAMELKPTAPPIFTGRPFVVAWDVPTQDCGPRLKVPLDLNAFDVQASPNEGFVNQNITIFYRDRLGLYPRFDSAGRSVHGGVPQNVSLWAHRKMLQKRVEHYI

SEQ ID NO: 6648 - protein, 473 aa, Homo Sapiens
MRAGPGPTVTLALVLAVSWAMELKPTAPPIFTGRPFVVAWDVPTQDCGPRLKVPLDLNAFDVQASPNEGFVNQNITIFYRDRLGLYPRFDSAGRSVHGGVPQNVSLWAHRKMLQKRVEHYIRTQESAGLAVIDWEDWRPVWVRNWQDKDVYRRLSRQLVASRHPDWPPDRIVKQAQYEFEFAAQQFMLETLRYVKAVRPRHLWGFYLFPDCYNHDYVQNWESYTGRCPDVEVARNDQLAWLWAESTALFPSVYLDETLASSRHGRNFVSFRVQEALRVARTHHANHALPVYVFTRPTYSRRLTGLSEMDLISTIGESAALGAAGVILWGDAGYTTSTETCQYLKDYLTRLLVPYVVNVSWATQYCSRAQCHGHGRCVRRNPSASTFLHLSTNSFRLVPGHAPGEPQLRPVGELSWADIDHLQTHFRCQCYLGWSGEQCQWDHRQAAGGASEAWAGSHLTSLLALAALAFTWTL

SEQ ID NO: 6649 - protein, 473 aa, Homo Sapiens; identical to SEQ ID NO: 6648

SEQ ID NO: 6650 - protein, 473 aa, Homo Sapiens; identical to SEQ ID NO: 6648

SEQ ID NO: 6651 - protein, 473 aa, Homo Sapiens; identical to SEQ ID NO: 6648

SEQ ID NO: 6652 - protein, 168 aa, Homo Sapiens
MLPPAHHQAFVRHRLEEAFRVALVGHRHPLPVLAYVRLTHRRSGRFLSQDDLVQSIGVSAALGAAGVVLWGDLSLSSSEEECWHLHDYLVDTLGPYVINVTRAAMACSHQRCHGHGRCARRDPGQMEAFLHLWPDGSLGDWKSFSCHCYWGWAGPTCQEPRPGPKEAV

SEQ ID NO: 6653 - protein, 138 aa, Homo Sapiens
MLPPAHHQAFVRHRLEEAFRVALVGHRHPLPVLAYVRLTHRRSGRFLSQEECWHLHDYLVDTLGPYVINVTRAAMACSHQRCHGHGRCARRDPGQMEAFLHLWPDGSLGDWKSFSCHCYWGWAGPTCQEPRPGPKEAV

SEQ ID NO: 6654 - protein, 160 aa, Homo Sapiens
MTTQLGPALVLGVALCLGCGQPLPQVPERPFSVLWNVPSAHCEARFGVHLPLNALGIIANRGQHFHGQNMTIFYKNQLGLYPYFGPRGTAHNGGIPQALPLDRHLALAAYQIHHSLRPGFAGPAVLDWEEWCPLWAGNWGRRRAYQAASWAWAQQVFPDL

SEQ ID NO: 6655 - protein, 417 aa, Homo Sapiens
MTTQLGPALVLGVALCLGCGQPLPQVPERPFSVLWNVPSAHCEARFGVHLPLNALGIIANRGQHFHGQNMTIFYKNQLGLYPYFGPRGTAHNGGIPQALPLDRHLALAAYQIHHSLRPGFAGPAVLDWEEWCPLWAGNWGRRRAYQAASWAWAQQVFPDLDPQEQLYKAYTGFEQAARALMEDTLRVAQALRPHGLWGFYHYPACGNGWHSMASNYTGRCHAATLARNTQLHWLWAASSALFPSIYLPPRLPPAHHQAFVRHRLEEAFRVALVGHRHPLPVLAYVRLTHRRSGRFLSQDDLVQSIGVSAALGAAGVVLWGDLSLSSSEEECWHLHDYLVDTLGPYVINVTRAAMACSHQRCHGHGRCARRDPGQMEAFLHLWPDGSLGDWKSFSCHCYWGWAGPTCQEPRPGPKEAV

SEQ ID NO: 6656 - protein, 387 aa, Homo Sapiens
MTTQLGPALVLGVALCLGCGQPLPQVPERPFSVLWNVPSAHCEARFGVHLPLNALGIIANRGQHFHGQNMTIFYKNQLGLYPYFGPRGTAHNGGIPQALPLDRHLALAAYQIHHSLRPGFAGPAVLDWEEWCPLWAGNWGRRRAYQAASWAWAQQVFPDLDPQEQLYKAYTGFEQAARALMEDTLRVAQALRPHGLWGFYHYPACGNGWHSMASNYTGRCHAATLARNTQLHWLWAASSALFPSIYLPPRLPPAHHQAFVRHRLEEAFRVALVGHRHPLPVLAYVRLTHRRSGRFLSQEECWHLHDYLVDTLGPYVINVTRAAMACSHQRCHGHGRCARRDPGQMEAFLHLWPDGSLGDWKSFSCHCYWGWAGPTCQEPRPGPKEAV

SEQ ID NO: 6657 - protein, 387 aa, Homo Sapiens; identical to SEQ ID NO: 6656

SEQ ID NO: 6658 - protein, 417 aa, Homo Sapiens; identical to SEQ ID NO: 6655

SEQ ID NO: 6659 - protein, 92 aa, Homo Sapiens
MADKVRRQRPRRRVCWALVAVLLADLLALSDTLAVMSVDLGSESMKVAIVKPGVPMEIVLNKESRRKTPVIVTLKENERFFGDSAASMAIKN

SEQ ID NO: 6660 - protein, 103 aa, Homo Sapiens
MADKVRRQRPRRRVCWALVAVLLADLLALSDTLAVMSVDLGSESMKVAIVKPGVPMEIVLNKESRRKTPVIVTLKENERFFGDSAASMAIKNPKATLRYFQHL

SEQ ID NO: 6661 - protein, 149 aa, Homo Sapiens
MADKVRRQRPRRRVCWALVAVLLADLLALSDTLAVMSVDLGSESMKVAIVKPGVPMEIVLNKESRRKTPVIVTLKENERFFGDSAASMAIKNPKATLRYFQHLLGKQADNPHVALYQARFPEHELTFDPQRQTVHFQISSQLQFSPEEV

SEQ ID NO: 6662 - protein, 154 aa, Homo Sapiens
MADKVRRQRPRRRVCWALVAVLLADLLALSDTLAVMSVDLGSESMKVAIVKPGVPMEIVLNKESRRKTPVIVTLKENERFFGDSAASMAIKNPKATLRYFQHLLGKQADNPHVALYQARFPEHELTFDPQRQTVHFQISSQLQFSPEEVLGMVL

SEQ ID NO: 6663 - protein, 211 aa, Homo Sapiens
MADKVRRQRPRRRVCWALVAVLLADLLALSDTLAVMSVDLGSESMKVAIVKPGVPMEIVLNKESRRKTPVIVTLKENERFFGDSAASMAIKNPKATLRYFQHLLGKQADNPHVALYQARFPEHELTFDPQRQTVHFQISSQLQFSPEEVLGMVLNYSRSLAEDFAEQPIKDAVITVPVFFNQAERRAVLQAARMAGLKVLQLINDNTATAL

SEQ ID NO: 6664 - protein, 224 aa, Homo Sapiens
MADKVRRQRPRRRVCWALVAVLLADLLALSDTLAVMSVDLGSESMKVAIVKPGVPMEIVLNKESRRKTPVIVTLKENERFFGDSAASMAIKNPKATLRYFQHLLGKQADNPHVALYQARFPEHELTFDPQRQTVHFQISSQLQFSPEEVLGMVLNYSRSLAEDFAEQPIKDAVITVPVFFNQAERRAVLQAARMAGLKVLQLINDNTATALSYGVFRRKDINTT

SEQ ID NO: 6665 - protein, 656 aa, Homo Sapiens
MADKVRRQRPRRRVCWALVAVLLADLLALSDTLAVMSVDLGSESMKVAIVKPGVPMEIVLNKESRRKTPVIVTLKENERFFGDSAASMAIKNPKATLRYFQHLLGKQADNPHVALYQARFPEHELTFDPQRQTVHFQISSQLQFSPEEVLGMVLNYSRSLAEDFAEQPIKDAVITVPVFFNQAERRAVLQAARMAGLKVLQLINDNTATALSYGVFRRKDINTTAQNIMFYDMGSGSTVCTIVTYQMVKTKEAGMQPQLQIRGVGFDRTLGGLEMELRLRERLAGLFNEQRKGQRAKDVRENPRAMAKLLREANRLKTVLSANADHMAQIEGLMDDVDFKAKVTRVEFEELCADLFERVPGPVQQALQSAEMSLDEIEQVILVGGATRVPRVQEVLLKAVGKEELGKNINADEAAAMGAVYQAAALSKAFKVKPFVVRDAVVYPILVEFTREVEEEPGIHSLKHNKRVLFSRMGPYPQRKVITFNRYSHDFNFHINYGDLGFLGPEDLRVFGSQNLTTVKLKGVGDSFKKYPDYESKGIKAHFNLDESGVLSLDRVESVFETLVEDSAEEESTLTKLGNTISSLFGGGTTPDAKENGTDTVQEEEESPAEGSKDEPGEQVELKEEAEAPVEDGSQPPPPEPKGDATPEGEKATEKE

SEQ ID NO: 6666 - protein, 937 aa, Homo Sapiens
MADKVRRQRPRRRVCWALVAVLLADLLALSDTLAVMSVDLGSESMKVAIVKPGVPMEIVLNKESRRKTPVIVTLKENERFFGDSAASMAIKNPKATLRYFQHLLGKQADNPHVALYQARFPEHELTFDPQRQTVHFQISSQLQFSPEEVLGMVLNYSRSLAEDFAEQPIKDAVITVPVFFNQAERRAVLQAARMAGLKVLQLINDNTATALSYGVFRRKDINTTAQNIMFYDMGSGSTVCTIVTYQMVKTKEAGMQPQLQIRGVGFDRTLGGLEMELRLRERLAGLFNEQRKGQRAKDVRENPRAMAKLLREANRLKTVLSANADHMAQIEGLMDDVDFKAKVTRVEFEELCADLFERVPGPVQQALQSAEMSLDEIEQVILVGGATRVPRVQEVLLKAVGKEELGKNINADEAAAMGAVYQAAALSKAFKVKPFVVRDAVVYPILVEFTREVEEEPGIHSLKHNKRVLFSRMGPYPQRKVITFNRYSHDFNFHINYGDLGFLGPEDLRVFGSQNLTTVKLKGVGDSFKKYPDYESKGIKAHFNLDESGVLSLDRVESVFETLVEDSAEEESTLTKLGNTISSLFGGGTTPDAKENGTDTVQKPSEKAEAGPEGVAPAPEGEKKQKPARKRRMVEEIGVELVVLDLPDLPEDKLAQSVQKLQDLTLRDLEKQEREKAANSLEAFIFETQDKLYQPEYQEVSTEEQREEISGKLSAASTWLEDEGVGATTVMLKEKLAELRKLCQGLFFRVEERKKWPERLSALDNLLNHSSMFLKGARLIPEMDQIFTEVEMTTLEKVINETWAWKNATLAEQAKLPATEKPVLLSKDIEAKMMALDREVQYLLNKAKFTKPRPRPKDKNGTRAEPPLNASASDQGEKVIPPAGQTEDAEPISEPEKVETGSEPGDTEPLELGGPGAEPEQKEQSTGQKRPLKNDEL

SEQ ID NO: 6667 - protein, 678 aa, Homo Sapiens
MADKVRRQRPRRRVCWALVAVLLADLLALSDTLAVMSVDLGSESMKVAIVKPGVPMEIVLNKESRRKTPVIVTLKENERFFGDSAASMAIKNPKATLRYFQHLLGKQADNPHVALYQARFPEHELTFDPQRQTVHFQISSQLQFSPEEVLGMVLNYSRSLAEDFAEQPIKDAVITVPVFFNQAERRAVLQAARMAGLKVLQLINDNTATALSYGVFRRKDINTTAQNIMFYDMGSGSTVCTIVTYQMVKTKEAGMQPQLQIRGVGFDRTLGGLEMELRLRERLAGLFNEQRKGQRAKDVRENPRAMAKLLREANRLKTVLSANADHMAQIEGLMDDVDFKAKVTRVEFEELCADLFERVPGPVQQALQSAEMSLDEIEQVILVGGATRVPRVQEVLLKAVGKEELGKNINADEAAAMGAVYQAAALSKAFKVKPFVVRDAVVYPILVEFTREVEEEPGIHSLKHNKRVLFSRMGPYPQRKVITFNRYSHDFNFHINYGDLGFLGPEDLRVFGSQNLTTVKLKGVGDSFKKYPDYESKGIKAHFNLDESGVLSLDRVESVFETLVEDSAEEESTLTKLGNTISSLFGGGTTPDAKENGTDTVQEEEESPAEGSKDEPGEQVELKEEAEAPVEDGSQPPPPEPKGDATPEGEKATEKENGDKSEAQKPVVCRASVTRFGF

SEQ ID NO: 6668 - protein, 677 aa, Homo Sapiens
MADKVRRQRPRRRVCWALVAVLLADLLALSDTLAVMSVDLGSESMKVAIVKPGVPMEIVLNKESRRKTPVIVTLKENERFFGDSAASMAIKNPKATLRYFQHLLGKQADNPHVALYQARFPEHELTFDPQRQTVHFQISSQLQFSPEEVLGMVLNYSRSLAEDFAEQPIKDAVITVPVFFNQAERRAVLQAARMAGLKVLQLINDNTATALSYGVFRRKDINTTAQNIMFYDMGSGSTVCTIVTYQMVKTKEAGMQPQLQIRGVGFDRTLGGLEMELRLRERLAGLFNEQRKGQRAKDVRENPRAMAKLLREANRLKTVLSANADHMAQIEGLMDDVDFKAKVTRVEFEELCADLFERVPGPVQQALQSAEMSLDEIEQVILVGGATRVPRVQEVLLKAVGKEELGKNINADEAAAMGAVYQAAALSKAFKVKPFVVRDAVVYPILVEFTREVEEEPGIHSLKHNKRVLFSRMGPYPQRKVITFNRYSHDFNFHINYGDLGFLGPEDLRVFGSQNLTTVKLKGVGDSFKKYPDYESKGIKAHFNLDESGVLSLDRVESVFETLVEDSAEEESTLTKLGNTISSLFGGGTTPDAKENGTDTVQEEEESPAEGSKDEPGEQVELKEEAEAPVEDGSQPPPPEPKGDATPEGEKATEKENGDKSEAQASVCRASVTRFGF

SEQ ID NO: 6669 - protein, 999 aa, Homo Sapiens
MADKVRRQRPRRRVCWALVAVLLADLLALSDTLAVMSVDLGSESMKVAIVKPGVPMEIVLNKESRRKTPVIVTLKENERFFGDSAASMAIKNPKATLRYFQHLLGKQADNPHVALYQARFPEHELTFDPQRQTVHFQISSQLQFSPEEVLGMVLNYSRSLAEDFAEQPIKDAVITVPVFFNQAERRAVLQAARMAGLKVLQLINDNTATALSYGVFRRKDINTTAQNIMFYDMGSGSTVCTIVTYQMVKTKEAGMQPQLQIRGVGFDRTLGGLEMELRLRERLAGLFNEQRKGQRAKDVRENPRAMAKLLREANRLKTVLSANADHMAQIEGLMDDVDFKAKVTRVEFEELCADLFERVPGPVQQALQSAEMSLDEIEQVILVGGATRVPRVQEVLLKAVGKEELGKNINADEAAAMGAVYQAAALSKAFKVKPFVVRDAVVYPILVEFTREVEEEPGIHSLKHNKRVLFSRMGPYPQRKVITFNRYSHDFNFHINYGDLGFLGPEDLRVFGSQNLTTVKLKGVGDSFKKYPDYESKGIKAHFNLDESGVLSLDRVESVFETLVEDSAEEESTLTKLGNTISSLFGGGTTPDAKENGTDTVQEEEESPAEGSKDEPGEQVELKEEAEAPVEDGSQPPPPEPKGDATPEGEKATEKENGDKSEAQKPSEKAEAGPEGVAPAPEGEKKQKPARKRRMVEEIGVELVVLDLPDLPEDKLAQSVQKLQDLTLRDLEKQEREKAANSLEAFIFETQDKLYQPEYQEVSTEEQREEISGKLSAASTWLEDEGVGATTVMLKEKLAELRKLCQGLFFRVEERKKWPERLSALDNLLNHSSMFLKGARLIPEMDQIFTEVEMTTLEKVINETWAWKNATLAEQAKLPATEKPVLLSKDIEAKMMALDREVQYLLNKAKFTKPRPRPKDKNGTRAEPPLNASASDQGEKVIPPAGQTEDAEPISEPEKVETGSEPGDTEPLELGGPGAEPEQKEQSTGQKRPLKNDEL

SEQ ID NO: 6670 - protein, 937 aa, Homo Sapiens; identical to SEQ ID NO: 6666

SEQ ID NO: 6671 - protein, 147 aa, Homo Sapiens
MADKVRRQRPRRRVCWALVAVLLADLLALSDTLAVMSVDLGSESMKVAIVKPGVPMEIVLNKESRRKTPVIVTLKENERFFGDSAASMAIKNPKATLRYFQHLLGKQADNPHVALYQARFPEHELTFDPQRQTVHFQISSQLQFSPL

SEQ ID NO: 6672 - protein, 38 aa, Homo Sapiens
MADKVRRQRPRRRVCWALVAVLLADLLALSGNLGGKHR

SEQ ID NO: 6673 - protein, 38 aa, Homo Sapiens; identical to SEQ ID NO: 6672

SEQ ID NO: 6674 - protein, 79 aa, Homo Sapiens
MGILKLQVFLIVLSVALNHLKATPIERQEWIIPVLSRNILLELRGAKPEHEAGKKSKVIRWKSGNATLPHVQRSAWQIF

SEQ ID NO: 6675 - protein, 79 aa, Homo Sapiens
MGILKLQVFLIVLSVALNHLKATPIESHQVEKRKCNTATCATQRLANFLVHSSNNFGAILSSTNVGSNTYGKRNAVEVL

SEQ ID NO: 6676 - protein, 89 aa, Homo Sapiens
MGILKLQVFLIVLSVALNHLKATPIESHQVEKRKCNTATCATQRLANFLVHSSNNFGAILSSTNVGSNTYGKRNAVEVLKREPLNYLPL

SEQ ID NO: 6677 - protein, 89 aa, Homo Sapiens; identical to SEQ ID NO: 6676

SEQ ID NO: 6678 - protein, 85 aa, Homo Sapiens
  misc_feature (1)..(1): Xaa can be any naturally occurring amino acid
XLKATPIERCLDQIPIFTVFQENHQVEKRKCNTATCATQRLANFLVHSSNNFGAILSSTNVGSNTYGKRNAVEVLKREPLNYLPL

SEQ ID NO: 6679 - protein, 317 aa, Homo Sapiens
MKTALILLSILGMACAFSMKNLHRRVKIEDSEENGVFKYRPRYYLYKHAYFYPHLKRFPVQGSSDSSEENGDDSSEEEEEEEETSNEGENNEESNEDEDSEAENTTLSATTLGYGEDATPGTGYTGLAAIQLPKKAGDITNKATKEKESDEEEEEEEEGNENEESEAEVDENEQGINGTSTNSTEAENGNGSSGGDNGEEGEEESVTGANAEDTTETGRQGKGTSKTTTSPNGGFEPTTPPQVYRTTSPPFGKTTTVEYEGEYEYTGANEYDNGYEIYESENGEPRGDNYRAYEDEYSYFKGQGYDGYDGQNYYHHQ

SEQ ID NO: 6680 - protein, 180 aa, Homo Sapiens
MAPSSPRPALPALLVLLGALFPGPGNAQTSVSPSKVILPRGGSVLVTCSTSCDQPKLLGIETPLPKKELLLPGNNRKVYELSNVQEDSQPMCYSNCPDGQSTAKTFLTVYWTPERVEGGAPRANLTVVLLRGEKELKREPAVGEPAEVTTTVLVRRDHHGANFSCRTELDLRPQGLELFE

SEQ ID NO: 6681 - protein, 532 aa, Homo Sapiens
MAPSSPRPALPALLVLLGALFPGPGNAQTSVSPSKVILPRGGSVLVTCSTSCDQPKLLGIETPLPKKELLLPGNNRKVYELSNVQEDSQPMCYSNCPDGQSTAKTFLTVYWTPERVELAPLPSWQPVGKNLTLRCQVEGGAPRANLTVVLLRGEKELKREPAVGEPAEVTTTVLVRRDHHGANFSCRTELDLRPQGLELFENTSAPYQLQTFVLPATPPQLVSPRVLEVDTQGTVVCSLDGLFPVSEAQVHLALGDQRLNPTVTYGNDSFSAKASVSVTAEDEGTQRLTCAVILGNQSQETLQTVTIYSFPAPNVILTKPEVSEGTEVTVKCEAHPRAKVTLNGVPAQPLGPRAQLLLKATPEDNGRSFSCSATLEVAGQLIHKNQTRELRVLYGPRLDERDCPGNWTWPENSQQTPMCQAWGNPLPELKCLKDGTFPLPIGESVTVTRDLEGTYLCRARSTQGEVTRKVTVNVLSPRYEIVIITVVAAAVIMGTAGLSTYLYNRQRKIKKYRLQQAQKGTPMKPNTQATPP

SEQ ID NO: 6682 - protein, 310 aa, Homo Sapiens
MAPSSPRPALPALLVLLGALFPVSEAQVHLALGDQRLNPTVTYGNDSFSAKASVSVTAEDEGTQRLTCAVILGNQSQETLQTVTIYSFPAPNVILTKPEVSEGTEVTVKCEAHPRAKVTLNGVPAQPLGPRAQLLLKATPEDNGRSFSCSATLEVAGQLIHKNQTRELRVLYGPRLDERDCPGNWTWPENSQQTPMCQAWGNPLPELKCLKDGTFPLPIGESVTVTRDLEGTYLCRARSTQGEVTRKVTVNVLSPRYEIVIITVVAAAVIMGTAGLSTYLYNRQRKIKKYRLQQAQKGTPMKPNTQATPP

SEQ ID NO: 6683 - protein, 174 aa, Homo Sapiens
MNSNVSVYQPPRQVILTLQPTLVAVGKSFTIECRVPTVEPLDSLTLFLFRGNETLHYETFGKAAPAPQEATATFNSTADREDGHRNFSCLAVLDLMSRGGNIFHKHSAPKMLEIYEPVSDSQMVIIVTVVSVLLSLFVTSVLLCFIFGQHLRQQRMGTYGVRAAWRRLPQAFRP

SEQ ID NO: 6684 - protein, 251 aa, Homo Sapiens
MSSFGYRTLTVALFTLICCPGSDEKVFEVHVRPKKLATSLDKILLDEQAQWKHYLVSNISHDTVLQCHFTCSGKQESMNSNVSVYQPPRQVILTLQPTLVAVGKSFTIECRVPTVEPLDSLTLFLFRGNETLHYETFGKAAPAPQEATATFNSTADREDGHRNFSCLAVLDLMSRGGNIFHKHSAPKMLEIYEPVSDSQMVIIVTVVSVLLSLFVTSVLLCFIFGQHLRQQRMGTYGVRAAWRRLPQAFRP

SEQ ID NO: 6685 - protein, 167 aa, Homo Sapiens
MSSFGYRTLTVALFTLICCPGSDEKVFEVHVRPKKLAVEPKGSLEVNCSTTCNQPEVGGLETSLDKILLDEQAQWKHYLVSNISHDTVLQCHFTCSGKQESMNSNVSVYQPPRQVILTLQPTLVAVGKSFTIECRVPTVEPLDSLTLFLFRGNETLHYETFGKAAPA

SEQ ID NO: 6686 - protein, 214 aa, Homo Sapiens
MSSFGYRTLTVALFTLICCPGSDEKVFEVHVRPKKLAVEPKGSLEVNCSTTCNQPEVGGLETSLDKILLDEQAQWKHYLVSNISHDTVLQCHFTCSGKQESMNSNVSVYQPPRQVILTLQPTLVAVGKSFTIECRVPTVEPLDSLTLFLFRGNETLHYETFGKAAPAPQEATATFNSTADREDGHRNFSCLAVLDLMSRGGNIFHKHSAPKMLE

SEQ ID NO: 6687 - protein, 216 aa, Homo Sapiens
MSSFGYRTLTVALFTLICCPGSDEKVFEVHVRPKKLAVEPKGSLEVNCSTTCNQPEVGGLETSLDKILLDEQAQWKHYLVSNISHDTVLQCHFTCSGKQESMNSNVSVYQPPRQVILTLQPTLVAVGKSFTIECRVPTVEPLDSLTLFLFRGNETLHYETFGKAAPAPQEATATFNSTADREDGHRNFSCLAVLDLMSRGGNIFHKHSAPKMLEIY

SEQ ID NO: 6688 - protein, 275 aa, Homo Sapiens
MSSFGYRTLTVALFTLICCPGSDEKVFEVHVRPKKLAVEPKGSLEVNCSTTCNQPEVGGLETSLDKILLDEQAQWKHYLVSNISHDTVLQCHFTCSGKQESMNSNVSVYQPPRQVILTLQPTLVAVGKSFTIECRVPTVEPLDSLTLFLFRGNETLHYETFGKAAPAPQEATATFNSTADREDGHRNFSCLAVLDLMSRGGNIFHKHSAPKMLEIYEPVSDSQMVIIVTVVSVLLSLFVTSVLLCFIFGQHLRQQRMGTYGVRAAWRRLPQAFRP

SEQ ID NO: 6689 - protein, 275 aa, Homo Sapiens; identical to SEQ ID NO: 6688

SEQ ID NO: 6690 - protein, 275 aa, Homo Sapiens; identical to SEQ ID NO: 6688

SEQ ID NO: 6691 - protein, 275 aa, Homo Sapiens; identical to SEQ ID NO: 6688

SEQ ID NO: 6692 - protein, 275 aa, Homo Sapiens; identical to SEQ ID NO: 6688

SEQ ID NO: 6693 - protein, 53 aa, Homo Sapiens
MSSFGYRTLTVALFTLICCPGVNEFQRQRVPASKAGHPDTATHFGGCGQVLHH

SEQ ID NO: 6694 - protein, 271 aa, Homo Sapiens
MGSLFPLSLLFFLAAAYPGVGSALGRRTKRAQSPKGSPLAPSGTSVPFWVRMSPEFVAVQPGKSVQLNCSNSCPQPQNSSLRTPLRQGKTLRGPGWVSYQLLDVRAWSSLAHCLVTCAGKTRWATSRITAYKPPHSVILEPPVLKGRKYTLRCHVTQVFPVGYLVVTLRHGSRVIYSESLERFTGLDLANVTLTYEFAAGPRDFWQPVICHARLNLDGLVVRNSSAPITLMLAWSPAPTALASGSIAALVGILLTVGAAYLCKCLAMKSQA

SEQ ID NO: 6695 - protein, 237 aa, Homo Sapiens
MGSLFPLSLLFFLAAAYPGVGSALGRRTKRAQSPKGSPLAPSGTSVPFWVRMSPEFVAVQPGKSVQLNCSNSCPQPQNSSLRTPLRQGKTLRGPGWVSYQLLDVRAWSSLAHCLVTCAGKTRWATSRITAYKPPHSVILEPPVLKGRKYTLRCHVTQVFPVGYLVVTLRHGSRVIYSESLERFTGLDLANVTLTYEFAAGPRDFWQPVICHARLNLDGLVVRNSSAPITLMLGEAPL

SEQ ID NO: 6696 - protein, 272 aa, Homo Sapiens
MGSLFPLSLLFFLAAAYPGVGSALGRRTKRAQSPKGSPLAPSGTSVPFWVRMSPEFVAVQPGKSVQLNCSNSCPQPQNSSLRTPLRQGKTLRGPGWVSYQLLDVRAWSSLAHCLVTCAGKTRWATSRITAYSVPGGLLGGDPEAWKPGHLFRKPGALHRPGSGQRDLDLRVCCWTPRLLAARDLPRAPQSRRPGGPQQLGTHYTDARLEPRAHSFGLRFHRCPCRDPPHCGRCVPMQVPSYEVPGVKGDVLCRLSEKKRNMKQSGEMAIHGG

SEQ ID NO: 6697 - protein, 155 aa, Homo Sapiens
MKVASGSTATAAAGPSCALKAGKTASGAGEVVRCLSEQSVAISRCAGGAGARLPALLDEQQVNVLLYDMNGCYSRLKELVPTLPQNRKVSKVEILQHVIDYIRDLQLELNSESEVGTPGGRGLPVRAPLSTLNGEISALTAEAACVPADDRILCR

SEQ ID NO: 6698 - protein, 149 aa, Homo Sapiens
MKVASGSTATAAAGPSCALKAGKTASGAGEVVRCLSEQSVAISRCAGGAGARLPALLDEQQVNVLLYDMNGCYSRLKELVPTLPQNRKVSKVEILQHVIDYIRDLQLELNSESEVGTPGGRGLPVRAPLSTLNGEISALTAEVRSRSDH

SEQ ID NO: 6699 - protein, 257 aa, Homo Sapiens
EFIIRGGRVPSHCLHFSRSFQKKTYSKMNNPAIKRIGNHITKSPEDKREYRGLELANGIKVLLISDPTTDKSSAALDVHIGSLSDPPNIAGLSHFCEHMLFLGTKKYPKENEYSQFLSEHAGSSNAFTSGEHTNYYFDVSHEHLEGALDRFAQFFLCPLFDESCKDREVNAVDSEHEKNVMNDAWRLFQLEKATGNPKHPFSKFGTGNKYTLETRPNQEGIDVRQELLKFHSAYYSSNLMAVCVLGRESLDDLTNLV

SEQ ID NO: 6700 - protein, 1019 aa, Homo Sapiens [sequence omitted]

SEQ ID NO: 6701 - protein, 61 aa, Homo Sapiens
MRYRLAWLLHPALPSTFRSVLGARLPPPERLCGNYQVVFQSSGTILHFHQQCVKIPISLYP

SEQ ID NO: 6702 - protein, 464 aa, Homo Sapiens
MSKLWFKQDDKFFLPKACLNFEFFSPFAYVDPLHCNMAYLYLELLKDSLNEYAYAAELAGLSYDLQNTIYGMYLSVKGYNDKQPILLKKIIEKMATFEIDEKRFEIIKEAYMRSLNNFRAEQPHQHAMYYLRLLMTEVAWTKDELKEALDDVTLPRLKAFIPQLLSRLHIEALLHGNITKQAALGIMQMVEDTLIEHAHTKPLLPSQLVRYREVQLPDRGWFVYQQRNEVHNNCGIEIYYQTDMQSTSENMFLELFCQIISEPCFNTLRTKEQLGYIVFSGPRRANGIQGLRFIIQSEKPPHYLESRVEAFLITMEKSIEDMTEEAFQKHIQALAIRRLDKPKKLSAECAKYWGEIISQQYNFDRDNTEVAYLKTLTKEDIIKFYKEMLAVDAPRRHKVSVHVLAREMDSCPVVGEFPCQNDINLSQAPALPQPEVIQNMTEFKRGLPLFPLVKPHINFMAAKL

SEQ ID NO: 6703 - protein, 106 aa, Homo Sapiens
MAAPGALLVMGTLTLSPRLEYSGVISAHCNLCLLSSSDCHASASGVTGVTGVHHHTQLSFVFLVETGFCHVGRASPELLASSDPPASASQSAGIIGVSQGLNLTWS

SEQ ID NO: 6704 - protein, 187 aa, Homo Sapiens
MAAPGALLVMGVSGSGKSTVGALLASELGWKFYDADDYHPEENRRKMGKGIPLNDQDRIPWLCNLHDILLRDVASGQRVVLACSALKKTYRDILTQGKDGVALKCEESGKEAKQAEMQLLVVHLSGSFEVISGRLLKREGHFMPPELLQSQFETLEPPAAPENFIQISVDKNVSEIIATIMETLKMK

SEQ ID NO: 6705 - protein, 90 aa, Homo Sapiens
MAAPGALLVMGVSGSGKSTVGALLASELGWKFYDADDYHPEENRRKMGKGIPLNDQRCSLGTACGSSLFSPEENVQRHINTRKRWCSSEV

SEQ ID NO: 6706 - protein, 59 aa, Homo Sapiens
MAAPGALLVMGVSGSGNWDGNSMMLMIITRRKIEGRWEKAYRSMTRTGFHGSVTCMTFY

SEQ ID NO: 6707 - protein, 90 aa, Homo Sapiens
MGKGIPLNDQDRIPWLCNLHDILLRDVASGQRVVLACSALKKTYRDILTQGKDGVALKCEESGKEAKQAEMQLLVVHLSGSFEVISGRLL

SEQ ID NO: 6708 - protein, 141 aa, Homo Sapiens
MGKGIPLNDQDRIPWLCNLHDILLRDVASGQRVVLACSALKKTYRDILTQGKDGVALKCEESGKEAKQAEMQLLVVHLSGSFEVISGRLLKREGHFMPPELLQSQFETLEPPAAPENFIQISVDKNVSEIIATIMETLKMK

SEQ ID NO: 6709 - protein, 86 aa, Homo Sapiens
MPPPRTGRGLLWLGLVLSSVCVALGSETQANSTTDALNVLLIIVDDLRPSLGCYGDKLVRSPNIDQLASHSLLFQNAFAQQAVCAP

SEQ ID NO: 6710 - protein, 550 aa, Homo Sapiens
MPPPRTGRGLLWLGLVLSSVCVALGSETQANSTTDALNVLLIIVDDLRPSLGCYGDKLVRSPNIDQLASHSLLFQNAFAQQAVCAPSRVSFLTGRRPDTTRLYDFNSYWRVHAGNFSTIPQYFKENGYVTMSVGKVFHPGISSNHTDDSPYSWSFPPYHPSSEKYENTKTCRGPDGELHANLLCPVDVLDVPEGTLPDKQSTEQAIQLLEKMKTSASPFFLAVGYHKPHIPFRYPKEFQKLYPLENITLAPDPEVPDGLPPVAYNPWMDIRQREDVQALNISVPYGPIPVDFQRKIRQSYFASVSYLDTQVGRLLSALDDLQLANSTIIAFTSDHGWALGEHGEWAKYSNFDVATHVPLIFYVPGRTASLPEAGEKLFPYLDPFDSASQLMEPGRQSMDLVELVSLFPTLAGLAGLQVPPRCPVPSFHVELCREGKNLLKHFRFRDLEEDPYLPGNPRELIAYSQYPRPSDIPQWNSDKPSLKDIKIMGYSIRTIDYRYTVWVGFNPDEFLANFSDIHAGELYFVDSDPLQDHNMYNDSQGGDLFQLLMP

SEQ ID NO: 6711 - protein, 343 aa, Homo Sapiens
MPPPRTGRGLLWLGLVLSSVCVALGSETQANSTTDALNVLLIIVDDLRPSLGCYGDKLVRSPNIDQLASHSLLFQNAFAQQAVCAPSRVSFLTGRRPDTTRLYDFNSYWRVHAGNFSTIPQYFKENGYVTMSVGKVFHPGISSNHTDDSPYSWSFPPYHPSSEKYENTKTCRGPDGELHANLLCPVDVLDVPEGTLPDKQSTEQAIQLLEKMKTSASPFFLAVGYHKPHIPFRYPKEFQKLYPLENITLAPDPEVPDGLPPVAYNPWMDIRQREDVQALNISVPYGPIPVDFQRKIRQSYFASVSYLDTQVGRLLSALDDLQLANSTIIAFTSDHGFLMRTNT

SEQ ID NO: 6712 - protein, 312 aa, Homo Sapiens
MPPPRTGRGLLWLGLVLSSVCVALGSETQANSTTDALNVLLIIVDDLRPSLGCYGDKLVRSPNIDQLASHSLLFQNAFAQQAVCAPSRVSFLTGRRPDTTRLYDFNSYWRVHAGNFSTIPQYFKENGYVTMSVGKVFHPGISSNHTDDSPYSWSFPPYHPSSEKYENTKTCRGPDGELHANLLCPVDVLDVPEGTLPDKQSTEQAIQLLEKMKTSASPFFLAVGYHKPHIPFRYPKEFQKLYPLENITLAPDPEVPDGLPPVAYNPWMDIRQREDVQALNISVPYGPIPVDFQEDQSSTGFRLKTSSTRKYK

SEQ ID NO: 6713 - protein, 179 aa, Homo Sapiens
MPPPRTGRGLLWLGLVLSSVCVALGSETQANSTTDALNVLLIIVDDLRPSLGCYGDKLVRSPNIDQLASHSLLFQNAFAQQAVCAPSRVSFLTGRRPDTTRLYDFNSYWRVHAGNFSTIPQYFKENGYVTMSVGKVFHPGTAPCPESGFSWFVVSESSIPILGMGLSLQSPLLAGRVPR

SEQ ID NO: 6714 - protein, 106 aa, Homo Sapiens
RSPNIDQLASHSLLFQNAFAQQAVCAPSRVSFLTGRRPDTTRLYDFNSYWRVHAGNFSTIPQYFKENGYVTMSVGKVFHPALVGTHFSAESLFSRPFSVSIGPASR

SEQ ID NO: 6715 - protein, 232 aa, Homo Sapiens
LAHPGPGIGAGPSPGSAGPSPLPGMDGRWALLDPESIVRGSTGRGLSYNFTHLDGYLDLLRENQLLPGFELMGSASGHFTDFEDKQQVFEWKDLVSSLARRYIGRYGLAHVSKWNFETWNEPDHHDFDNVSMTMQGFLNYYDACSEGLRAASPALRLGGPGDSFHTPPRSPLSWGLLRHCHDGTNFFTGEAGVRLDYISLHRKGARSSISILEQEKVVAQQIRQLFPKFADT

SEQ ID NO: 6716 - protein, 176 aa, Homo Sapiens
MCLPSECHSHWTQVQASLSPAAPCPPPWLPRGSTGRGLSYNFTHLDGYLDLLRENQLLPGFELMGSASGHFTDFEDKQQVFEWKDLVSSLARRYIGRYGLAHVSKWNFETWNEPDHHDFDNVSMTMQGFLNYYDACSEGLRAASPALRLGGPGDSFHTPPRSPLSWGLLRHCHDGT

SEQ ID NO: 6717 - protein, 521 aa, Homo Sapiens
MGSASGHFTDFEDKQQVFEWKDLVSSLARRYIGRYGLAHVSKWNFETWNEPDHHDFDNVSMTMQGFLNYYDACSEGLRAASPALRLGGPGDSFHTPPRSPLSWGLLRHCHDGTNFFTGEAGVRLDYISLHRKGARSSISILEQEKVVAQQIRQLFPKFADTPIYNDEADPLVGWSLPQPWRADVTYAAMVVKVIAQHQNLLLANTTSAFPYALLSNDNAFLSYHPHPFAQRTLTARFQVNNTRPPHVQLLRKPVLTAMGLLALLDEEQLWAEVSQAGTVLDSNHTVGVLASAHRPQGPADAWRAAVLIYASDDTRAHPNRSVAVTLRLRGVPPGPGLVYVTRYLDNGLCSPDGEWRRLGRPVFPTAEQFRRMRAAEDPVAAAPRPLPAGGRLTLRPALRLPSLLLVHVCARPEKPPGQVTRLRALPLTQGQLVLVWSDEHVGSKCLWTYEIQFSQDGKAYTPVSRKPSTFNLFVFSPDTGAVSGSYRVRALDYWARPGPFSDPVPYLEVPVPRGPPSPGNP

SEQ ID NO: 6718 - protein, 653 aa, Homo Sapiens
MRPLRPRAALLALLASLLAAPPVAPAEAPHLVHVDAARALWPLRRFWRSTGFCPPLPHSQADQYVLSWDQQLNLAYVGAVPHRGIKQVRTHWLLELVTTRGSTGRGLSYNFTHLDGYLDLLRENQLLPGFELMGSASGHFTDFEDKQQVFEWKDLVSSLARRYIGRYGLAHVSKWNFETWNEPDHHDFDNVSMTMQGFLNYYDACSEGLRAASPALRLGGPGDSFHTPPRSPLSWGLLRHCHDGTNFFTGEAGVRLDYISLHRKGARSSISILEQEKVVAQQIRQLFPKFADTPIYNDEADPLVGWSLPQPWRADVTYAAMVVKVIAQHQNLLLANTTSAFPYALLSNDNAFLSYHPHPFAQRTLTARFQVNNTRPPHVQLLRKPVLTAMGLLALLDEEQLWAEVSQAGTVLDSNHTVGVLASAHRPQGPADAWRAAVLIYASDDTRAHPNRSVAVTLRLRGVPPGPGLVYVTRYLDNGLCSPDGEWRRLGRPVFPTAEQFRRMRAAEDPVAAAPRPLPAGGRLTLRPALRLPSLLLVHVCARPEKPPGQVTRLRALPLTQGQLVLVWSDEHVGSKCLWTYEIQFSQDGKAYTPVSRKPSTFNLFVFSPDTGAVSGSYRVRALDYWARPGPFSDPVPYLEVPVPRGPPSPGNP

SEQ ID NO: 6719 - protein, 224 aa, Homo Sapiens
MRPLRPRAALLALLASLLAAPPVAPAEAPHLVHVDAARALWPLRRFWRSTGFWGSTGRGLSYNFTHLDGYLDLLRENQLLPGFELMGSASGHFTDFEDKQQVFEWKDLVSSLARRYIGRYGLAHVSKWNFETWNEPDHHDFDNVSMTMQGFLNYYDACSEGLRAASPALRLGGPGDSFHTPPRSPLSWGLLRHCHDGTNFFTGEAGVRLDYISLHRKGARSSIS

SEQ ID NO: 6720 - protein, 196 aa, Homo Sapiens
  misc_feature (1)..(1): Xaa can be any naturally occurring amino acid
XVPCAPAPRCWRSWPRSWPRPRWPRPRPRTWCMWTRPARCGPCGASGGAQASAPRCHTARLTSTSSAGTSSSTSPMWAPSLTAASSRGSTGRGLSYNFTHLDGYLDLLRENQLLPGFELMGSASGHFTDFEDKQQVFEWKDLVSSLARRYIGRYGLAHVSKWNFETWNEPDHHDFDNVSMTMQGFLNYYDACSEGL

SEQ ID NO: 6721 - protein, 105 aa, Homo Sapiens
MGFTGAGIAASSIAAKMMSAAAIANGGGVSAGSLVATLQSVGAAGLSTSSNILLASVGSVLGACLGNSPSSSLPAEPEAKEDEARENVPQGEPPKPPLKSEKHEE

SEQ ID NO: 6722 - protein, 130 aa, Homo Sapiens
MMKRAAAAAVGGALAVGAVPVVLSAMGFTGAGIAASSIAAKMMSAAAIANGGGVSAGSLVATLQSVGAAGLSTSSNILLASVGSVLGACLGNSPSSSLPAEPEAKEDEARENVPQGEPPKPPLKSEKHEE

SEQ ID NO: 6723 - protein, 105 aa, Homo Sapiens
MTLSPLLLFLPPLLLLLDVPTAAVQASPLQALDFFGNGPPVNYKTGNLYLRGPLKKSNAPLVNVTLYYEALCGGCRAFLIRELFPTWLLVMEILNVTLVPYGNAQ

SEQ ID NO: 6724 - protein, 250 aa, Homo Sapiens
MTLSPLLLFLPPLLLLLDVPTAAVQASPLQALDFFGNGPPVNYKTGNLYLRGPLKKSNAPLVNVTLYYEALCGGCRAFLIRELFPTWLLVMEILNVTLVPYGNAQEQNVSGRWEFKCQHGEEECKFNKVEACVLDELDMELAFLTIVCMEEFEDMERSLPLCLQLYAPGLSPDTIMECAMGDRGMQLMHANAQRTDALQPPHEYVPWVTVNGKPLEDQTQLLTLVCQLYQGKKPDVCPSSTSSLRSVCFK

SEQ ID NO: 6725 - protein, 189 aa, Homo Sapiens
MASPFALLMVLVVLSCKSSCSLGCDLPETHSLDNRRTLMLLAQMSRISPSSCLMDRHDFGFPQEEFDGNQFQKAPAISVLHELIQQIFNLFTTKDSSAAWDEDLLDKFCTELYQQLNDLEACVMQEERVGETPLMNADSILAVKKYFRRITLYLTEKKYSPCAWEVVRAEIMRSLSLSTNLQERLRRKE

SEQ ID NO: 6726 - protein, 189 aa, Homo Sapiens
MALSFSLLMAVLVLSYKSICSLGCDLPQTHSLGNRRALILLGQMGRISPFSCLKDRHDFRIPQEEFDGNQFQKAQAISVLHEMIQQTFNLFSTEDSSAAWEQSLLEKFSTELYQQLNDLEACVIQEVGVEETPLMNEDSILAVRKYFQRITLYLIERKYSPCAWEVVRAEIMRSLSFSTNLQKRLRRKD

SEQ ID NO: 6727 - protein, 189 aa, Homo Sapiens
MASPFALLMALVVLSCKSSCSLGCDLPETHSLDNRRTLMLLAQMSRISPSSCLMDRHDFGFPQEEFDGNQFQKAPAISVLHELIQQIFNLFTTKDSSAAWDEDLLDKFCTELYQQLNDLEACVMQEERVGETPLMNADSILAVKKYFRRITLYLTEKKYSPCAWEVVRAEIMRSLSLSTNLQERLRRKE

SEQ ID NO: 6728 - protein, 190 aa, Homo Sapiens
MMASPFALLMALVVLSCKSSCSLGCDLPETHSLDNRRTLMLLAQMSRISPSSCLMDRHDFGFPQEEFDGNQFQKAPAISVLHELIQQIFNLFTTKDSSAAWDEDLLDKFCTELYQQLNDLEACVMQEERVGETPLMNADSILAVKKYFRRITLYLTEKKYSPCAWEVVRAEIMRSLSLSTNLQERLRRKE

SEQ ID NO: 6729 - protein, 189 aa, Homo Sapiens
MALPFALMMALVVLSCKSSCSLGCNLSQTHSLNNRRTLMLMAQMRRISPFSCLKDRHDFEFPQEEFDGNQFQKAQAISVLHEMMQQTFNLFSTKNSSAAWDETLLEKFYIELFQQMNDLEACVIQEVGVEETPLMNEDSILAVKKYFQRITLYLMEKKYSPCAWEVVRAEIMRSLSFSTNLQKRLRRKD

SEQ ID NO: 6730 - protein, 189 aa, Homo Sapiens
MALSFSLLMAVLVLSYKSICSLGCDLPQTHSLGNRRALILLAQMGRISHFSCLKDRYDFGFPQEVFDGNQFQKAQAISAFHEMIQQTFNLFSTKDSSAAWDETLLDKFYIELFQQLNDLEACVTQEVGVEEIALMNEDSILAVRKYFQRITLYLMGKKYSPCAWEVVRAEIMRSFSFSTNLQKGLRRKD

SEQ ID NO: 6731 - protein, 189 aa, Homo Sapiens
MALSFSLLMAVLVLSYKSICSLGCDLPQTHSLGNRRALILLAQMGRISPFSCLKDRHDFGLPQEEFDGNQFQKTQAISVLHEMIQQTFNLFSTEDSSAAWEQSLLEKFSTELYQQLNNLEACVIQEVGMEETPLMNEDSILAVRKYFQRITLYLTEKKYSPCAWEVVRAEIMRSLSFSTNLQKILRRKD

SEQ ID NO: 6732 - protein, 188 aa, Homo Sapiens
MALTFALLVALLVLSCKSSCSVGCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 6733 - protein, 189 aa, Homo Sapiens
MALSFSLLMAVLVLSYKSICSLGCDLPQTHSLGNRRALILLAQMGRISPFSCLKDRHDFGFPQEEFDGNQFQKAQAISVLHEMIQQTFNLFSTKDSSATWEQSLLEKFSTELNQQLNDLEACVIQEVGVEETPLMNVDSILAVKKYFQRITLYLTEKKYSPCAWEVVRAEIMRSFSLSKIFQERLRRKE

SEQ ID NO: 6734 - protein, 189 aa, Homo Sapiens
MALSFSLLMAVLVLSYKSICSLGCDLPQTHSLGNRRALILLAQMGRISHFSCLKDRHDFGFPEEEFDGHQFQKAQAISVLHEMIQQTFNLFSTEDSSAAWEQSLLEKFSTELYQQLNDLEACVIQEVGVEETPLMNEDSILAVRKYFQRITLYLTEKKYSPCAWEVVRAEIMRSLSFSTNLQKRLRRKD

SEQ ID NO: 6735 - protein, 189 aa, Homo Sapiens
MALPFVLLMALVVLNCKSICSLGCDLPQTHSLSNRRTLMIMAQMGRISPFSCLKDRHDFGFPQEEFDGNQFQKAQAISVLHEMIQQTFNLFSTKDSSATWDETLLDKFYTELYQQLNDLEACMMQEVGVEDTPLMNVDSILTVRKYFQRITLYLTEKKYSPCAWEVVRAEIMRSFSLSANLQERLRRKE

SEQ ID NO: 6736 - protein, 189 aa, Homo Sapiens
MALPFALLMALVVLSCKSSCSLDCDLPQTHSLGHRRTMMLLAQMRRISLFSCLKDRHDFRFPQEEFDGNQFQKAEAISVLHEVIQQTFNLFSTKDSSVAWDERLLDKLYTELYQQLNDLEACVMQEVWVGGTPLMNEDSILAVRKYFQRITLYLTEKKYSPCAWEVVRAEIMRSFSSSRNLQERLRRKE

SEQ ID NO: 6737 - protein, 190 aa, Homo Sapiens
TMALPFALLMALVVLSCKSSCSLDCDLPQTHSLGHRRTMMLLAQMRRISLFSCLKDRHDFRFPQEEFDGNQFQKAEAISVLHEVIQQTFNLFSTKDSSVAWDERLLDKLYTELYQQLNDLEACVMQEVWVGGTPLMNEDSILAVRKYFQRITLYLTEKKYSPCAWEVVRAEIMRSFSSSRNLQERLRRKE

SEQ ID NO: 6738 - protein, 189 aa, Homo Sapiens
MARSFSLLMVVLVLSYKSICSLGCDLPQTHSLRNRRALILLAQMGRISPFSCLKDRHEFRFPEEEFDGHQFQKTQAISVLHEMIQQTFNLFSTEDSSAAWEQSLLEKFSTELYQQLNDLEACVIQEVGVEETPLMNEDFILAVRKYFQRITLYLMEKKYSPCAWEVVRAEIMRSFSFSTNLKKGLRRKD

SEQ ID NO: 6739 - protein, 189 aa, Homo Sapiens
MALTFYLLVALVVLSYKSFSSLGCDLPQTHSLGNRRALILLAQMRRISPFSCLKDRHDFEFPQEEFDDKQFQKAQAISVLHEMIQQTFNLFSTKDSSAALDETLLDEFYIELDQQLNDLESCVMQEVGVIESPLMYEDSILAVRKYFQRITLYLTEKKYSSCAWEVVRAEIMRSFSLSINLQKRLKSKE

SEQ ID NO: 6740 - protein, 557 aa, Homo Sapiens
MMVVLLGATTLVLVAVAPWVLSAAAGGKNLKSPQKVEVDIIDDNFILRWNRSDESVGNVTFSFDYQKTGMDNWIKLSGCQNITSTKCNFSSLKLNVYEEIKLRIRAEKENTSSWYEVDSFTPFRKAQIGPPEVHLEAEDKAIVIHISPGTKDSVMWALDGLSFTYSLVIWKNSSGVEERIENIYSRHKIYKLSPETTYCLKVKAALLTSWKIGVYSPVHCIKTTVENELPPPENIEVSVQNQNYVLKWDYTYANMTFQVQWLHAFLKRNPGNHLYKWKQIPDCENVKTTQCVFPQNVFQKGIYLLRVQASDGNNTSFWSEEIKFDTEIQAFLLPPVFNIRSLSDSFHIYIGAPKQSGNTPVIQDYPLIYEIIFWENTSNAERKIIEKKTDVTVPNLKPLTVYCVKARAHTMDEKLNKSSVFSDAVCEKTKPGNTSKIWLIVGICIALFALPFVIYAAKVFLRCINYVFFPSLKPSSSIDEYFSEQPLKNLLLSTSEEQIEKCFIIENISTIATVEETNQTDEDHKKYSSQTSQDSGNYSNEDESESKTSEELQQDFV

SEQ ID NO: 6741 - protein, 136 aa, Homo Sapiens
MMVVLLGATTLVLVAVAPWVLSAAAGGKNLKSPQKVEVDIIDDNFILRWNRSDESVGNVTFSFDYQKTGMDNWIKLSGCQNITSTKCNFSSLKLNVYEEIKLRIRAEKENTSSWYEVDSFTPFRKVENELPPPENI

SEQ ID NO: 6742 - protein, 187 aa, Homo Sapiens
MTNKCLLQIALLLCFSTTALSMSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 6743 - protein, 208 aa, Homo Sapiens
MIIKHFFGTVLVLLASTTIFSLDLKLIIFQQRQVNQESLKLLNKLQTLSIQQCLPHRKNFLLPQKSLSPQQYQKGHTLAILHEMLQQIFSLFRANISLDGWEENHTEKFLIQLHQQLEYLEALMGLEAEKLSGTLGSDNLRLQVKMYFRRIHDYLENQDYSTCAWAIVQVEISRCLFFVFSLTEKLSKQGRPLNDMKQELTTEFRSPR

SEQ ID NO: 6744 - protein, 166 aa, Homo Sapiens
MKYTSYILAFQLCIVLGSLGCYCQDPYVKEAENLKKYFNAGHSDVADNGTLFLGILKNWKEESDRKIMQSQIVSFYFKLFKNFKDDQSIQKSVETIKEDMNVKFFNSNKKKRDDFEKLTNYSVTDLNVQRKAIHELIQVMAELSPAAKTGKRKRSQMLFRGRRASQ

SEQ ID NO: 6745 - protein, 30 aa, Homo Sapiens
LLPLVMQGVSRAEMGTADLGPSSVLSTDVF

SEQ ID NO: 6746 - protein, 210 aa, Homo Sapiens
MALLFLLPLVMQGVSRAEMGTADLGPSSVPTPTNVTIESYNMNPIVYWEYQIMPQVPVFTVEVKNYGVKARVGQKESAYAKSEEFAVCRDGKIGPPKLDIRKEEKQIMIDIFHPSVFVNGDEQEVDYDPETTCYIRVYNVYVRMNGSEIQYKILTQKEDDCDEIQCQLAIPVSSLNSQYCVSAEGVLHVWGVTTEKSKEVCITIFNSSIK

SEQ ID NO: 6747 - protein, 489 aa, Homo Sapiens
MALLFLLPLVMQGVSRAEMGTADLGPSSVPTPTNVTIESYNMNPIVYWEYQIMPQVPVFTVEVKNYGVKNSEWIDACINISHHYCNISDHVGDPSNSLWVRVKARVGQKESAYAKSEEFAVCRDGKIGPPKLDIRKEEKQIMIDIFHPSVFVNGDEQEVDYDPETTCYIRVYNVYVRMNGSEIQYKILTQKEDDCDEIQCQLAIPVSSLNSQYCVSAEGVLHVWGVTTEKSKEVCITIFNSSIKGSLWIPVVAALLLFLVLSLVFICFYIKKINPLKEKSIILPKSLISVVRSATLETKPESKYVSLITSYQPFSLEKEVVCEEPLSPATVPGMHTEDNPGKVEHTEELSSITEVVTTEENIPDVVPGSHLTPIERESSSPLSSNQSEPGSIALNSYHSRNCSESDHSRNGFDTDSSCLESHSSLSDSEFPPNNKGEIKTEGQELITVIKAPTSFGYDKPHVLVDLLVDDSGKESLIGYRPTEDSKEFS

SEQ ID NO: 6748 - protein, 470 aa, Homo Sapiens
MCGSIVQSLVPTPTNVTIESYNMNPIVYWEYQIMPQVPVFTVEVKNYGVKNSEWIDACINISHHYCNISDHVGDPSNSLWVRVKARVGQKESAYAKSEEFAVCRDGKIGPPKLDIRKEEKQIMIDIFHPSVFVNGDEQEVDYDPETTCYIRVYNVYVRMNGSEIQYKILTQKEDDCDEIQCQLAIPVSSLNSQYCVSAEGVLHVWGVTTEKSKEVCITIFNSSIKGSLWIPVVAALLLFLVLSLVFICFYIKKINPLKEKSIILPKSLISVVRSATLETKPESKYVSLITSYQPFSLEKEVVCEEPLSPATVPGMHTEDNPGKVEHTEELSSITEVVTTEENIPDVVPGSHLTPIERESSSPLSSNQSEPGSIALNSYHSRNCSESDHSRNGFDTDSSCLESHSSLSDSEFPPNNKGEIKTEGQELITVIKAPTSFGYDKPHVLVDLLVDDSGKESLIGYRPTEDSKEFS

SEQ ID NO: 6749 - protein, 161 aa, Homo Sapiens
MLLKSPENSLLQFQFKYGVPTPTNVTIESYNMNPIVYWEYQIMPQVPVFTVEVKNYGVKNSEWIDACINISHHYCNISDHVGDPSNSLWVRVKARVGQKESAYAKSEEFAVCRDGKIGPPKLDIRKEEKQIMIDIFHPSVFVNGDEQEVDYDPETTCYIRV

SEQ ID NO: 6750 - protein, 479 aa, Homo Sapiens
MLLKSPENSLLQFQFKYGVPTPTNVTIESYNMNPIVYWEYQIMPQVPVFTVEVKNYGVKNSEWIDACINISHHYCNISDHVGDPSNSLWVRVKARVGQKESAYAKSEEFAVCRDGKIGPPKLDIRKEEKQIMIDIFHPSVFVNGDEQEVDYDPETTCYIRVYNVYVRMNGSEIQYKILTQKEDDCDEIQCQLAIPVSSLNSQYCVSAEGVLHVWGVTTEKSKEVCITIFNSSIKGSLWIPVVAALLLFLVLSLVFICFYIKKINPLKEKSIILPKSLISVVRSATLETKPESKYVSLITSYQPFSLEKEVVCEEPLSPATVPGMHTEDNPGKVEHTEELSSITEVVTTEENIPDVVPGSHLTPIERESSSPLSSNQSEPGSIALNSYHSRNCSESDHSRNGFDTDSSCLESHSSLSDSEFPPNNKGEIKTEGQELITVIKAPTSFGYDKPHVLVDLLVDDSGKESLIGYRPTEDSKEFS

SEQ ID NO: 6751 - protein, 479 aa, Homo Sapiens; identical to SEQ ID NO: 6750

SEQ ID NO: 6752 - protein, 448 aa, Homo Sapiens
MNPIVYWEYQIMPQVPVFTVEVKNYGVKNSEWIDACINISHHYCNISDHVGDPSNSLWVRVKARVGQKESAYAKSEEFAVCRDGKIGPPKLDIRKEEKQIMIDIFHPSVFVNGDEQEVDYDPETTCYIRVYNVYVRMNGSEIQYKILTQKEDDCDEIQCQLAIPVSSLNSQYCVSAEGVLHVWGVTTEKSKEVCITIFNSSIKGSLWIPVVAALLLFLVLSLVFICFYIKKINPLKEKSIILPKSLISVVRSATLETKPESKYVSLITSYQPFSLEKEVVCEEPLSPATVPGMHTEDNPGKVEHTEELSSITEVVTTEENIPDVVPGSHLTPIERESSSPLSSNQSEPGSIALNSYHSRNCSESDHSRNGFDTDSSCLESHSSLSDSEFPPNNKGEIKTEGQELITVIKAPTSFGYDKPHVLVDLLVDDSGKESLIGYRPTEDSKEFS

SEQ ID NO: 6753 - protein, 448 aa, Homo Sapiens; identical to SEQ ID NO: 6752

SEQ ID NO: 6754 - protein, 448 aa, Homo Sapiens; identical to SEQ ID NO: 6752

SEQ ID NO: 6755 - protein, 27 aa, Homo Sapiens
  misc_feature (1)..(1): Xaa can be any naturally occurring amino acid
XLLPLVMQGVSRAEMGTADLGPSSDVF

SEQ ID NO: 6756 - protein, 200 aa, Homo Sapiens
MAAAWTVVLVTLVLGLAVAGPVPTSKPTTTGKGCHIGRFKSLSPQELASFKKARDALEESLKLKNWSCSSPVFPGNWDLRLLQVRERPVALEAELALTLKVLEAAAGPALEDVLDQPLHTLHHILSQLQACIQPQPTAGPRPRGRLHHWLHRLQEAPKKESAGCLEASVTFNLFRLLTRDLKYVADGNLCLRTSTHPEST

SEQ ID NO: 6757 - protein, 200 aa, Homo Sapiens
MKLDMTGDCTPVLVLMAAVLTVTGAVPVARLHGALPDARGCHIAQFKSLSPQELQAFKRAKDALEESLLLKDCRCHSRLFPRTWDLRQLQVRERPMALEAELALTLKVLEATADTDPALVDVLDQPLHTLHHILSQFRACIQPQPTAGPRTRGRLHHWLYRLQEAPKKESPGCLEASVTFNLFRLLTRDLNCVASGDLCV

SEQ ID NO: 6758 - protein, 200 aa, Homo Sapiens
MKLDMTGDCMPVLVLMAAVLTVTGAVPVARLRGALPDARGCHIAQFKSLSPQELQAFKRAKDALEESLLLKDCKCRSRLFPRTWDLRQLQVRERPVALEAELALTLKVLEATADTDPALGDVLDQPLHTLHHILSQLRACIQPQPTAGPRTRGRLHHWLHRLQEAPKKESPGCLEASVTFNLFRLLTRDLNCVASGDLCV

SEQ ID NO: 6759 - protein, 196 aa, Homo Sapiens
MTGDCMPVLVLMAAVLTVTGAVPVARLRGALPDARGCHIAQFKSLSPQELQAFKRAKDALEESLLLKDCKCRSRLFPRTWDLRQLQVRERPVALEAELALTLKVLEATADTDPALGDVLDQPLHTLHHILSQLRACIQPQPTAGPRTRGRLHHWLHRLQEAPKKESPGCLEASVTFNLFRLLTRDLNCVASGDLCV

SEQ ID NO: 6760 - protein, 520 aa, Homo Sapiens
MAGPERWGPLLLCLLQAAPGRPRLAPPQNVTLLSQNFSVYLTWLPGLGNPQDVTYFVAYQSSPTRRRWREVEECAGTKELLCSMMCLKKQDLYNKFKGRVRTVSPSSKSPWVESEYLDYLFEVEPAPPVLVLTQTEEILSANATYQLPPCMPPLDLKYEVAFWKEGAGNKTLFPVTPHGQPVQITLQPAASEHHCLSARTIYTFSVPKYSKFSKPTCFLLEVPEANWAFLVLPSLLILLLVIAAGGVIWKTLMGNPWFQRAKMPRALDFSGHTHPVATFQPSRPESVNDLFLCPQKELTRGVRPTPRVRAPATQQTRWKKDLAEDEEEEDEEDTEDGVSFQPYIEPPSFLGQEHQAPGHSEAGGVDSGRPRAPLVPSEGSSAWDSSDRSWASTVDSSWDRAGSSGYLAEKGPGQGPGGDGHQESLPPPEFSKDSGFLEELPEDNLSSWATWGTLPPEPNLVPGGPPVSLQTLTFCWESSPEEEEEARESEIEDSDAGSWGAESTQRTEDRGRTLGHYMAR

SEQ ID NO: 6761 - protein, 491 aa, Homo Sapiens
MAGPERWGPLLLCLLQAAPGRPRLAPPQNVTLLSQNFSVYLTWLPGLGNPQDVTYFVAYQSSPTRRRWREVEECAGTKELLCSMMCLKKQDLYNKFKGRVRTVSPSSKSPWVESEYLDYLFEVEPAPPVLVLTQTEEILSANATYQLPPCMPPLDLKYEVAFWKEGAGNKTLFPVTPHGQPVQITLQPAASEHHCLSARTIYTFSVPKYSKFSKPTCFLLEVPEANWAFLVLPSLLILLLVIAAGGVIWKTLMGNPWFQRAKMPRALELTRGVRPTPRVRAPATQQTRWKKDLAEDEEEEDEEDTEDGVSFQPYIEPPSFLGQEHQAPGHSEAGGVDSGRPRAPLVPSEGSSAWDSSDRSWASTVDSSWDRAGSSGYLAEKGPGQGPGGDGHQESLPPPEFSKDSGFLEELPEDNLSSWATWGTLPPEPNLVPGGPPVSLQTLTFCWESSPEEEEEARESEIEDSDAGSWGAESTQRTEDRGRTLGHYMAR

SEQ ID NO: 6762 - protein, 244 aa, Homo Sapiens
MAGPERWGPLLLCLLQAAPGRPRLAPPQNVTLLSQNFSVYLTWLPGLGNPQDVTYFVAYQSSPTRRRWREVEECAGTKELLCSMMCLKKQDLYNKFKGRVRTVSPSSKSPWVESEYLDYLFEVEPAPPVLVLTQTEEILSANATYQLPPCMPPLDLKYEVAFWKEGAGNKTLFPVTPHGQPVQITLQPAASEHHCLSARTIYTFSVPKYSKFSKPTCFLLEVPGLFWTHTPCGNLSAQQTRVRE

SEQ ID NO: 6763 - protein, 211 aa, Homo Sapiens
MAGPERWGPLLLCLLQAAPGRPRLAPPQNVTLLSQNFSVYLTWLPGLGNPQDVTYFVAYQSSPTRRRWREVEECAGTKELLCSMMCLKKQDLYNKFKGRVRTVSPSSKSPWVESEYLDYLFEVEPAPPVLVLTQTEEILSANATYQLPPCMPPLDLKYEVAFWKEGAGNKVGSSFPAPRLGPLLHPFLLRFFSPSQPAPAPLLQEVFPVHS

SEQ ID NO: 6764 - protein, 185 aa, Homo Sapiens
MMCLKKQDLYNKFKGRVRTVSPSSKSPWVESEYLDYLFEVEPAPPVLVLTQTEEILSANATYQLPPCMPPLDLKYEVAFWKEGAGNKTLFPVTPHGQPVQITLQPAASEHHCLSARTIYTFSVPKYSKFSKPTCFLLEVPEANWAFLVLPSLLILLLVIAAGGVIWKTLMGNPWFQRAKMPRALV

SEQ ID NO: 6765 - protein, 195 aa, Homo Sapiens
MALLFPLLAALVMTSYSPVGSLGCDLPQNHGLLSRNTLVLLHQMRRISPFLCLKDRRDFRFPQEMVKGSQLQKAHVMSVLHEMLQQIFSLFHTERSSAAWNMTLLDQLHTGLHQQLQHLETCLLQVVGEGESAGAISSPALTLRRYFQGIRVYLKEKKYSDCAWEVVRMEIMKSLFLSTNMQERLRSKDRDLGSS

SEQ ID NO: 6766 - protein, 153 aa, Homo Sapiens
MGKISSLPTQLFKCCFCDFLKVKMHTMSSSHLFYLALCLLTFTSSATAGPETLCGAELVDALQFVCGDRGFYFNKPTGYGSSSRRAPQTGIVDECCFRSCDLRRLEMYCAPLKPAKSARSVRAQRHTDMPKTQKEVHLKNASRGSAGNKNYRM

SEQ ID NO: 6767 - protein, 153 aa, Homo Sapiens; identical to SEQ ID NO: 6766

SEQ ID NO: 6768 - protein, 158 aa, Homo Sapiens
MGKISSLPTQLFKCCFCDFLKVKMHTMSSSHLFYLALCLLTFTSSATAGPETLCGAELVDALQFVCGDRGFYFNKPTGYGSSSRRAPQTGIVDECCFRSCDLRRLEMYCAPLKPAKSARSVRAQRHTDMPKTQKYQPPSTNKNTKSQRRKGSTFEERK

SEQ ID NO: 6769 - protein, 158 aa, Homo Sapiens; identical to SEQ ID NO: 6768

SEQ ID NO: 6770 - protein, 195 aa, Homo Sapiens
MGKISSLPTQLFKCCFCDFLKVKMHTMSSSHLFYLALCLLTFTSSATAGPETLCGAELVDALQFVCGDRGFYFNKPTGYGSSSRRAPQTGIVDECCFRSCDLRRLEMYCAPLKPAKSARSVRAQRHTDMPKTQKYQPPSTNKNTKSQRRKGWPKTHPGGEQKEGTEASLQIRGKKKEQRREIGSRNAECRGKKGK

SEQ ID NO: 6771 - protein, 137 aa, Homo Sapiens
MITPTVKMHTMSSSHLFYLALCLLTFTSSATAGPETLCGAELVDALQFVCGDRGFYFNKPTGYGSSSRRAPQTGIVDECCFRSCDLRRLEMYCAPLKPAKSARSVRAQRHTDMPKTQKEVHLKNASRGSAGNKNYRM

SEQ ID NO: 6772 - protein, 183 aa, Homo Sapiens
MGIPMGKSMLVLLTFLAFASCCIAAYRPSETLCGGELVDTLQFVCGDRGFYFRLPGRPASRVSRRSRGIVEECCFRSCDLALLETYCATPAKSERDVSTPPTVLPDNFPRYPVGKFFQYDTWKQSTQRLRRGLPALLRARRGHVLAKELEAFREAKRHRPLIALPTQDPAHGGAPPEMASNRK

SEQ ID NO: 6773 - protein, 183 aa, Homo Sapiens; identical to SEQ ID NO: 6772

SEQ ID NO: 6774 - protein, 180 aa, Homo Sapiens
MGIPMGKSMLVLLTFLAFASCCIAAYRPSETLCGGELVDTLQFVCGDRGFYFSRPASRVSRRSRGIVEECCFRSCDLALLETYCATPAKSERDVSTPPTVLPDNFPRYPVGKFFQYDTWKQSTQRLRRGLPALLRARRGHVLAKELEAFREAKRHRPLIALPTQDPAHGGAPPEMASNRK

SEQ ID NO: 6775 - protein, 180 aa, Homo Sapiens; identical to SEQ ID NO: 6774

SEQ ID NO: 6776 - protein, 180 aa, Homo Sapiens; identical to SEQ ID NO: 6774

SEQ ID NO: 6777 - protein, 180 aa, Homo Sapiens; identical to SEQ ID NO: 6774

SEQ ID NO: 6778 - protein, 180 aa, Homo Sapiens; identical to SEQ ID NO: 6774

SEQ ID NO: 6779 - protein, 236 aa, Homo Sapiens
MVSPDPQIIVVAPETELASMQVQRTEDGVTIIQIFWVGRKGELLRRTPVSSAMQTPMGIPMGKSMLVLLTFLAFASCCIAAYRPSETLCGGELVDTLQFVCGDRGFYFSRPASRVSRRSRGIVEECCFRSCDLALLETYCATPAKSERDVSTPPTVLPDNFPRYPVGKFFQYDTWKQSTQRLRRGLPALLRARRGHVLAKELEAFREAKRHRPLIALPTQDPAHGGAPPEMASNRK

SEQ ID NO: 6780 - protein, 643 aa, Homo Sapiens
MALRKAGDLEPQFTPERRFRLCWYQAHSGRALLGPPPQASPPAGGLALALLLLSWVALGPRSLEGADPGTPGEAEGPACPAACVCSYDDDADELSVFCSSRNLTRLPDGVPGGTQALWLDGNNLSSVPPAAFQNLSSLGFLNLQGGQLGSLEPQALLGLENLCHLHLERNQLRSLALGTFAHTPALASLGLSNNRLSRLEDGLFEGLGSLWDLNLGWNSLAVLPDAAFRGLGSLRELVLAGNRLAYLQPALFSGLAELRELDLSRNALRAIKANVFVQLPRLQKLYLDRNLIAAVAPGAFLGLKALRWLDLSHNRVAGLLEDTFPGLLGLRVLRLSHNAIASLRPRTFKDLHFLEELQLGHNRIRQLAERSFEGLGQLEVLTLDHNQLQEVKAGAFLGLTNVAVMNLSGNCLRNLPEQVFRGLGKLHSLHLEGSCLGRIRPHTFTGLSGLRRLFLKDNGLVGIEEQSLWGLAELLELDLTSNQLTHLPHRLFQGLGKLEYLLLSRNRLAELPADALGPLQRAFWLDVSHNRLEALPNSLLAPLGRLRYLSLRNNSLRTFTPQPPGLERLWLEGNPWDCGCPLKALRDFALQNPSAVPRFVQAICEGDDCQPPAYTYNNITCASPPEVVGLDLRDLSEAHFAPC

SEQ ID NO: 6781 - protein, 605 aa, Homo Sapiens
MALRKGGLALALLLLSWVALGPRSLEGADPGTPGEAEGPACPAACVCSYDDDADELSVFCSSRNLTRLPDGVPGGTQALWLDGNNLSSVPPAAFQNLSSLGFLNLQGGQLGSLEPQALLGLENLCHLHLERNQLRSLALGTFAHTPALASLGLSNNRLSRLEDGLFEGLGSLWDLNLGWNSLAVLPDAAFRGLGSLRELVLAGNRLAYLQPALFSGLAELRELDLSRNALRAIKANVFVQLPRLQKLYLDRNLIAAVAPGAFLGLKALRWLDLSHNRVAGLLEDTFPGLLGLRVLRLSHNAIASLRPRTFKDLHFLEELQLGHNRIRQLAERSFEGLGQLEVLTLDHNQLQEVKAGAFLGLTNVAVMNLSGNCLRNLPEQVFRGLGKLHSLHLEGSCLGRIRPHTFTGLSGLRRLFLKDNGLVGIEEQSLWGLAELLELDLTSNQLTHLPHRLFQGLGKLEYLLLSRNRLAELPADALGPLQRAFWLDVSHNRLEALPNSLLAPLGRLRYLSLRNNSLRTFTPQPPGLERLWLEGNPWDCGCPLKALRDFALQNPSAVPRFVQAICEGDDCQPPAYTYNNITCASPPEVVGLDLRDLSEAHFAPC

SEQ ID NO: 6782 - protein, 131 aa, Homo Sapiens
MTVGRRLPTALHGACQEAWPWRCCCCPGWHWAPAAWREQTPERRGKPRAQRARPPVSAATMTTRMSSASSAAPGTSRACLMESRAAPKPCGWTATTSRPSPRQPSRTSPAWASSTCRAASWAAWSHRRCWA

SEQ ID NO: 6783 - protein, 216 aa, Homo Sapiens
MSEVPVARVWLVLLLLTVQVGVTAGAPWQCAPCSAEKLALCPPVSASCSEVTRSAGCGCCPMCALPLGAACGVATARCARGLSCRALPGEQQPLHALTRGQGACVQESDASAPHAAEAGSPESPESTEITEEELLDNFHLMAPSEEDHSILWDAISTYDGSKALHVTNIKKWKCETSMDGEAGLCWCVYPWNGKRIPGSPEIRGDPNCQIYFNVQN

SEQ ID NO: 6784 - protein, 259 aa, Homo Sapiens
MSEVPVARVWLVLLLLTVQVGVTAGAPWQCAPCSAEKLALCPPVSASCSEVTRSAGCGCCPMCALPLGAACGVATARCARGLSCRALPGEQQPLHALTRGQGACVQESDASAPHAAEAGSPESPESTEITEEELLDNFHLMAPSEEDHSILWDAISTYDGSKALHVTNIKKWKEPCRIELYRVVESLAKAQETSGEEISKFYLPNCNKNGFYHSRQCETSMDGEAGLCWCVYPWNGKRIPGSPEIRGDPNCQIYFNVQN

SEQ ID NO: 6785 - protein, 257 aa, Homo Sapiens
MSEVPVARVWLVLLLLTVQVGVTAGAPWQCAPCSAEKLALCPPVSASCSEVTRSAGCGCCPMCALPLGAACGVATARCARGLSCRALPGEQQPLHALTRGQGACVQESDASAPHAAEAGSPESPESTEITEEELLDNFHLMAPSEEDHSILWDAISTYDGSKALHVTNIKKWKEPCRIELYRVVESLAKAQETSGEEISKFYLPNCNKNGFYHSRQTSMDGEAGLCWCVYPWNGKRIPGSPEIRGDPNCQIYFNVQN

SEQ ID NO: 6786 - protein, 98 aa, Homo Sapiens
KHHLGLEEPKKLRPPPARQLLAELASGACFVGLLSSLRASPAVCACRLPANRNWTRSWSGSPPCAFRMSGALWSTSTPCTSPTVTSMACTTSNSARCL

SEQ ID NO: 6787 - protein, 325 aa, Homo Sapiens
MLPRVGCPALPLPPPPLLPLLLLLLGASGGGGGARAEVLFRCPPCTPERLAACGPPPVAPPAAVAAVAGGARMPCAELVREPGCGCCSVCARLEGEACGVYTPRCGQGLRCYPHPGSELPLQALVMGEGTCEKRRDAEYGASPEQVADNGDDHSEGGLVENHVDSTMNMLGGGGSAGRKPLKSGMKELAVFREKVTEQHRQMGKGGKHHLGLEEPKKLRPPPARTPCQQELDQVLERISTMRLPDERGPLEHLYSLHIPNCDKHGLYNLKQCKMSLNGQRGECWCVNPNTGKLIQGAPTIRGDPECHLFYNEQQEARGVHTQRMQ

SEQ ID NO: 6788 - protein, 78 aa, Homo Sapiens
MNMLGGGGSAGRKPLKSGMKELAVFREKVTEQHRQMGKGGKHHLGLEEPKKLRPPPARTPCQQELDQVLERISTMRLP

SEQ ID NO: 6789 - protein, 181 aa, Homo Sapiens
MPCNNGDDHSEGGLVENHVDSTMNMLGGGGSAGRKPLKSGMKELAVFREKVTEQHRQMGKGGKHHLGLEEPKKLRPPPARTPCQQELDQVLERISTMRLPDERGPLEHLYSLHIPNCDKHGLYNLKQCKMSLNGQRGECWCVNPNTGKLIQGAPTIRGDPECHLFYNEQQEARGVHTQRMQ

SEQ ID NO: 6790 - protein, 194 aa, Homo Sapiens
MQRARPLQALLDGRGLCVNASAVSRLRAYLLPAPPAPGNASESEEDRSAGSVESPSVSSTHRVSDPKFHPLHSKIIIIKKGHAKDSQRYKVDYESQSTDTQNFSSESKRETEYGPCRREMEDTLNHLKFLNVLSPRGVHIPNCDKKGFYKKKQCRPSKGRKRGFCWCVDKYGQPLPGYTTKGKEDVHCYSMQSK

SEQ ID NO: 6791 - protein, 297 aa, Homo Sapiens
MQRARPTLWAAALTLLVLLRGPPVARAGASSAGLGPVVRCEPCDARALAQCAPPPAVCAELVREPGCGCCLTCALSEGQPCGIYTERCGSGLRCQPSPDEARPLQALLDGRGLCVNASAVSRLRAYLLPAPPAPGEPPAPGNASESEEDRSAGSVESPSVSSTHRVSDPKFHPLHSKIIIIKKGHAKDSQRYKVDYESQSTDTQNFSSESKRETEYGPCRREMEDTLNHLKFLNVLSPRGVHIPNCDKKGFYKKKQCRPSKGRKRGFCWCVDKYGQPLPGYTTKGKEDVHCYSMQSK

SEQ ID NO: 6792 - protein, 291 aa, Homo Sapiens
MQRARPTLWAAALTLLVLLRGPPVARAGASSAGLGPVVRCEPCDARALAQCAPPPAVCAELVREPGCGCCLTCALSEGQPCGIYTERCGSGLRCQPSPDEARPLQALLDGRGLCVNASAVSRLRAYLLPAPPAPGNASESEEDRSAGSVESPSVSSTHRVSDPKFHPLHSKIIIIKKGHAKDSQRYKVDYESQSTDTQNFSSESKRETEYGPCRREMEDTLNHLKFLNVLSPRGVHIPNCDKKGFYKKKQCRPSKGRKRGFCWCVDKYGQPLPGYTTKGKEDVHCYSMQSK

SEQ ID NO: 6793 - protein, 270 aa, Homo Sapiens
MQRARPTLWAAALTLLVRCEPCDARALAQCAPPPAVCAELVREPGCGCCLTCALSEGQPCGIYTERCGSGLRCQPSPDEARPLQALLDGRGLCVNASAVSRLRAYLLPAPPAPGNASESEEDRSAGSVESPSVSSTHRVSDPKFHPLHSKIIIIKKGHAKDSQRYKVDYESQSTDTQNFSSESKRETEYGPCRREMEDTLNHLKFLNVLSPRGVHIPNCDKKGFYKKKQCRPSKGRKRGFCWCVDKYGQPLPGYTTKGKEDVHCYSMQSK

SEQ ID NO: 6794 - protein, 263 aa, Homo Sapiens
MQRARPTLWAACEPCDARALAQCAPPPAVCAELVREPGCGCCLTCALSEGQPCGIYTERCGSGLRCQPSPDEARPLQALLDGRGLCVNASAVSRLRAYLLPAPPAPGNASESEEDRSAGSVESPSVSSTHRVSDPKFHPLHSKIIIIKKGHAKDSQRYKVDYESQSTDTQNFSSESKRETEYGPCRREMEDTLNHLKFLNVLSPRGVHIPNCDKKGFYKKKQCRPSKGRKRGFCWCVDKYGQPLPGYTTKGKEDVHCYSMQSK

SEQ ID NO: 6795 - protein, 132 aa, Homo Sapiens
MRSAVCQFPRHRLAAGRPHPESGRGNASESEEDRSAGSVESPSVSSTHRVSDPKFHPLHSKIIIIKKGHAKDSQRYKVDYESQSTDTQNFSSESKRETEYGPCRREMEDTLNHLKFLNVLSPRGVHIPNCDK

SEQ ID NO: 6796 - protein, 143 aa, Homo Sapiens
  misc_feature (1)..(1): Xaa can be any naturally occurring amino acid
XESPSVSSTHRVSDPKFHPLHSKIIIIKKGHAKDSQRYKVDYESQSTDTQNFSSESKRETEYGPCRREMEDTLNHLKFLNVLSPRGVHIPNCDKKGFYKKKQCRPSKGRKRGFCWCVDKYGQPLPGYTTKGKEDVHCYSMQSK

SEQ ID NO: 6797 - protein, 153 aa, Homo Sapiens
  misc_feature (1)..(1): Xaa can be any naturally occurring amino acid
XSEEDRSAGSVESPSVSSTHRVSDPKFHPLHSKIIIIKKGHAKDSQRYKVDYESQSTDTQNFSSESKRETEYGPCRREMEDTLNHLKFLNVLSPRGVHIPNCDKKGFYKKKQCRPSKGRKRGFCWCVDKYGQPLPGYTTKGKEDVHCYSMQSK

SEQ ID NO: 6798 - protein, 258 aa, Homo Sapiens
MLPLCLVAALLLAAGPGPSLGDEAIHCPPCSEEKLARCRPPVGCEELVREPGCGCCATCALGLGMPCGVYTPRCGSGLRCYPPRGVEKPLHTLMHGQGVCMELAEIEAIQESLQPSDKDEGDHPNNSFSPCSAHDRRCLQKHFAKIRDRSTSGGKMKVNGAPREDARPVPQGSCQSELHRALERLAASQSRTHEDLYIIPIPNCDRNGNFHPKQCHPALDGQRGKCWCVDRKTGVKLPGGLEPKGELDCHQLADSFRE

SEQ ID NO: 6799 - protein, 272 aa, Homo Sapiens
MVLLTAVLLLLAAYAGPAQSLGSFVHCEPCDEKALSMCPPSPLGCELVKEPGCGCCMTCALAEGQSCGVYTERCAQGLRCLPRQDEEKPLHALLHGRGVCLNEKSYREQVKIERDSREHEEPTTSEMAEETYSPKIFRPKHTRISELKAEAVKKDRRKKLTQSKFVGGAENTAHPRIISAPEMRQESEQGPCRRHMEASLQELKASPRMVPRAVYLPNCDRKGFYKRKQCKPSRGRKRGICWCVDKYGMKLPGMEYVDGDFQCHTFDSSNVE

SEQ ID NO: 6800 - protein, 233 aa, Homo Sapiens
MVLLTAVLLLLAAYAGPAQSLGSFVHCEPCDEKALSMCPPSPLGCELVKEPGCGCCMTCALAEGQSCGVYTERCAQGLRCLPRQDEEKPLHALLHGRGVCLNEKSYREQVKIGCAPGGQRHICFSLYYSPHPKLPSPGLWPCAPWPTGADPPAPSPAERDSREHEEPTTSEMAEETYSPKIFRPKHTRISELKAEAVKKDRRKKLTQSKFVGGAENTAHPRIISAPEMRQESE

SEQ ID NO: 6801 - protein, 238 aa, Homo Sapiens
MTPHRLLPPLLLLLALLLAASPGGALARCPGCGQGVQAGCPGGCVEEEDGGSPAEGCAEAEGCLRREGQECGVYTPNCAPGLQCHPPKDDEAPLRALLLGRGRCLPARAPAEENPKESKPQAGTARPQDVNRRDQQRNPGTSTTPSQPNSAGVQDTEMGPCRRHLDSVLQQLQTEVYRGAQTLYVPNCDHRGFYRKRQCRSSQGQRRGPCWCVDRMGKSLPGSPDGNGSSSCPTGSSG

SEQ ID NO: 6802 - protein, 240 aa, Homo Sapiens
MTPHRLLPPLLLLLALLLAASPGGALARCPGCGQGVQAGCPGGCVEEEDGGSPAEGCAEAEGCLRREGQECGVYTPNCAPGLQCHPPKDDEAPLRALLLGRGRCLPARAPAVAEENPKESKPQAGTARPQDVNRRDQQRNPGTSTTPSQPNSAGVQDTEMGPCRRHLDSVLQQLQTEVYRGAQTLYVPNCDHRGFYRKRQCRSSQGQRRGPCWCVDRMGKSLPGSPDGNGSSSCPTGSSG

SEQ ID NO: 6803 - protein, 136 aa, Homo Sapiens
MTPHRLLPPLLLLLALLLAASPGGALARCPGCGQGVQAGCPGGCVEEEDGGSPAEGCAEAEGCLRREGQECGVYTPNCAPGLQCHPPKDDEAPLRALLLGRGRCLPARAPAVLSSPRTLRKLSPEPGATCSCRGES

SEQ ID NO: 6804 - protein, 282 aa, Homo Sapiens
MERPSLRALLLGAAGLLLLLLPLSSSSSSDTCGPCEPASCPPLPPLGCLLGETRDACGCCPMCARGEGEPCGGGGAGRGYCAPGMECVKSRKRRKGKAGAAAGGPGVSGVCVCKSRYPVCGSDGTTYPSGCQLRAASQRAESRGEKAITQVSKGTCEQGPSIVTPPKDIWNVTGAQVYLSCEVIGIPTPVLIWNKVKRGHYGVQRTELLPGDRDNLAIQTRGGPEKHEVTGWVLVSPLSKEDAGEYECHASNSQGQASASAKITVVDALHEIPVKKGEGAEL

SEQ ID NO: 6805 - protein, 279 aa, Homo Sapiens
MERPSLRALLLGAAGLLLLLLPLSSSSSSDTCGPCEPASCPPLPPLGCLLGETRDACGCCPMCARGEGEPCGGGGAGRGYCAPGMECVKSRKRRKGKAGAAAGGPGVSGVCVCKSRYPVCGSDGTTYPSGCQLRAASQRAESRGEKAITQVSKGTCEQGPSIVTPPKDIWNVTGAQVYLSCEVIGIPTPVLIWNKVKRGHYGVQRTELLPGDRDNLAIQTRGGPEKHEVTGWVLVSPLSKEDAGEYECHASNSQGQASASAKITVVDALHEIPVKKGTQ

SEQ ID NO: 6806 - protein, 278 aa, Homo Sapiens
MPRLSLLLPLLLLLLLPLLPPLSPSLGIRDVGGRRPKCGPCRPEGCPAPAPCPAPGISALDECGCCARCLGAEGASCGGRAGGRCGPGLVCASQAAGAAPEGTGLCVCAQRGTVCGSDGRSYPSVCALRLRARHTPRAHPGHLHKARDGPCEFAPVVVVPPRSVHNVTGAQVGLSCEVRAVPTPVITWRKVTKSPEGTQALEELPGDHVNIAVQVRGGPSDHEATAWILINPLRKEDEGVYQCHAANMVGEAESHSTVTVLDLSKYRSFHFPAPDDRM

SEQ ID NO: 6807 - protein, 110 aa, Homo Sapiens
MAPRGCIVAVFAIFCISRLLCSHGAPVAPMTPYLMLCQPHKRCGDKFYDPLQHCCYDDAVVPLARTQTCGNCTFRVCFEQCCPWTFMVKLINQNCDSARTSDDRLCRSVS

SEQ ID NO: 6808 - protein, 130 aa, Homo Sapiens
MRFSVSGMRTDYPRSVLAPAYVSVCLLLLCPREVIAPAGSEPWLCQPAPRCGDKIYNPLEQCCYNDAIVSLSETRQCGPPCTFWPCFELCCLDSFGLTNDFVVKLKVQGVNSQCHSSPISSKCESRRRFP

SEQ ID NO: 6809 - protein, 119 aa, Homo Sapiens
MVPRIFAPAYVSVCLLLLCPREVIAPAGSEPWLCQPAPRCGDKIYNPLEQCCYNDAIVSLSETRQCGPPCTFWPCFELCCLDSFGLTNDFVVKLKVQGVNSQCHSSPISSKCESRRRFP

SEQ ID NO: 6810 - protein, 84 aa, Homo Sapiens
QPAPRCGDKIYNPLEQCCYNDAIVSLSETRQCGPPCTFWPCFELCCLDSFGLTNDFVVKLKVQGVNSQCHSSPISSKCERRRFP

SEQ ID NO: 6811 - protein, 125 aa, Homo Sapiens
MRPRCCILALVCWITVFLLQCSKGTTDAPVGSGLWLCQPTPRCGNKIYNPSEQCCYDDAILSLKETRRCGSTCTFWPCFELCCPESFGPQQKFLVKLRVLGMKSQCHLSPISRSCTRNRRHVLYP

SEQ ID NO: 6812 - protein, 16 aa, Homo Sapiens
MGPGRCLLTALLLLAL

SEQ ID NO: 6813 - protein, 132 aa, Homo Sapiens
MGPGRCLLTALLLLALAPPPEASQYCGRLEYWNPDNKCCSSCLQRFGPPPCPDYEFRENCGLNDHGDFVTPPFRKCSSGQCNPDGAELCSPCGGGAVTPTPAAGGGRTPWRCREAGPCQGALPPHTWKPRRP

SEQ ID NO: 6814 - protein, 138 aa, Homo Sapiens
MGPGRCLLTALLLLALAPPPEASQYCGRLEYWNPDNKCCSSCLQRFGPPPCPDYEFRENCGLNDHGDFVTPPFRKCSSGQCNPDGAELCSPCGGGAVTPTPAAGGGRTPWRCRERPVPAKGHCPLTPGNPGAPSSQER

SEQ ID NO: 6815 - protein, 355 aa, Homo Sapiens
MGPGRCLLTALLLLALAPPPEASQYCGRLEYWNPDNKCCSSCLQRFGPPPCPDYEFRENCGLNDHGDFVTPPFRKCSSGQCNPDGAELCSPCGGGAVTPTPAAGGGRTPWRCRERPVPAKGHCPLTPGNPGAPSSQERSSPASSIAWRTPEPVPQQAWPNFLPLVVLVLLLTLAVIAILLFILLWHLCWPKEKADPYPYPGLVCGVPNTHTPSSSHLSSPGALETGDTWKEASLLPLLSRELSSLASQPLSRLLDELEVLEELIVLLDPEPGPGGGMAHGTTRHLAARYGLPAAWSTFAYSLRPSRSPLRALIEMVVAREPSASLGQLGTHLAQLGRADALRVLSKLGSSGVCWA

SEQ ID NO: 6816 - protein, 355 aa, Homo Sapiens; identical to SEQ ID NO: 6815

SEQ ID NO: 6817 - protein, 167 aa, Homo Sapiens
MGPGRCLLTALLLLALAPPPEASQYCGRLEYWNPDNKCCSSCLQRFGPPPCPELSSLASQPLSRLLDELEVLEELIVLLDPEPGPGGGMAHGTTRHLAARYGLPAAWSTFAYSLRPSRSPLRALIEMVVAREPSASLGQLGTHLAQLGRADALRVLSKLGSSGVCWA

SEQ ID NO: 6818 - protein, 187 aa, Homo Sapiens
MGPGRCLLTALLLLALAPPPEASQYCGRLEYWNPDNKCCSSCLQRFGPPPCPGALETGDTWKEASLLPLLSRELSSLASQPLSRLLDELEVLEELIVLLDPEPGPGGGMAHGTTRHLAARYGLPAAWSTFAYSLRPSRSPLRALIEMVVAREPSASLGQLGTHLAQLGRADALRVLSKLGSSGVCWA

SEQ ID NO: 6819 - protein, 60 aa, Homo Sapiens
  misc_feature (1)..(1): Xaa can be any naturally occurring amino acid
XGRLEYWNPDNKCCSSCLQRFGPPPCPGENPRPSLAWAELAEAGPCQGALPPHTWKPRRP

SEQ ID NO: 6820 - protein, 74 aa, Homo Sapiens
  misc_feature (1)..(1): Xaa can be any naturally occurring amino acid
XNCGLNDHGDFVTPPFRKCSSGQCNPDGAELCSPCGGGAVTPTPAAGGGRTPWRCREAPWRQGTHGRRPHYFHS

SEQ ID NO: 6821 - protein, 53 aa, Homo Sapiens
MCSYYHMKKRSVSGCNITIFAVMFSHLSAGKSPCGNQANVLCISRLEFVQYQS

SEQ ID NO: 6822 - protein, 336 aa, Homo Sapiens
MPPPAPGARLRLLAAAALAGLAVISRGLLSQSLEFNSPADNYTVCEGDNATLSCFIDEHVTRVAWLNRSNILYAGNDRWTSDPRVRLLINTPEEFSILITEVGLGDEGLYTCSFQTRHQPYTTQVYLIVHVPARIVNISSPVTVNEGGNVNLLCLAVGRPEPTVTWRQLRDGFTSEGEILEISDIQRGQAGEYECVTHNGVNSAPDSRRVLVTVNYPPTITDVTSARTALGRAALLRCEAMAVPPADFQWYKDDRLLSSGTAEGLKVQTERTRSMLLFANVSARHYGNYTCRAANRLGASSASMRLLRPGSLENSAPRPPGLLALLSALGWLWWRM

SEQ ID NO: 6823 - protein, 1327 aa, Homo Sapiens
MTLDRPGEGATMLKTFTVLLFCILMDPQPELWIESNYPQAPWENITLWCRSPSRISSKFLLLKDKTQMTWIRPSHKTFQVSFLIGALTESNAGLYRCCYWKETGWSKPSKVLELEAPGQLPKPIFWIQAETPALPGCNVNILCHGWLQDLVFMLFKEGYAEPVDYQVPTGTMAIFSIDNLTPEDEGVYICRTHIQMLPTLWSEPSNPLKLVVAGLYPKPTLTAHPGPIMAPGESLNLRCQGPIYGMTFALMRVEDLEKSFYHKKTIKNEANFFFQSLKIQDTGHYLCFYYDASYRGSLLSDVLKIWVTDTFPKTWLLARPSAVVQMGQNVSLRCRGPVDGVGLALYKKGEDKPLQFLDATSIDDNTSFFLNNVTYSDTGIYSCHYLLTWKTSIRMPSHNTVELMVVDKPPKPSLSAWPSTVFKLGKAITLQCRVSHPVLEFSLEWEERETFQKFSVNGDFIISNVDGKGTGTYSCSYRVETHPNIWSHRSEPLKLMGPAGYLTWNYVLNEAIRLSLIMQLVALLLVVLWIRWKCRRLRIREAWLLGTAQGVTMLFIVTALLCCGLCNGVLIEETEIVMPTPKPELWAETNFPLAPWKNLTLWCRSPSGSTKEFVLLKDGTGWIATRPASEQVRAAFPLGALTQSHTGSYHCHSWEEMAVSEPSEALELVGTDILPKPVISASPTIRGQELQLRCKGWLAGMGFALYKEGEQEPVQQLGAVGREAFFTIQRMEDKDEGNYSCRTHTEKRPFKWSEPSEPLELVIKEMYPKPFFKTWASPVVTPGARVTFNCSTPHQHMSFILYKDGSEIASSDRSWASPGASAAHFLIISVGIGDGGNYSCRYYDFSIWSEPSDPVELVVTEFYPKPTLLAQPGPVVFPGKSVILRCQGTFQGMRFALLQEGAHVPLQFRSVSGNSADFLLHTVGAEDSGNYSCIYYETTMSNRGSYLSMPLMIWVTDTFPKPWLFAEPSSVVPMGQNVTLWCRGPVHGVGYILHKEGEATSMQLWGSTSNDGAFPITNISGTSMGRYSCCYHPDWTSSIKIQPSNTLELLVTGLLPKPSLLAQPGPMVAPGENMTLQCQGELPDSTFVLLKEGAQEPLEQQRPSGYRADFWMPAVRGEDSGIYSCVYYLDSTPFAASNHSDSLEIWVTDKPPKPSLSAWPSTMFKLGKDITLQCRGPLPGVEFVLEHDGEEAPQQFSEDGDFVINNVEGKGIGNYSCSYRLQAYPDIWSEPSDPLELVGAAGPVAQECTVGNIVRSSLIVVVVVALGVVLAIEWKKWPRLRTRGSETDGRDQTIALEECNQEGEPGTPANSPSSTSQRISVELPVPI

SEQ ID NO: 6824 - protein, 1327 aa, Homo Sapiens; identical to SEQ ID NO: 6823

SEQ ID NO: 6825 - protein, 242 aa, Homo Sapiens
MTLDRPGEGATMLKTFTVLLFCIRMSLGMTSIVMDPQPELWIESNYPQAPWENITLWCRSPSRISSKFLLLKDKTQMTWIRPSHKTFQVSFLIGALTESNAGLYRCCYWKETGWSKPSKVLELEAPGQLPKPIFWIQAETPALPGCNVNILCHGWLQDLVFMLFKEGYAEPVDYQVPTGTMAIFSIDNLTPEDEGVYICRTHIQMLPTLWSEPSNPLKLVVAGGCGYGCWHLAIVVPGIMAG

SEQ ID NO: 6826 - protein, 242 aa, Homo Sapiens; identical to SEQ ID NO: 6825

SEQ ID NO: 6827 - protein, 1341 aa, Homo Sapiens
MTLDRPGEGATMLKTFTVLLFCIRMSLGMTSIVMDPQPELWIESNYPQAPWENITLWCRSPSRISSKFLLLKDKTQMTWIRPSHKTFQVSFLIGALTESNAGLYRCCYWKETGWSKPSKVLELEAPGQLPKPIFWIQAETPALPGCNVNILCHGWLQDLVFMLFKEGYAEPVDYQVPTGTMAIFSIDNLTPEDEGVYICRTHIQMLPTLWSEPSNPLKLVVAGLYPKPTLTAHPGPIMAPGESLNLRCQGPIYGMTFALMRVEDLEKSFYHKKTIKNEANFFFQSLKIQDTGHYLCFYYDASYRGSLLSDVLKIWVTDTFPKTWLLARPSAVVQMGQNVSLRCRGPVDGVGLALYKKGEDKPLQFLDATSIDDNTSFFLNNVTYSDTGIYSCHYLLTWKTSIRMPSHNTVELMVVDKPPKPSLSAWPSTVFKLGKAITLQCRVSHPVLEFSLEWEERETFQKFSVNGDFIISNVDGKGTGTYSCSYRVETHPNIWSHRSEPLKLMGPAGYLTWNYVLNEAIRLSLIMQLVALLLVVLWIRWKCRRLRIREAWLLGTAQGVTMLFIVTALLCCAISFAGLCNGVLIEETEIVMPTPKPELWAETNFPLAPWKNLTLWCRSPSGSTKEFVLLKDGTGWIATRPASEQVRAAFPLGALTQSHTGSYHCHSWEEMAVSEPSEALELVGTDILPKPVISASPTIRGQELQLRCKGWLAGMGFALYKEGEQEPVQQLGAVGREAFFTIQRMEDKDEGNYSCRTHTEKRPFKWSEPSEPLELVIKEMYPKPFFKTWASPVVTPGARVTFNCSTPHQHMSFILYKDGSEIASSDRSWASPGASAAHFLIISVGIGDGGNYSCRYYDFSIWSEPSDPVELVVTEFYPKPTLLAQPGPVVFPGKSVILRCQGTFQGMRFALLQEGAHVPLQFRSVSGNSADFLLHTVGAEDSGNYSCIYYETTMSNRGSYLSMPLMIWVTDTFPKPWLFAEPSSVVPMGQNVTLWCRGPVHGVGYILHKEGEATSMQLWGSTSNDGAFPITNISGTSMGRYSCCYHPDWTSSIKIQPSNTLELLVTGLLPKPSLLAQPGPMVAPGENMTLQCQGELPDSTFVLLKEGAQEPLEQQRPSGYRADFWMPAVRGEDSGIYSCVYYLDSTPFAASNHSDSLEIWVTDKPPKPSLSAWPSTMFKLGKDITLQCRGPLPGVEFVLEHDGEEAPQQFSEDGDFVINNVEGKGIGNYSCSYRLQAYPDIWSEPSDPLELVGAAGPVAQECTVGNIVRSSLIVVVVVALGVVLAIEWKKWPRLRTRGSETDGRDQTIALEECNQEGEPGTPANSPSSTSQRISVELPVPI

SEQ ID NO: 6828 - protein, 1336 aa, Homo Sapiens
MTLDRPGEGATMLKTFTVLLFCIRMSLGMTSIVMDPQPELWIESNYPQAPWENITLWCRSPSRISSKFLLLKDKTQMTWIRPSHKTFQVSFLIGALTESNAGLYRCCYWKETGWSKPSKVLELEAPGQLPKPIFWIQAETPALPGCNVNILCHGWLQDLVFMLFKEGYAEPVDYQVPTGTMAIFSIDNLTPEDEGVYICRTHIQMLPTLWSEPSNPLKLVVAGLYPKPTLTAHPGPIMAPGESLNLRCQGPIYGMTFALMRVEDLEKSFYHKKTIKNEANFFFQSLKIQDTGHYLCFYYDASYRGSLLSDVLKIWVTDTFPKTWLLARPSAVVQMGQNVSLRCRGPVDGVGLALYKKGEDKPLQFLDATSIDDNTSFFLNNVTYSDTGIYSCHYLLTWKTSIRMPSHNTVELMVVDKPPKPSLSAWPSTVFKLGKAITLQCRVSHPVLEFSLEWEERETFQKFSVNGDFIISNVDGKGTGTYSCSYRVETHPNIWSHRSEPLKLMGPAGYLTWNYVLNEAIRLSLIMQLVALLLVVLWIRWKCRRLRIREAWLLGTAQGVTMLFIVTALLCCGLCNGVLIEETEIVMPTPKPELWAETNFPLAPWKNLTLWCRSPSGSTKEFVLLKDGTGWIATRPASEQVRAAFPLGALTQSHTGSYHCHSWEEMAVSEPSEALELVGTDILPKPVISASPTIRGQELQLRCKGWLAGMGFALYKEGEQEPVQQLGAVGREAFFTIQRMEDKDEGNYSCRTHTEKRPFKWSEPSEPLELVIKEMYPKPFFKTWASPVVTPGARVTFNCSTPHQHMSFILYKDGSEIASSDRSWASPGASAAHFLIISVGIGDGGNYSCRYYDFSIWSEPSDPVELVVTEFYPKPTLLAQPGPVVFPGKSVILRCQGTFQGMRFALLQEGAHVPLQFRSVSGNSADFLLHTVGAEDSGNYSCIYYETTMSNRGSYLSMPLMIWVTDTFPKPWLFAEPSSVVPMGQNVTLWCRGPVHGVGYILHKEGEATSMQLWGSTSNDGAFPITNISGTSMGRYSCCYHPDWTSSIKIQPSNTLELLVTGLLPKPSLLAQPGPMVAPGENMTLQCQGELPDSTFVLLKEGAQEPLEQQRPSGYRADFWMPAVRGEDSGIYSCVYYLDSTPFAASNHSDSLEIWVTDKPPKPSLSAWPSTMFKLGKDITLQCRGPLPGVEFVLEHDGEEAPQQFSEDGDFVINNVEGKGIGNYSCSYRLQAYPDIWSEPSDPLELVGAAGPVAQECTVGNIVRSSLIVVVVVALGVVLAIEWKKWPRLRTRGSETDGRDQTIALEECNQEGEPGTPANSPSSTSQRISVELPVPI

SEQ ID NO: 6829 - protein, 2623 aa, Homo Sapiens
MKVKGRGITCLLVSFAVICLVATPGGKACPRRCACYMPTEVHCTFRYLTSIPDSIPPNVERINLGYNSLVRLMETDFSGLTKLELLMLHSNGIHTIPDKTFSDLQALQVLKMSYNKVRKLQKDTFYGLRSLTRLHMDHNNIEFINPEVFYGLNFLRLVHLEGNQLTKLHPDTFVSLSYLQIFKISFIKFLYLSDNFLTSLPQEMVSYMPDLDSLYLHGNPWTCDCHLKWLSDWIQEKPDVIKCKKDRSPSSAQQCPLCMNPRTSKGKPLAMVSAAAFQCAKPTIDSSLKSKSLTILEDSSSAFISPQGFMAPFGSLTLNMTDQSGNEANMVCSIQKPSRTSPIAFTEENDYIVLNTSFSTFLVCNIDYGHIQPVWQILALYSDSPLILERSHLLSETPQLYYKYKQVAPKPEDIFTNIEADLRADPSWLMQDQISLQLNRTATTFSTLQIQYSSDAQITLPRAEMRPVKHKWTMISRDNNTKLEHTVLVGGTVGLNCPGQGDPTPHVDWLLADGSKVRAPYVSEDGRILIDKSGKLELQMADSFDTGVYHCISSNYDDADILTYRITVVEPLVEAYQENGIHHTVFIGETLDLPCHSTGIPDASISWVIPGNNVLYQSSRDKKVLNNGTLRILQVTPKDQGYYRCVAANPSGVDFLIFQVSVKMKGQRPLEHDGETEGSGLDESNPIAHLKEPPGAQLRTSALMEAEVGKHTSSTSKRHNYRELTLQRRGDSTHRRFRENRRHFPPSARRIDPQHWAALLEKAKKNAMPDKRENTTVSPPPVVTQLPNIPGEEDDSSGMLALHEEFMVPATKALNLPARTVTADSRTISDSPMTNINYGTEFSPVVNSQILPPEEPTDFKLSTAIKTTAMSKNINPTMSSQIQGTTNQHSSTVFPLLLGATEFQDSDQMGRGREHFQSRPPITVRTMIKDVNVKMLSSTTNKLLLESVNTTNSHQTSVREVSEPRHNHFYSHTTQILSTSTFPSDPHTAAHSQFPIPRNSTVNIPLFRRFGRQRKIGGRGRIISPYRTPVLRRHRYSIFRSTTRGSSEKSTTAFSATVLNVTCLSCLPRERLTTATAALSFPSAAPITFPKADIARVPSEESTTLVQNPLLLLENKPSVEKTTPTIKYFRTEISQVTPTGAVMTYAPTSIPMEKTHKVNASYPRVSSTNEAKRDSVITSSLSGAITKPPMTIIAITRFSRRKIPWQQNFVNNHNPKGRLRNQHKVSLQKSTAVMLPKTSPALPRDKVSPFHFTTLSTSVMQIPSNTLTTAHHTTTKTHNPGSLPTKKELPFPPLNPMLPSIISKDSSTKSIISTQTAIPATTPTFPASVITYETQTERSRAQTIQREQEPQKKNRTDPNISPDQSSGFTTPTAMTPPVLTTAETSVKPSVSAFTHSPPENTTGISSTISFHSRTLNLTDVIEELAQASTQTLKSTIASETTLSSKSHQSTTTRKAIIRHSTIPPFLSSSATLMPVPISPPFTQRAVTDNVATPISGLMTNTVVKLHESSRHNAKPQQLVAEVATSPKVHPNAKFTIGTTHFIYSNLLHSTPMPALTTVKSQNSKLTPSPWAENQFWHKPYSEIAEKGKKPEVSMLATTGLSEATTLVSDWDGQKNTKKSDFDKKPVQEATTSKLLPFDSLSRYIFEKPRIVGGKAASFTIPANSDAFLPCEAVGNPLPTIHWTRVPSGLDLSKRKQNSRVQVLPNGTLSIQRVEIQDRGQYLCSASNLFGTDHLHVTLSVVSYPPRILERRTKEITVHSGSTVELKCRAEGRPSPTVTWILANQTVVSESSQGSRQAVVTVDGTLVLHNLSIYDRGFYKCVASNPGGQDSLLVKIQVIAAPPVILEQRRQVIVGTWGESLKLPCTAKGTPQPSVYWVLSDGTEVKPLQFTNSKLFLFSNGTLYIRNLASSDRGTYECIATSSTGSERRVVMLTMEERVTSPRIEAASQKRTEVNFGDKLLLNCSATGEPKPQIMWRLPSKAVVDQQHRVGSWIHVYPNGSLFIGSVTEKDSGVYLCVARNKMGDDLILMHVSLRLKPAKIDHKQYFRKQVLHGKDFQVDCKASGSPVPEISWSLPDGTMINNAMQADDSGHRTRRYTLFNNGTLYFNKVGVAEEGDYTCYAQNTLGKDEMKVHLTVITAAPRIRQSNKTNKRIKAGDTAVLDCEVTGDPKPKIFWLLPSNDMISFSIDRYTFHANGSLTINKVKLLDSGEYVCVARNPSGDDTKMYKLDVVSKPPLINGLYTNRTVIKATAVRHSKKHFDCRAEGTPSPEVMWIMPDNIFLTAPYYGSRITVHKNGTLEIRNVRLSDSADFICVARNEGGESVLVVQLEVLEMLRRPTFRNPFNEKIVAQLGKSTALNCSVDGNPPPEIIWILPNGTRFSNGPQSYQYLIASNGSFIISKTTREDAGKYRCAARNKVGYIEKLVILEIGQKPVILTYAPGTVKGISGESLSLHCVSDGIPKPNIKWTMPSGYVVDRPQINGKYILHDNGTLVIKEATAYDRGNYICKAQNSVGHTLITVPVMIVAYPPRITNRPPRSIVTRTGAAFQLHCVALGVPKPEITWEMPDHSLLSTASKERTHGSEQLHLQGTLVIQNPQTSDSGIYKCTAKNPLGSDYAATYIQVI

SEQ ID NO: 6830 - protein, 86 aa, Homo Sapiens
TMEERVTSPRIEAASQKRTEVNFGDKLLLNCSATGEPKPQIMWRLPSKAVVDQQHRILDFYFSEAEAMPCSCCNHKTEYPAYYCQV

SEQ ID NO: 6831 - protein, 406 aa, Homo Sapiens
MSLVELLLWWNCFSRTGVAASLEVSESPGSIQVARGQPAVLPCTFTTSAALINLNVIWMVTPLSNANQPEQVILYQGGQMFDGAPRFHGRVGFTGTMPATNVSIFINNTQLSDTGTYQCLVNNLPDIGGRNIGVTGLTVLVPPSAPHCQIQGSQDIGSDVILLCSSEEGIPRPTYLWEKLDNTLKLPPTATQDQVQGTVTIRNISALSSAQPRNIGLIAGAIGTGAVIIIFCIALILGAFFYWRSKNKEEEEEEIPNEIREDDLPPKCSSAKAFHTEISSSDNNTLTSSNAYNSRYWSNNPKVHRNTESVSHFSDLGQSFSFHSGNANIPSIYANGTHLVPGQHKTLVVTANRGSSPQVMSRSNGSVSRKPRPPHTHSYTISHATLERIGAVPVMVPAQSRAGSLV

SEQ ID NO: 6832 - protein, 430 aa, Homo Sapiens
MSLVELLLWWNCFSRTGVAASLEVSESPGSIQVARGQPAVLPCTFTTSAALINLNVIWMVTPLSNANQPEQVILYQGGQMFDGAPRFHGRVGFTGTMPATNVSIFINNTQLSDTGTYQCLVNNLPDIGGRNIGVTGLTVLVPPSAPHCQIQGSQDIGSDVILLCSSEEGIPRPTYLWEKLDNTLKLPPTATQDQVQGTVTIRNISALSSGLYQCVASNAIGTSTCLLDLQVISPQPRNIGLIAGAIGTGAVIIIFCIALILGAFFYWRSKNKEEEEEEIPNEIREDDLPPKCSSAKAFHTEISSSDNNTLTSSNAYNSRYWSNNPKVHRNTESVSHFSDLGQSFSFHSGNANIPSIYANGTHLVPGQHKTLVVTANRGSSPQVMSRSNGSVSRKPRPPHTHSYTISHATLERIGAVPVMVPAQSRAGSLV

SEQ ID NO: 6833 - protein, 430 aa, Homo Sapiens; identical to SEQ ID NO: 6832

SEQ ID NO: 6834 - protein, 407 aa, Homo Sapiens
MTSQRSPLAPLLLLSLHGVAASLEVSESPGSIQVARGQPAVLPCTFTTSAALINLNVIWMVTPLSNANQPEQVILYQGGQMFDGAPRFHGRVGFTGTMPATNVSIFINNTQLSDTGTYQCLVNNLPDIGGRNIGVTGLTVLVPPSAPHCQIQGSQDIGSDVILLCSSEEGIPRPTYLWEKLDNTLKLPPTATQDQVQGTVTIRNISALSSAQPRNIGLIAGAIGTGAVIIIFCIALILGAFFYWRSKNKEEEEEEIPNEIREDDLPPKCSSAKAFHTEISSSDNNTLTSSNAYNSRYWSNNPKVHRNTESVSHFSDLGQSFSFHSGNANIPSIYANGTHLVPGQHKTLVVTANRGSSPQVMSRSNGSVSRKPRPPHTHSYTISHATLERIGAVPVMVPAQSRAGSLV

SEQ ID NO: 6835 - protein, 431 aa, Homo Sapiens
MTSQRSPLAPLLLLSLHGVAASLEVSESPGSIQVARGQPAVLPCTFTTSAALINLNVIWMVTPLSNANQPEQVILYQGGQMFDGAPRFHGRVGFTGTMPATNVSIFINNTQLSDTGTYQCLVNNLPDIGGRNIGVTGLTVLVPPSAPHCQIQGSQDIGSDVILLCSSEEGIPRPTYLWEKLDNTLKLPPTATQDQVQGTVTIRNISALSSGLYQCVASNAIGTSTCLLDLQVISPQPRNIGLIAGAIGTGAVIIIFCIALILGAFFYWRSKNKEEEEEEIPNEIREDDLPPKCSSAKAFHTEISSSDNNTLTSSNAYNSRYWSNNPKVHRNTESVSHFSDLGQSFSFHSGNANIPSIYANGTHLVPGQHKTLVVTANRGSSPQVMSRSNGSVSRKPRPPHTHSYTISHATLERIGAVPVMVPAQSRAGSLV

SEQ ID NO: 6836 - protein, 403 aa, Homo Sapiens
MTSQRSPLAPLLLLSLHGVAASLEVSESPGSIQVARGQPAVLPCTFTTSAALINLNVIWMVTPLSNANQPEQVILYQGGQMFDGAPRFHGRVGFTGTMPATNVSIFINNTQLSDTGTYQCLVNNLPDIGGRNIGVTGLTVLVPPSAPHCQIQGSQDIGSDVILLCSSEEGIPRPTYLWEKLDNTLKLPPTATQDQVQGTVTIRNISALSSGLYQCVASNAIGTSTCLLDLQVISRAFFYWRSKNKEEEEEEIPNEIREDDLPPKCSSAKAFHTEISSSDNNTLTSSNAYNSRYWSNNPKVHRNTESVSHFSDLGQSFSFHSGNANIPSIYANGTHLVPGQHKTLVVTANRGSSPQVMSRSNGSVSRKPRPPHTHSYTISHATLERIGAVPVMVPAQSRAGSLV

SEQ ID NO: 6837 - protein, 33 aa, Homo Sapiens
MVTPLSNANQPEQVILYQGGQMFDGAPRFHGRV

SEQ ID NO: 6838 - protein, 59 aa, Homo Sapiens
MVTPLSNANQPEQVILYQGGQMFDGAPRFHGRVGFTGTMPATNVSIFINNTQLSDTGTY

SEQ ID NO: 6839 - protein, 467 aa, Homo Sapiens
MRTAPSLRRCVCLLLAAILDLARGYLTVNIEPLPPVVAGDAVTLKCNFKTDGRMREIVWYRVTDGGTIKQKIFTFDAMFSTNYSHMENYRKREDLVYQSTVRLPEVRISDNGPYECHVGIYDRATREKVVLASGNIFLNVMAPPTSIEVVAADTPAPFSRYQAQNFTLVCIVSGGKPAPMVYFKRDGEPIDAVPLSEPPAASSGPLQDSRPFRSLLHRDLDDTKMQKSLSLLDAENRGGRPYTERPSRGLTPDPNILLQPTTENIPETVVSREFPRWVHSAEPTYFLRHSRTPSSDGTVEVRALLTWTLNPQIDNEALFSCEVKHPALSMPMQAEVTLVAPKGPKIVMTPSRARVGDTVRILVHGFQNEVFPEPMFTWTRVGSRLLDGSAEFDGKELVLERVPAELNGSMYRCTAQNPLGSTDTHTRLIVFENPNIPRGTEDSNGSIGPTGARLTLVLALTVILELT

SEQ ID NO: 6840 - protein, 613 aa, Homo Sapiens
MGALRPTLLPPSLPLLLLLMLGMGCWAREVLVPEGPLYRVAGTAVSISCNVTGYEGPAQQNFEWFLYRPEAPDTALGIVSTKDTQFSYAVFKSRVVAGEVQVQRLQGDAVVLKIARLQAQDAGIYECHTPSTDTRYLGSYSGKVELRVLPDVLQVSAAPPGPRGRQAPTSPPRMTVHEGQELALGCLARTSTQKHTHLAVSFGRSVPEAPVGRSTLQEVVGIRSDLAVEAGAPYAERLAAGELRLGKEGTDRYRMVVGGAQAGDAGTYHCTAAEWIQDPDGSWAQIAEKRAVLAHVDVQTLSSQLAVTVGPGERRIGPGEPLELLCNVSGALPPAGRHAAYSVGWEMAPAGAPGPGRLVAQLDTEGVGSLGPGYEGRHIAMEKVASRTYRLRLEAARPGDAGTYRCLAKAYVRGSGTRLREAASARSRPLPVHVREEGVVLEAVAWLAGGTVYRGETASLLCNISVRGGPPGLRLAASWWVERPEDGELSSVPAQLVGGVGQDGVAELGVRPGGGPVSVELVGPRSHRLRLHSLGPEDEGVYHCAPSAWVQHADYSWYQAGSARSGPVTVYPYMHALDTLFVPLLVGTGVALVTGATVLGTITCCFMKRLRKR

SEQ ID NO: 6841 - protein, 613 aa, Homo Sapiens; identical to SEQ ID NO: 6840

SEQ ID NO: 6842 - protein, 301 aa, Homo Sapiens
MGALRPTLLPPSLPLLLLLMLGMGCWAREVLVPEGPLYRVAGTAVSISCNVTGYEGPAQQNFEWFLYRPEAPDTALGIVSTKDTQFSYAVFKSRVVAGEVQVQRLQGDAVVLKIARLQAQDAGIYECHTPSTDTRYLGSYSGKVELRVLPDVLQVSAAPPGPRGRQAPTSPPRMTVHEGQELALGCLARTSTQKHTHLAVSFGRSVPEAPVGRSTLQEVVGIRSDLAVEAGAPYAERLAAGELRLGKEGTDRYRMVVGGAQAGDAGTYHCTAAEWIQDPDGSWAQIAEKRAVLAHVDVQTL

SEQ ID NO: 6843 - protein, 613 aa, Homo Sapiens; identical to SEQ ID NO: 6840

SEQ ID NO: 6844 - protein, 1163 aa, Homo Sapiens
MVWCLGLAVLSLVISQGADGRGKPEVVSVVGRAGESVVLGCDLLPPAGRPPLHVIEWLRFGFLLPIFIQFGLYSPRIDPDYVGRVRLQKGASLQIEGLRVEDQGWYECRVFFLDQHIPEDDFANGSWVHLTVNSPPQFQETPPAVLEVQELEPVTLRCVARGSPLPHVTWKLRGKDLGQGQGQVQVQNGTLRIRRVERGSSGVYTCQASSTEGSATHATQLLVLGPPVIVVPPKNSTVNASQDVSLACHAEAYPANLTYSWFQDNINVFHISRLQPRVRILVDGSLRLLATQPDDAGCYTCVPSNGLLHPPSASAYLTVLCMPGVIRCPVRANPPLLFVSWTKDGKALQLDKFPGWSQGTEGSLIIALGNEDALGEYSCTPYNSLGTAGPSPVTRVLLKAPPAFIERPKEEYFQEVGRELLIPCSAQGDPPPVVSWTKVGRGLQGQAQVDSNSSLILRPLTKEAHGHWECSASNAVARVATSTNVYVLGTSPHVVTNVSVVALPKGANVSWEPGFDGGYLQRFSVWYTPLAKRPDRMHHDWVSLAVPVGAAHLLVPGLQPHTQYQFSVLAQNKLGSGPFSEIVLSAPEGLPTTPAAPGLPPTEIPPPLSPPRGLVAVRTPRGVLLHWDPPELVPKRLDGYVLEGRQGSQGWEVLDPAVAGTETELLVPGLIKDVLYEFRLVAFAGSFVSDPSNTANVSTSGLEVYPSRTQLPGLLPQPVLAGVVGGVCFLGVAVLVSILAGCLLNRRRAARRRRKRLRQDPPLIFSPTGKSAAPSALGSGSPDSVAKLKLQGSPVPSLRQSLLWGDPAGTPSPHPDPPSSRGPLPLEPICRGPDGRFVMGPTVAAPQERSGREQAEPRTPAQRLARSFDCSSSSPSGAPQPLCIEDISPVAPPPAAPPSPLPGPGPLLQYLSLPFFREMNVDGDWPPLEEPSPAAPPDYMDTRRCPTSSFLRSPETPPVSPRESLPGAVVGAGATAEPPYTALADWTLRERLLPGLLPAAPRGSLTSQSSGRGSASFLRPPSTAPSAGGSYLSPAPGDTSSWASGPERWPRREHVVTVSKRRNTSVDENYEWDSEFPGDMELLETLHLGLASSRLRPEAEPELGVKTPEEGCLLNTAHVTGPEARCAALREEFLAFRRRRDATRARLPAYRQPVPHPEQATLL

SEQ ID NO: 6845 - protein, 1179 aa, Homo Sapiens
MVWCLGLAVLSLVISQGADGRGKPEVVSVVGRAGESVVLGCDLLPPAGRPPLHVIEWLRFGFLLPIFIQFGLYSPRIDPDYVGRVRLQKGASLQIEGLRVEDQGWYECRVFFLDQHIPEDDFANGSWVHLTVNSPPQFQETPPAVLEVQELEPVTLRCVARGSPLPHVTWKLRGKDLGQGQGQVQVQNGTLRIRRVERGSSGVYTCQASSTEGSATHATQLLVLGPPVIVVPPKNSTVNASQDVSLACHAEAYPANLTYSWFQDNINVFHISRLQPRVRILVDGSLRLLATQPDDAGCYTCVPSNGLLHPPSASAYLTVLYPAQVTAMPPETPLPIGMPGVIRCPVRANPPLLFVSWTKDGKALQLDKFPGWSQGTEGSLIIALGNEDALGEYSCTPYNSLGTAGPSPVTRVLLKAPPAFIERPKEEYFQEVGRELLIPCSAQGDPPPVVSWTKVGRGLQGQAQVDSNSSLILRPLTKEAHGHWECSASNAVARVATSTNVYVLGTSPHVVTNVSVVALPKGANVSWEPGFDGGYLQRFSVWYTPLAKRPDRMHHDWVSLAVPVGAAHLLVPGLQPHTQYQFSVLAQNKLGSGPFSEIVLSAPEGLPTTPAAPGLPPTEIPPPLSPPRGLVAVRTPRGVLLHWDPPELVPKRLDGYVLEGRQGSQGWEVLDPAVAGTETELLVPGLIKDVLYEFRLVAFAGSFVSDPSNTANVSTSGLEVYPSRTQLPGLLPQPVLAGVVGGVCFLGVAVLVSILAGCLLNRRRAARRRRKRLRQDPPLIFSPTGKSAAPSALGSGSPDSVAKLKLQGSPVPSLRQSLLWGDPAGTPSPHPDPPSSRGPLPLEPICRGPDGRFVMGPTVAAPQERSGREQAEPRTPAQRLARSFDCSSSSPSGAPQPLCIEDISPVAPPPAAPPSPLPGPGPLLQYLSLPFFREMNVDGDWPPLEEPSPAAPPDYMDTRRCPTSSFLRSPETPPVSPRESLPGAVVGAGATAEPPYTALADWTLRERLLPGLLPAAPRGSLTSQSSGRGSASFLRPPSTAPSAGGSYLSPAPGDTSSWASGPERWPRREHVVTVSKRRNTSVDENYEWDSEFPGDMELLETLHLGLASSRLRPEAEPELGVKTPEEGCLLNTAHVTGPEARCAALREEFLAFRRRRDATRARLPAYRQPVPHPEQATLL

SEQ ID NO: 6846 - protein, 717 aa, Homo Sapiens
MVWCLGLAVLSLVISQGADGRGKPEVVSVVGRAGESVVLGCDLLPPAGRPPLHVIEWLRFGFLLPIFIQFGLYSPRIDPDYVGRVRLQKGASLQIEGLRVEDQGWYECRVFFLDQHIPEDDFANGSWVHLTVNSPPQFQETPPAVLEVQELEPVTLRCVARGSPLPHVTWKLRGKDLGQGQGQVQVQNGTLRIRRVERGSSGVYTCQASSTEGSATHATQLLVLGPPVIVVPPKNSTVNASQDVSLACHAEAYPANLTYSWFQDNINVFHISRLQPRVRILVDGSLRLLATQPDDAGCYTCVPSNGLLHPPSASAYLTVLYPAQVTAMPPETPLPIGMPGVIRCPVRANPPLLFVSWTKDGKALQLDKFPGWSQGTEGSLIIALGNEDALGEYSCTPYNSLGTAGPSPVTRVLLKAPPAFIERPKEEYFQEVGRELLIPCSAQGDPPPAAPPSPLPGPGPLLQYLSLPFFREMNVDGDWPPLEEPSPAAPPDYMDTRRCPTSSFLRSPETPPVSPRESLPGAVVGAGATAEPPYTALADWTLRERLLPGLLPAAPRGSLTSQSSGRGSASFLRPPSTAPSAGGSYLSPAPGDTSSWASGPERWPRREHVVTVSKRRNTSVDENYEWDSEFPGDMELLETLHLGLASSRLRPEAEPELGVKTPEEGCLLNTAHVTGPEARCAALREEFLAFRRRRDATRARLPAYRQPVPHPEQATLL

SEQ ID NO: 6847 - protein, 411 aa, Homo Sapiens
MSPARLRPRLHFCLVLLLLLVVPAAWGCGPGRVVGSRRRPPRKLVPLAYKQFSPNVPEKTLGASGRYEGKIARSSERFKELTPNYNPDIIFKDEENTGADRLMTQRCKDRLNSLAISVMNQWPGVKLRVTEGWDEDGHHSEESLHYEGRAVDITTSDRDRNKYGLLARLAVEAGFDWVYYESKAHVHCSVKSEHSAAAKTGGCFPAGAQVRLESGARVALSAVRPGDRVLAMGEDGSPTFSDVLIFLDREPHRLRAFQVIETQDPPRRLALTPAHLLFTADNHTEPAARFRATFASHVQPGQYVLVAGVPGLQPARVAAVSTHVALGAYAPLTKHGTLVVEDVVASCFAAVADHHLAQLAFWPLRLFHSLAWGSWTPGEGVHWYPQLLYRLGRLLLEEGSFHPLGMSGAGS

SEQ ID NO: 6848 - protein, 178 aa, Homo Sapiens
MHSSALLCCLVLLTGVRASPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 6849 - protein, 74 aa, Homo Sapiens
MIQFYLEEVMPQAENQDPDIKAHVNSLGENLKTLRLRLRRCHRFLPCENKSKAVEQVKNAFNKLQEKGIYKAMS

SEQ ID NO: 6850 - protein, 199 aa, Homo Sapiens
MNCVCRLVLVVLSLWPDTAVAPGPPPGPPRVSPDPRAELDSTVLLTRSLLADTRQLAAQLRDKFPADGDHNLDSLPTLAMSAGALGALQLPGVLTRLRADLLSYLRHVQWLRRAGGSSLKTLEPELGTLQARLDRLLRRLQLLMSRLALPQPPPDPPAPPLAPPSSAWGGIRAAHAILGGLHLTLDWAVRGLLLLKTRL

SEQ ID NO: 6851 - protein, 199 aa, Homo Sapiens; identical to SEQ ID NO: 6850

SEQ ID NO: 6852 - protein, 40 aa, Homo Sapiens
MSAGALGALQLPGVLTRLRADLLSYLRHVQWLRRAGGSSL

SEQ ID NO: 6853 - protein, 120 aa, Homo Sapiens
MSAGALGALQLPGVLTRLRADLLSYLRHVQWLRRAGGSSLKTLEPELGTLQARLDRLLRRLQLLMSRLALPQPPPDPPAPPLAPPSSAWGGIRAAHAILGGLHLTLDWAVRGLLLLKTRL

SEQ ID NO: 6854 - protein, 152 aa, Homo Sapiens
MSSSCSGLSRVLVAVATALVSASSPCPQAWGPPDPPARPVVSCQAADYENFSCTWSPSQISGLPTRYLTSYRKKTVLGADSQRRSPSTGPWPCPQDPLGAARCVVHGAEFWSQYRINVTEVNPLGASTRLLDVSLQSILRPDPPQGLRVESV

SEQ ID NO: 6855 - protein, 54 aa, Homo Sapiens
MSSSCSGLSRVLVAVATALVSASSPCPQAWGPPGTQCPGFGMGSQSCSRDLTLG

SEQ ID NO: 6856 - protein, 139 aa, Homo Sapiens
MSSSCSGLSRVLVAVATALVSASSPCPQAWGPPGVQYGQPGRSVKLCCPGVTAGDPVSWFRDGEPKLLQGPDSGLGHELVLAQADSTDEGTYICQTLDGALGGTVTLQLGYPPARPVVSCQAADYENFSCTWSPSQISG

SEQ ID NO: 6857 - protein, 167 aa, Homo Sapiens
MSSSCSGLSRVLVAVATALVSASSPCPQAWGPPGVQYGQPGRSVKLCCPGVTAGDPVSWFRDGEPKLLQGPDSGLGHELVLAQADSTDEGTYICQTLDGALGGTVTLQLGYPPARPVVSCQAADYENFSCTWSPSQISGLPTRYLTSYRKKTVLGADSQRRSPSTGP

SEQ ID NO: 6858 - protein, 422 aa, Homo Sapiens
MSSSCSGLSRVLVAVATALVSASSPCPQAWGPPGVQYGQPGRSVKLCCPGVTAGDPVSWFRDGEPKLLQGPDSGLGHELVLAQADSTDEGTYICQTLDGALGGTVTLQLGYPPARPVVSCQAADYENFSCTWSPSQISGLPTRYLTSYRKKTVLGADSQRRSPSTGPWPCPQDPLGAARCVVHGAEFWSQYRINVTEVNPLGASTRLLDVSLQSILRPDPPQGLRVESVPGYPRRLRASWTYPASWPCQPHFLLKFRLQYRPAQHPAWSTVEPAGLEEVITDAVAGLPHAVRVSARDFLDAGTWSTWSPEAWGTPSTGTIPKEIPAWGQLHTQPEVEPQVDSPAPPRPSLQPHPRLLDHRDSVEQVAVLASLGILSFLGLVAGALALGLWLRLRRGGKDGSPKPGFLASVIPVDRRPGAPNL

SEQ ID NO: 6859 - protein, 422 aa, Homo Sapiens; identical to SEQ ID NO: 6858

SEQ ID NO: 6860 - protein, 270 aa, Homo Sapiens
MSSSCSGLSRVLVAVATALVSASSPCPQAWGPPGVQYGQPGRSVKLCCPGVTAGDPVSWFRDGEPKLLQGPDSGLGHELVLAQADSTDEGTYICQTLDGALGGTVTLQLGYPPARPVVSCQAADYENFSCTWSPSQISGLPTRYLTSYRKKTVLGADSQRRSPSTGPWPCPQDPLGAARCVVHGAEFWSQYRINVTEVNPLGASTRLLDVSLQSILRPDPPQGLRVESVPGYPRRLRASWTYPASWPCQPHFLLKFRLQYRPAQHPAWST

SEQ ID NO: 6861 - protein, 390 aa, Homo Sapiens
MSSSCSGLSRVLVAVATALVSASSPCPQAWGPPGVQYGQPGRSVKLCCPGVTAGDPVSWFRDGEPKLLQGPDSGLGHELVLAQADSTDEGTYICQTLDGALGGTVTLQLGYPPARPVVSCQAADYENFSCTWSPSQISGLPTRYLTSYRKKTVLGADSQRRSPSTGPWPCPQDPLGAARCVVHGAEFWSQYRINVTEVNPLGASTRLLDVSLQSILRPDPPQGLRVESVPGYPRRLRASWTYPASWPCQPHFLLKFRLQYRPAQHPAWSTVEPAGLEEVITDAVAGLPHAVRVSARDFLDAGTWSTWSPEAWGTPSTGTIPKEIPAWGQLHTQPEVEPQVDSPAPPRPSLQPHPRLLDHRDSVEQVAVLASLGILSFLGLVAGALALGLW

SEQ ID NO: 6862 - protein, 422 aa, Homo Sapiens; identical to SEQ ID NO: 6858

SEQ ID NO: 6863 - protein, 68 aa, Homo Sapiens
MSSSCSGLSRVLVAVATALVSASSPCPQAWGPPGVQYGQPGRSVKLCCPGVTAGPSSPPCCLLPSSRL

SEQ ID NO: 6864 - protein, 77 aa, Homo Sapiens
  misc_feature (1)..(1): Xaa can be any naturally occurring amino acid
XTPSTGTIPKEIPAWGQLHTQPEVEPQVDSPAPPRPSLQPHPRLLDHRDSVEQVAVLASLGILSFLGLVAGALALGL

SEQ ID NO: 6865 - protein, 328 aa, Homo Sapiens
MCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 6866 - protein, 51 aa, Homo Sapiens
MEPLVTWVVPLLFLFLLSRQGAACRTSECCFQDPPYPDADSGSASGPRDLR

SEQ ID NO: 6867 - protein, 67 aa, Homo Sapiens
MEPLVTWVVPLLFLFLLSRQGAACRTSECCFQDPPYPDADSGSASGPRDLRCYRISSDRYECSWQYE

SEQ ID NO: 6868 - protein, 381 aa, Homo Sapiens
MEPLVTWVVPLLFLFLLSRQGAACRTSECCFQDPPYPDADSGSASGPRDLRCYRISSDRYECSWQYEGPTAGVSHFLRCCLSSGRCCYFAAGSATRLQFSDQAGVSVLYTVTLWVESWARNQTEKSPEVTLQLYNSVKYEPPLGDIKVSKLAGQLRMEWETPDNQVGAEVQFRHRTPSSPWKLGDCGPQDDDTESCLCPLEMNVAQEFQLRRRQLGSQGSSWSKWSSPVCVPPENPPQPQVRFSVEQLGQDGRRRLTLKEQPTQLELPEGCQGLAPGTEVTYRLQLHMLSCPCKAKATRTLHLGKMPYLSGAAYNVAVISSNQFGPGLNQTWHIPADTHTDGMISAHCNLRLPDSRDSPASASRVAGITGICHHTRLILYF

SEQ ID NO: 6869 - protein, 662 aa, Homo Sapiens
MEPLVTWVVPLLFLFLLSRQGAACRTSECCFQDPPYPDADSGSASGPRDLRCYRISSDRYECSWQYEGPTAGVSHFLRCCLSSGRCCYFAAGSATRLQFSDQAGVSVLYTVTLWVESWARNQTEKSPEVTLQLYNSVKYEPPLGDIKVSKLAGQLRMEWETPDNQVGAEVQFRHRTPSSPWKLGDCGPQDDDTESCLCPLEMNVAQEFQLRRRQLGSQGSSWSKWSSPVCVPPENPPQPQVRFSVEQLGQDGRRRLTLKEQPTQLELPEGCQGLAPGTEVTYRLQLHMLSCPCKAKATRTLHLGKMPYLSGAAYNVAVISSNQFGPGLNQTWHIPADTHTEPVALNISVGTNGTTMYWPARAQSMTYCIEWQPVGQDGGLATCSLTAPQDPDPAGMATYSWSRESGAMGQEKCYYITIFASAHPEKLTLWSTVLSTYHFGGNASAAGTPHHVSVKNHSLDSVSVDWAPSLLSTCPGVLKEYVVRCRDEDSKQVSEHPVQPTETQVTLSGLRAGVAYTVQVRADTAWLRGVWSQPQRFSIEVQVSDWLIFFASLGSFLSILLVGVLGYLGLNRAARHLCPPLPTPCASSAIEFPGGKETWQWINPVDFQEEASLQEALVVEMSWDKGERTEPLEKTELPEGAPELALDTELSLEDGDRCKAKM

SEQ ID NO: 6870 - protein, 662 aa, Homo Sapiens; identical to SEQ ID NO: 6869

SEQ ID NO: 6871 - protein, 118 aa, Homo Sapiens
MEPLVTWVVPLLFLFLLSRQGAACRTSECCFQDPPYPDADSGSLPGSASGPRDLRCYRISSDRYECSWQYEGPTAGVSHFLRCCLSSGRCCYFAAGSATRLQFSDQAGVSVLYTVTLW

SEQ ID NO: 6872 - protein, 862 aa, Homo Sapiens
MAHTFRGCSLAFMFIITWLLIKAKIDACKRGDVTVKPSHVILLGSTVNITCSLKPRQGCFHYSRRNKLILYKFDRRINFHHGHSLNSQVTGLPLGTTLFVCKLACINSDEIQICGAEIFVGVAPEQPQNLSCIQKGEQGTVACTWERGRDTHLYTEYTLQLSGPKNLTWQKQCKDIYCDYLDFGINLTPESPESNFTAKVTAVNSLGSSSSLPSTFTFLDIVRPLPPWDIRIKFQKASVSRCTLYWRDEGLVLLNRLRYRPSNSRLWNMVNVTKAKGRHDLLDLKPFTEYEFQISSKLHLYKGSWSDWSESLRAQTPEEEPTGMLDVWYMKRHIDYSRQQISLFWKNLSVSEARGKILHYQVTLQELTGGKAMTQNITGHTSWTTVIPRTGNWAVAVSAANSKGSSLPTRINIMNLCEAGLLAPRQVSANSEGMDNILVTWQPPRKDPSAVQEYVVEWRELHPGGDTQVPLNWLRSRPYNVSALISENIKSYICYEIRVYALSGDQGGCSSILGNSKHKAPLSGPHINAITEEKGSILISWNSIPVQEQMGCLLHYRIYWKERDSNSQPQLCEIPYRVSQNSHPINSLQPRVTYVLWMTALTAAGESSHGNEREFCLQGKANWMAFVAPSICIAIIMVGIFSTHYFQQKVFVLLAALRPQWCSREIPDPANSTCAKKYPIAEEKTQLPLDRLLIDWPTPEDPEPLVISEVLHQVTPVFRHPPCSNWPQREKGIQGHQASEKDMMHSASSPPPPRALQAESRQLVDLYKVLESRGSDPKPENPACPWTVLPAGDLPTHDGYLPSNIDDLPSHEAPLADSLEELEPQHISLSVFPSSSLHPLTFSCGDKLTLDQLKMRCDSLML

SEQ ID NO: 6873 - protein, 659 aa, Homo Sapiens
MAHTFRGCSLAFMFIITWLLIKAKIDACKRGDVTVKPSHVILLGSTVNITCSLKPRQGCFHYSRRNKLILYKFDRRINFHHGHSLNSQVTGLPLGTTLFVCKLACINSDEIQICGAEIFVGVAPEQPQNLSCIQKGEQGTVACTWERGRDTHLYTEYTLQLSGPKNLTWQKQCKDIYCDYLDFGINLTPESPESNFTAKVTAVNSLGSSSSLPSTFTFLDIVRPLPPWDIRIKFQKASVSRCTLYWRDEGLVLLNRLRYRPSNSRLWNMVNVTKAKGRHDLLDLKPFTEYEFQISSKLHLYKGSWSDWSESLRAQTPEEEPTGMLDVWYMKRHIDYSRQQISLFWKNLSVSEARGKILHYQVTLQELTGGKAMTQNITGHTSWTTVIPRTGNWAVAVSAANSKGSSLPTRINIMNLCEAGLLAPRQVSANSEGMDNILVTWQPPRKDPSAVQEYVVEWRELHPGGDTQVPLNWLRSRPYNVSALISENIKSYICYEIRVYALSGDQGGCSSILGNSKHKAPLSGPHINAITEEKGSILISWNSIPVQEQMGCLLHYRIYWKERDSNSQPQLCEIPYRVSQNSHPINSLQPRVTYVLWMTALTAAGESSHGNEREFCLQGKANWMAFVAPSICIAIIMVGIFSTHYFQQKRRHSCPWTGS

SEQ ID NO: 6874 - protein, 635 aa, Homo Sapiens
MAHTFRGCSLAFMFIITWLLIKAKIDACKRGDVTVKPSHVILLGSTVNITCSLKPRQGCFHYSRRNKLILYKFDRRINFHHGHSLNSQVTGLPLGTTLFVCKLACINSDEIQICGAEIFVGVAPEQPQNLSCIQKGEQGTVACTWERGRDTHLYTEYTLQLSGPKNLTWQKQCKDIYCDYLDFGINLTPESPESNFTAKVTAVNSLGSSSSLPSTFTFLDIVRPLPPWDIRIKFQKASVSRCTLYWRDEGLVLLNRLRYRPSNSRLWNMVNVTKAKGRHDLLDLKPFTEYEFQISSKLHLYKGSWSDWSESLRAQTPEEEPTGMLDVWYMKRHIDYSRQQISLFWKNLSVSEARGKILHYQVTLQELTGGKAMTQNITGHTSWTTVIPRTGNWAVAVSAANSKGSSLPTRINIMNLCEAGLLAPRQVSANSEGMDNILVTWQPPRKDPSAVQEYVVEWRELHPGGDTQVPLNWLRSRPYNVSALISENIKSYICYEIRVYALSGDQGGCSSILGNSKHKAPLSGPHINAITEEKGSILISWNSIPVQEQMGCLLHYRIYWKERDSNSQPQLCEIPYRVSQNSHPINSLQPRVTYVLWMTALTAAGESSHGNEREFCLQGEDTAALGQAPDRLAHA

SEQ ID NO: 6875 - protein, 776 aa, Homo Sapiens
MAHTFRGCSLAFMFIITWLLIKAKIDACKRGDVTVKPSHVILLGSTVNITCSLKPRQGCFHYSRRNKLILYKFDRRINFHHGHSLNSQVTGLPLGTTLFVCKLACINSDEIQICGAEIFVGVAPEQPQNLSCIQKGEQGTVACTWERGRDTHLYTEYTLQLSGPKNLTWQKQCKDIYCDYLDFGINLTPESPESNFTAKVTAVNSLGSSSSLPSTFTFLDIVRPLPPWDIRIKFQKASVSRCTLYWRDEGLVLLNRLRYRPSNSRLWNMVNVTKAKGRHDLLDLKPFTEYEFQISSKLHLYKGSWSDWSESLRAQTPEEEPTGMLDVWYMKRHIDYSRQQISLFWKNLSVSEARGKILHYQVTLQELTGGKAMTQNITGHTSWTTVIPRTGNWAVAVSAANSKGSSLPTRINIMNLCEAGLLAPRQVSANSEGMDNILVTWQPPRKDPSAVQEYVVEWRELHPGGDTQVPLNWLRSRPYNVSALISEIPYRVSQNSHPINSLQPRVTYVLWMTALTAAGESSHGNEREFCLQGKANWMAFVAPSICIAIIMVGIFSTHYFQQKVFVLLAALRPQWCSREIPDPANSTCAKKYPIAEEKTQLPLDRLLIDWPTPEDPEPLVISEVLHQVTPVFRHPPCSNWPQREKGIQGHQASEKDMMHSASSPPPPRALQAESRQLVDLYKVLESRGSDPKPENPACPWTVLPAGDLPTHDGYLPSNIDDLPSHEAPLADSLEELEPQHISLSVFPSSSLHPLTFSCGDKLTLDQLKMRCDSLML

SEQ ID NO: 6876 - protein, 230 aa, Homo Sapiens
  misc_feature (1)..(1): Xaa can be any naturally occurring amino acid
XQKGEQGTVACTWERGRDTHLYTEYTLQLSGPKNLTWQKQCKDIYCDYLDFGINLTPESPESNFTAKVTAVNSLGSSSSLPSTFTFLDIVRPLPPWDIRIKFQKASVSRCTLYWRDEGLVLLNRLRYRPSNSRLWNMVNVTKAKGRHDLLDLKPFTEYEFQISSKLHLYKGSWSDWSESLRAQTPEEEPTGMLDVWYMKRHIDYSRQQISLFWKVSFKRQLKTQGNKTEG

SEQ ID NO: 6877 - protein, 144 aa, Homo Sapiens
MALLLTTVIALTCLGGFASPGPVPPSTALRELIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGQFNNFESIIICRDRT

SEQ ID NO: 6878 - protein, 146 aa, Homo Sapiens
MHPLLNPLLLALGLMALLLTTVIALTCLGGFASPGPVPPSTALRELIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGQFN

SEQ ID NO: 6879 - protein, 279 aa, Homo Sapiens
MEWPARLCGLWALLLCAGGGGGGGGAAPTETQPPVTNLSVSVENLCTVIWTWNPPEGASSNCSLWYFSHFGDKQDKKIAPETRRSIEVPLNERICLQVGSQCSTNESEKPSILVEKCISPPEGDPESAVTELQCIWHNLSYMKCSWLPGRNTSPDTNYTLYYWHRSLEKIHQCENIFREGQYFGCSFDLTKVKDSSFEQHSVQIMVKDNAGKIKPSFNIVPLTSRVKPDPPHIKNLSFHNDDLYVQWENPQNFISRCLFYEVEVNNSQTETHNVFYVRF

SEQ ID NO: 6880 - protein, 427 aa, Homo Sapiens
MEWPARLCGLWALLLCAGGGGGGGGAAPTETQPPVTNLSVSVENLCTVIWTWNPPEGASSNCSLWYFSHFGDKQDKKIAPETRRSIEVPLNERICLQVGSQCSTNESEKPSILVEKCISPPEGDPESAVTELQCIWHNLSYMKCSWLPGRNTSPDTNYTLYYWHRSLEKIHQCENIFREGQYFGCSFDLTKVKDSSFEQHSVQIMVKDNAGKIKPSFNIVPLTSRVKPDPPHIKNLSFHNDDLYVQWENPQNFISRCLFYEVEVNNSQTETHNVFYVQEAKCENPEFERNVENTSCFMVPGVLPDTLNTVRIRVKTNKLCYEDDKLWSNWSQEMSIGKKRNSTLYITMLLIVPVIVAGAIIVLLLYLKRLKIIIFPPIPDPGKIFKEMFGDQNDDTLHWKKYDIYEKQTKEETDSVVLIENLKKASQ

SEQ ID NO: 6881 - protein, 308 aa, Homo Sapiens
MAPRRARGCRTLGLPALLLLLLLRPPATRDARDRLAVLAGRSRISESFNHEVQTHEACVRLRTMENCPQCHHHRTSRQQAGITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSSLDAFIKIRGGFSTWLLGLPHSTVGSG

SEQ ID NO: 6882 - protein, 346 aa, Homo Sapiens
MAPRRARGCRTLGLPALLLLLLLRPPATRDARDRLAVLAGRSRISESFNHEVQTHEACVRLRTMENCPQCHHHRTSRQQAGITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSSSHSRELTLLTLKWPKELLLLRRDISPALVEGAGQMPRASAPRQLQTGQPRMTSVLPRLCLSFGS

SEQ ID NO: 6883 - protein, 305 aa, Homo Sapiens
MAPRRARGCRTLGLPALLLLLLLRPPATRDARDRLAVLAGRSRISESFNHEVQTHEACVRLRTMENCPQCHHHRTSRQQAGITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTGRKQHLLPDFQASFQRDCINKHIEDKECWTVASFLLFCTMFVSTCWYTL

SEQ ID NO: 6884 - protein, 331 aa, Homo Sapiens
MAPRRARGCRTLGLPALLLLLLLRPPATRDARDRLAVLAGRSRISESFNHEVQTHEACVRLRTMENCPQCHHHRTSRQQAGITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRWLAKRSLPGDAEAPNMSRGGRNAWEQLSRAPATSLLRTPVESALSASRP

SEQ ID NO: 6885 - protein, 154 aa, Homo Sapiens
MAPRRARGCRTLGLPALLLLLLLRPPATREPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRASVCSCHPRSAGHTCSVGSVC

SEQ ID NO: 6886 - protein, 169 aa, Homo Sapiens
MAPRRARGCRTLGLPALLLLLLLRPPATREPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHL

SEQ ID NO: 6887 - protein, 172 aa, Homo Sapiens
MAPRRARGCRTLGLPALLLLLLLRPPATRGITCPPPMSVEHADIWVKSYSLYSRERYICNSGFKRKAGTSSLTECVLNKATNVAHWTTPSLKCIKPAASSPSSNNTAATTAAIVPGSQLMPSKSPSTGTTEISSHESSHGTPSQTTAKNWELTASASHQPPGVYPQGHSDTT

SEQ ID NO: 6888 - protein, 219 aa, Homo Sapiens
MAPRRARGCRTLGLPALLLLLLLRPPATRGITCPPPMSVEHADIWVKSYSLYSRERYICNSGFKRKAGTSSLTECVLNKATNVAHWTTPSLKCIKPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRASVCSCHPRSAGHTCSVGSVC

SEQ ID NO: 6889 - protein, 234 aa, Homo Sapiens
MAPRRARGCRTLGLPALLLLLLLRPPATRGITCPPPMSVEHADIWVKSYSLYSRERYICNSGFKRKAGTSSLTECVLNKATNVAHWTTPSLKCIKPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHL

SEQ ID NO: 6890 - protein, 252 aa, Homo Sapiens
MAPRRARGCRTLGLPALLLLLLLRPPATRGITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRASVCSCHPRSAGHTCSVGSVC

SEQ ID NO: 6891 - protein, 267 aa, Homo Sapiens
MAPRRARGCRTLGLPALLLLLLLRPPATRGITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHL

SEQ ID NO: 6892 - protein, 353 aa, Homo Sapiens
MRLAGRQVPEQRSPPPPGLGSARPGSPAVSCGAAAMAPRRARGCRTLGLPALLLLLLLRPPATRDARDRLAVLAGRSRISESFNHEVQTHEACVRLRTMENCPQCHHHRTSRQQAGITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHL

SEQ ID NO: 6893 - protein, 172 aa, Homo Sapiens
MSVEHADIWVKSYSLYSRERYICNSGFKRKAGTSSLTECVLNKATNVAHWTTPSLKCIKPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEM

SEQ ID NO: 6894 - protein, 148 aa, Homo Sapiens
MSVEHADIWVKSYSLYSRERYICNSGFKRKAGTSSLTECVLNKATNVAHWTTPSLKCINPALVHQRPAPPSTVTTAGVTPQPESLSPSGKEPAASSPSSNNTAATTAAIVPGSQLMPSKSPSTGTTEISSHESSHGTPSQTTAKNWEL

SEQ ID NO: 6895 - protein, 231 aa, Homo Sapiens
MSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHL

SEQ ID NO: 6896 - protein, 209 aa, Homo Sapiens
  misc_feature (1)..(1): Xaa can be any naturally occurring amino acid
XITCPPPMSVEHADIWVKSYSLYSRERYICNSGFKRKAGTSSLTECVLNKATNVAHWTTPSLKCIRTTEISSHESSHGTPSQTTAKNWELTASASHQPPGVYPQGHSDTTGRKQHLLPDFQASFQRDCINKHIEDKECWTVASFLLFLAISTSTVLLCGLSAVSLLACYLKSRQTPPLASVEMEAMEALPVTWGTSSRDEDLENCSHHL

SEQ ID NO: 6897 - protein, 155 aa, Homo Sapiens
  misc_feature (1)..(1): Xaa can be any naturally occurring amino acid
XLVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRASVCSCHPRSAGHTCSVGSVC

SEQ ID NO: 6898 - protein, 198 aa, Homo Sapiens
  misc_feature (1)..(1): Xaa can be any naturally occurring amino acid
XPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSSSQRKVTYLRLSVNYKAPPGVGDVYREDTSVWAPPNDPVSSCAARTDREPEKVEEMLSPVNPLHRRIQEEENSSQRHFTYICIYTSLSVISTHYI

SEQ ID NO: 6899 - protein, 155 aa, Homo Sapiens
MTPGKTSLVSLLLLLSLEAIVKAGITIPRNPGCPNSEDKNFPRTVMVNLNIHNRNTNTNPKRSSDYYNRSTSPWNLHRNEDPERYPSVIWEAKCRHLGCINADGNVDYHMNSVPIQQEILVLRREPPHCPNSFRLEKILVSVGCTCVTPIVHHVA

SEQ ID NO: 6900 - protein, 180 aa, Homo Sapiens
MDWPHNLLFLLTISIFLGLGQPRSPKSKRKGQGRPGPLAPGPHQVPLDLVSRMKPYARMEEYERNIEEMVAQLRNSSELAQRKCEVNLQLWMSNKRSLSPWGYSINHDPSRIPVDLPEARCLCLGCVNPFTMQEDRSMVSVPVFSQVPVRRRLCPPPPRTGPCRQRAVMETIAVGCTCIF

SEQ ID NO: 6901 - protein, 197 aa, Homo Sapiens
MTLLPGLLFLTWLHTCLAHHDPSLRGHPHSHGTPHCYSAEELPLGQAPPHLLARGAKWGQALPVALVSSLEAASHRGRHERPSATTQCPVLRPEEVLEADTHQRSISPWRYRVDTDEDRYPQKLAFAECLCRGCIDARTGRETAALNSVRLLQSLLVLRRRPCSRDGSGLPTPGAFAFHTEFIHVPVGCTCVLPRSV

SEQ ID NO: 6902 - protein, 35 aa, Homo Sapiens
MLGALVWMLVAGFLLALPPSWAAGAPRAGRRPARP

SEQ ID NO: 6903 - protein, 202 aa, Homo Sapiens
MLVAGFLLALPPSWAAGAPRAGRRPARPRGCADRPEELLEQLYGRLAAGVLSAFHHTLQLGPREQARNASCPAGGRPADRRFRPPTNLRSVSPWAYRISYDPARYPRYLPEAYCLCRGCLTGLFGEEDVRFRSAPVYMPTVVLRRTPACAGGRSVYTEAYVTIPVGCTCVPEPEKDADSINSSIDKQGAKLLLGPNDAPAGP

SEQ ID NO: 6904 - protein, 90 aa, Homo Sapiens
  misc_feature (1)..(1): Xaa can be any naturally occurring amino acid
XRPRGCADRPEELLEQLYGRLAAGVLSAFHHTLQLGPREQARNASCPAGGRPADRRFRPPTNLRSVSPWAYSSVSITSNHPWRTRPLFLD

SEQ ID NO: 6905 - protein, 163 aa, Homo Sapiens
MTVKTLHGPAMVKYLLLSILGLAFLSEAAARKIPKVGHTFFQKPESCPPVPGGSMKLDIGIINENQRVSMSRNIESRSTSPWNYTVTWDPNRYPSEVVQAQCRNLGCINAQGKEDISMNSVPIQQETLVVRRKHQGCSVSFQLEKVLVTVGCTCVTPVIHHVQ

SEQ ID NO: 6906 - protein, 866 aa, Homo Sapiens
MGAARSPPSAVPGPLLGLLLLLLGVLAPGGASLRLLDHRALVCSQPGLNCTVKNSTCLDDSWIHPRNLTPSSPKDLQIQLHFAHTQQGDLFPVAHIEWTLQTDASILYLEGAELSVLQLNTNERLCVRFEFLSKLRHHHRRWRFTFSHFVVDPDQEYEVTVHHLPKPIPDGDPNHQSKNFLVPDCEHARMKVTTPCMSSGSLWDPNITVETLEAHQLRVSFTLWNESTHYQILLTSFPHMENHSCFEHMHHIPAPRPEEFHQRSNVTLTLRNLKGCCRHQVQIQPFFSSCLNDCLRHSATVSCPEMPDTPEPIPDYMPLWVYWFITGISILLVGSVILLIVCMTWRLAGPGSEKYSDDTKYTDGLPAADLIPPPLKPRKVWIIYSADHPLYVDVVLKFAQFLLTACGTEVALDLLEEQAISEAGVMTWVGRQKQEMVESNSKIIVLCSRGTRAKWQALLGRGAPVRLRCDHGKPVGDLFTAAMNMILPDFKRPACFGTYVVCYFSEVSCDGDVPDLFGAAPRYPLMDRFEEVYFRIQDLEMFQPGRMHRVGELSGDNYLRSPGGRQLRAALDRFRDWQVRCPDWFECENLYSADDQDAPSLDEEVFEEPLLPPGTGIVKRAPLVREPGSQACLAIDPLVGEEGGAAVAKLEPHLQPRGQPAPQPLHTLVLAAEEGALVAAVEPGPLADGAAVRLALAGEGEACPLLGSPGAGRNSVLFLPVDPEDSPLGSSTPMASPDLLPEDVREHLEGLMLSLFEQSLSCQAQGGCSRPAMVLTDPHTPYEEEQRQSVQSDQGYISRSSPQPPEGLTEMEEEEEEEQDPGKPALPLSPEDLESLRSLQRQLLFRQLQKNSGWDTMGSESEGPSA

SEQ ID NO: 6907 - protein, 832 aa, Homo Sapiens
MGAARSPPSAVPGPLLGLLLLLLGVLAPGGASLRLLDHRALVCSQPGLNCTVKNSTCLDDSWIHPRNLTPSSPKDLQIQLHFAHTQQGDLFPVAHIEWTLQTDASILYLEGAELSVLQLNTNERLCVRFEFLSKLRHHHRRWRFTFSHFVVDPDQEYEVTVHHLPKPIPDGDPNHQSKNFLVPDCEHARMKVTTPCMSSGSLWDPNITVETLEAHQLRVSFTLWNESTHYQILLTSFPHMENHSCFEHMHHIPAPRPEEFHQRSNVTLTLRNLKGCCRHQVQIQPFFSSCLNDCLRHSATVSCPEMPDTPEPIPGPGSEKYSDDTKYTDGLPAADLIPPPLKPRKVWIIYSADHPLYVDVVLKFAQFLLTACGTEVALDLLEEQAISEAGVMTWVGRQKQEMVESNSKIIVLCSRGTRAKWQALLGRGAPVRLRCDHGKPVGDLFTAAMNMILPDFKRPACFGTYVVCYFSEVSCDGDVPDLFGAAPRYPLMDRFEEVYFRIQDLEMFQPGRMHRVGELSGDNYLRSPGGRQLRAALDRFRDWQVRCPDWFECENLYSADDQDAPSLDEEVFEEPLLPPGTGIVKRAPLVREPGSQACLAIDPLVGEEGGAAVAKLEPHLQPRGQPAPQPLHTLVLAAEEGALVAAVEPGPLADGAAVRLALAGEGEACPLLGSPGAGRNSVLFLPVDPEDSPLGSSTPMASPDLLPEDVREHLEGLMLSLFEQSLSCQAQGGCSRPAMVLTDPHTPYEEEQRQSVQSDQGYISRSSPQPPEGLTEMEEEEEEEQDPGKPALPLSPEDLESLRSLQRQLLFRQLQKNSGWDTMGSESEGPSA

SEQ ID NO: 6908 - protein, 330 aa, Homo Sapiens
MPVPWFLLSLALGRSPVVLSLERLVGPQDATHCSPGLSCRLWDSDILCLPGDIVPAPGPVLAPTHLQTELVLRCQKETDCDLCLRVAVHLAVHASLQAQVVLSFQAYPTARCVLLEVQVPAALVQFGQSVGSVVYDCFEAALGSEVRIWSYTQPRYEKELNHTQQLPALPWLNVSADGDNVHLVLNVSEEQHFGLSLYWNQVQGPPKPRWHKNLTGPQIITLNHTDLVPCLCIQVWPLEPDSVRTNICPFREDPRAHQNLWQAARLQLLTLQSWLLDAPCSLPAEAALCWRAPGGDPCQPLVPPLSWENVTVDKVLEFPLLKGHPNLCVQ

SEQ ID NO: 6909 - protein, 242 aa, Homo Sapiens
MPVPWFLLSLALGRSPVVLSLERLVGPQDATHCSPGLSCRLWDSDILCLPGDIVPAPGPVLAPTHLQTELVLRCQKETDCDLCLRVAVHLAVHASLQAQVVLSFQAYPTARCVLLEVQVPAALVQFGQSVGSVVYDCFEAALGSEVRIWSYTQPRYEKELNHTQQLPALPWLNVSADGDNVHLVLNVSEEQHFGLSLYWNQVQGPPKPRWHKNLVRPPPSQVHSHCRPMPVQRTQCHIREDP

SEQ ID NO: 6910 - protein, 416 aa, Homo Sapiens
MPVPWFLLSLALGRSPVVLSLERLVGPQDATHCSPGLSCRLWDSDILCLPGDIVPAPGPVLAPTHLQTELVLRCQKETDCDLCLRVAVHLAVHASLQAQVVLSFQAYPTARCVLLEVQVPAALVQFGQSVGSVVYDCFEAALGSEVRIWSYTQPRYEKELNHTQQLPDCRGLEVWNSIPSCWALPWLNVSADGDNVHLVLNVSEEQHFGLSLYWNQVQGPPKPRWHKNLTGPQIITLNHTDLVPCLCIQVWPLEPDSVRTNICPFREDPRAHQNLWQAARLQLLTLQSWLLDAPCSLPAEAALCWRAPGGDPCQPLVPPLSWENVTVDKVLEFPLLKGHPNLCVQVNSSEKLQLQECLWADSLGPLKDDVLLLETRGPQDNRSLCALEPSGCTSLPSKASTRAARLGEYLLQDLQS

SEQ ID NO: 6911 - protein, 99 aa, Homo Sapiens
MPVPWFLLSLALGRSPVVLSLERLVGPQDATHCSPGLSCRLWDSDILCLPGDIVPAPGPVLAPTHLQTELVLRCQKETDCDLCLRVAVHLAVHGEQVIL

SEQ ID NO: 6912 - protein, 156 aa, Homo Sapiens
MPVPWFLLSLALGRSPVVLSLERLVGPQDATHCSPGLSCRLWDSDILCLPGDIVPAPGPVLAPTHLQTELVLRCQKETDCDLCLRVAVHLAVHGHWEEPEDEEKFGGAADSGVEEPRNASLQAQVVLSFQAYPTARCVLLEVQVPAALVQFGLCGI

SEQ ID NO: 6913 - protein, 705 aa, Homo Sapiens
MPVPWFLLSLALGRSPVVLSLERLVGPQDATHCSPGLSCRLWDSDILCLPGDIVPAPGPVLAPTHLQTELVLRCQKETDCDLCLRVAVHLAVHGHWEEPEDEEKFGGAADSGVEEPRNASLQAQVVLSFQAYPTARCVLLEVQVPAALVQFGQSVGSVVYDCFEAALGSEVRIWSYTQPRYEKELNHTQQLPALPWLNVSADGDNVHLVLNVSEEQHFGLSLYWNQVQGPPKPRWHKNLTGPQIITLNHTDLVPCLCIQVWPLEPDSVRTNICPFREDPRAHQNLWQAARLQLLTLQSWLLDAPCSLPAEAALCWRAPGGDPCQPLVPPLSWENVTVDKVLEFPLLKGHPNLCVQVNSSEKLQLQECLWADSLGPLKDDVLLLETRGPQDNRSLCALEPSGCTSLPSKASTRAARLGEYLLQDLQSGQCLQLWDDDLGALWACPMDKYIHKRWALVWLACLLFAAALSLILLLKKDHAKGWLRLLKQDVRSGAAARGRAALLLYSADDSGFERLVGALASALCQLPLRVAVDLWSRRELSAQGPVAWFHAQRRQTLQEGGVVVLLFSPGAVALCSEWLQDGVSGPGAHGPHDAFRASLSCVLPDFLQGRAPGSYVGACFDRLLHPDAVPALFRTVPVFTLPSQLPDFLGALQQPRAPRSGRLQERAEQVSRALQPALDSYFHPPGTPAPGRGVGPGAGPGAGDGT

SEQ ID NO: 6914 - protein, 688 aa, Homo Sapiens
MPVPWFLLSLALGRSPVVLSLERLVGPQDATHCSPGLSCRLWDSDILCLPGDIVPAPGPVLAPTHLQTELVLRCQKETDCDLCLRVAVHLAVHGHWEEPEDEEKFGGAADSGVEEPRNASLQAQVVLSFQAYPTARCVLLEVQVPAALVQFGQSVGSVVYDCFEAALGSEVRIWSYTQPRYEKELNHTQQLPALPWLNVSADGDNVHLVLNVSEEQHFGLSLYWNQVQGPPKPRWHKNLTGPQIITLNHTDLVPCLCIQVWPLEPDSVRTNICPFREDPRAHQNLWQAARLQLLTLQSWLLDAPCSLPAEAALCWRAPGGDPCQPLVPPLSWENVTVDVNSSEKLQLQECLWADSLGPLKDDVLLLETRGPQDNRSLCALEPSGCTSLPSKASTRAARLGEYLLQDLQSGQCLQLWDDDLGALWACPMDKYIHKRWALVWLACLLFAAALSLILLLKKDHAKGWLRLLKQDVRSGAAARGRAALLLYSADDSGFERLVGALASALCQLPLRVAVDLWSRRELSAQGPVAWFHAQRRQTLQEGGVVVLLFSPGAVALCSEWLQDGVSGPGAHGPHDAFRASLSCVLPDFLQGRAPGSYVGACFDRLLHPDAVPALFRTVPVFTLPSQLPDFLGALQQPRAPRSGRLQERAEQVSRALQPALDSYFHPPGTPAPGRGVGPGAGPGAGDGT

SEQ ID NO: 6915 - protein, 690 aa, Homo Sapiens
MPVPWFLLSLALGRSPVVLSLERLVGPQDATHCSPGLSCRLWDSDILCLPGDIVPAPGPVLAPTHLQTELVLRCQKETDCDLCLRVAVHLAVHGHWEEPEDEEKFGGAADSGVEEPRNASLQAQVVLSFQAYPTARCVLLEVQVPAALVQFGQSVGSVVYDCFEAALGSEVRIWSYTQPRYEKELNHTQQLPDCRGLEVWNSIPSCWALPWLNVSADGDNVHLVLNVSEEQHFGLSLYWNQVQGPPKPRWHKNLTGPQIITLNHTDLVPCLCIQVWPLEPDSVRTNICPFREDPRAHQNLWQAARLQLLTLQSWLLDAPCSLPAEAALCWRAPGGDPCQPLVPPLSWENVTVDVNSSEKLQLQECLWADSLGPLKDDVLLLETRGPQDNRSLCALEPSGCTSLPSKASTRAARLGEYLLQDLQSGQCLQLWDDDLGALWACPMDKYIHKRWALVWLACLLFAAALSLILLLKKDHAKAAARGRAALLLYSADDSGFERLVGALASALCQLPLRVAVDLWSRRELSAQGPVAWFHAQRRQTLQEGGVVVLLFSPGAVALCSEWLQDGVSGPGAHGPHDAFRASLSCVLPDFLQGRAPGSYVGACFDRLLHPDAVPALFRTVPVFTLPSQLPDFLGALQQPRAPRSGRLQERAEQVSRALQPALDSYFHPPGTPAPGRGVGPGAGPGAGDGT

SEQ ID NO: 6916 - protein, 720 aa, Homo Sapiens
MPVPWFLLSLALGRSPVVLSLERLVGPQDATHCSPGLSCRLWDSDILCLPGDIVPAPGPVLAPTHLQTELVLRCQKETDCDLCLRVAVHLAVHGHWEEPEDEEKFGGAADSGVEEPRNASLQAQVVLSFQAYPTARCVLLEVQVPAALVQFGQSVGSVVYDCFEAALGSEVRIWSYTQPRYEKELNHTQQLPDCRGLEVWNSIPSCWALPWLNVSADGDNVHLVLNVSEEQHFGLSLYWNQVQGPPKPRWHKNLTGPQIITLNHTDLVPCLCIQVWPLEPDSVRTNICPFREDPRAHQNLWQAARLQLLTLQSWLLDAPCSLPAEAALCWRAPGGDPCQPLVPPLSWENVTVDKVLEFPLLKGHPNLCVQVNSSEKLQLQECLWADSLGPLKDDVLLLETRGPQDNRSLCALEPSGCTSLPSKASTRAARLGEYLLQDLQSGQCLQLWDDDLGALWACPMDKYIHKRWALVWLACLLFAAALSLILLLKKDHAKGWLRLLKQDVRSGAAARGRAALLLYSADDSGFERLVGALASALCQLPLRVAVDLWSRRELSAQGPVAWFHAQRRQTLQEGGVVVLLFSPGAVALCSEWLQDGVSGPGAHGPHDAFRASLSCVLPDFLQGRAPGSYVGACFDRLLHPDAVPALFRTVPVFTLPSQLPDFLGALQQPRAPRSGRLQERAEQVSRALQPALDSYFHPPGTPAPGRGVGPGAGPGAGDGT

SEQ ID NO: 6917 - protein, 707 aa, Homo Sapiens
MPVPWFLLSLALGRSPVVLSLERLVGPQDATHCSPGLSCRLWDSDILCLPGDIVPAPGPVLAPTHLQTELVLRCQKETDCDLCLRVAVHLAVHGHWEEPEDEEKFGGAADSGVEEPRNASLQAQVVLSFQAYPTARCVLLEVQVPAALVQFGQSVGSVVYDCFEAALGSEVRIWSYTQPRYEKELNHTQQLPDCRGLEVWNSIPSCWALPWLNVSADGDNVHLVLNVSEEQHFGLSLYWNQVQGPPKPRWHKNLTGPQIITLNHTDLVPCLCIQVWPLEPDSVRTNICPFREDPRAHQNLWQAARLQLLTLQSWLLDAPCSLPAEAALCWRAPGGDPCQPLVPPLSWENVTVDKVLEFPLLKGHPNLCVQVNSSEKLQLQECLWADSLGPLKDDVLLLETRGPQDNRSLCALEPSGCTSLPSKASTRAARLGEYLLQDLQSGQCLQLWDDDLGALWACPMDKYIHKRWALVWLACLLFAAALSLILLLKKDHAKAAARGRAALLLYSADDSGFERLVGALASALCQLPLRVAVDLWSRRELSAQGPVAWFHAQRRQTLQEGGVVVLLFSPGAVALCSEWLQDGVSGPGAHGPHDAFRASLSCVLPDFLQGRAPGSYVGACFDRLLHPDAVPALFRTVPVFTLPSQLPDFLGALQQPRAPRSGRLQERAEQVSRALQPALDSYFHPPGTPAPGRGVGPGAGPGAGDGT

SEQ ID NO: 6918 - protein, 98 aa, Homo Sapiens
MPVPWFLLSLALGRSPVVLSLERLVGPQDATHCSPGLSCRLWDSDILCLPGDIVPAPGPVLAPTHLQTELVLRCQKETDCDLCLRVAVHLAVHGLCGI

SEQ ID NO: 6919 - protein, 123 aa, Homo Sapiens
MPVPWFLLSLALGRSPVVLSLERLVGPQDATHCSPGLSCRLWDSDILCLPGDIVPAPGPVLAPTHLQTELVLRCQKETDCDLCLRVAVHLAVHGLPYCPLRPAGGASACCPCAVWSVCGLCGI

SEQ ID NO: 6920 - protein, 91 aa, Homo Sapiens
MPVPWFLLSLALGRSPVVLSLERLVGPQDATHCSPGLSCRLWGATKFWAWNSFSSHPLLHTQTVTYSACLGTSCLLRAPCWRLRTCRQSWC

SEQ ID NO: 6921 - protein, 70 aa, Homo Sapiens
MPVPWFLLSLALGRSPVVLSLERLVGPQDATHCSPGLSCRLWVTYSACLGTSCLLRAPCWRLRTCRQSWC

SEQ ID NO: 6922 - protein, 44 aa, Homo Sapiens
MPVPWFLLSLALGRSPVVLSLERLVGPQDATHCSPNCPVWSVWC

SEQ ID NO: 6923 - protein, 791 aa, Homo Sapiens
MPVPWFLLSLALGRSPVVLSLERLVGPQDATHCSPVSLEPWGDEERLRVQFLAQQSLSLAPVTAATARTALSGLSGADGRREERGRGKSWVCLSLGGSGNTEPQKKGLSCRLWDSDILCLPGDIVPAPGPVLAPTHLQTELVLRCQKETDCDLCLRVAVHLAVHGHWEEPEDEEKFGGAADSGVEEPRNASLQAQVVLSFQAYPTARCVLLEVQVPAALVQFGQSVGSVVYDCFEAALGSEVRIWSYTQPRYEKELNHTQQLPDCRGLEVWNSIPSCWALPWLNVSADGDNVHLVLNVSEEQHFGLSLYWNQVQGPPKPRWHKNLTGPQIITLNHTDLVPCLCIQVWPLEPDSVRTNICPFREDPRAHQNLWQAARLQLLTLQSWLLDAPCSLPAEAALCWRAPGGDPCQPLVPPLSWENVTVDKVLEFPLLKGHPNLCVQVNSSEKLQLQECLWADSLGPLKDDVLLLETRGPQDNRSLCALEPSGCTSLPSKASTRAARLGEYLLQDLQSGQCLQLWDDDLGALWACPMDKYIHKRWALVWLACLLFAAALSLILLLKKDHAKGWLRLLKQDVRSGAAARGRAALLLYSADDSGFERLVGALASALCQLPLRVAVDLWSRRELSAQGPVAWFHAQRRQTLQEGGVVVLLFSPGAVALCSEWLQDGVSGPGAHGPHDAFRASLSCVLPDFLQGRAPGSYVGACFDRLLHPDAVPALFRTVPVFTLPSQLPDFLGALQQPRAPRSGRLQERAEQVSRALQPALDSYFHPPGTPAPGRGVGPGAGPGAGDGT

SEQ ID NO: 6924 - protein, 173 aa, Homo Sapiens
MGSSRLAALLLPLLLIVIDLSDSAGIGFRHLPHWNTRCPLASHTDDSFTGLQRGLFHLLVQKSKKSSTFKFYRRHKMPAPAQRKLLPRRHLSEKSHHISIPSPDISHKGLRSKRTQPSDPETWESLPRLDSQRHGGPEFSFDLLPEARAIRVTISSGPEVSVRLCHQWALECE

SEQ ID NO: 6925 - protein, 667 aa, Homo Sapiens
MGSSRLAALLLPLLLIVIDLSDSAGIGFRHLPHWNTRCPLASHTDDSFTGSSAYIPCRTWWALFSTKPWCVRVWHCSRCLCQHLLSGGSGLQRGLFHLLVQKSKKSSTFKFYRRHKMPAPAQRKLLPRRHLSEKSHHISIPSPDISHKGLRSKRTQPSDPETWESLPRLDSQRHGGPEFSFDLLPEARAIRVTISSGPEVSVRLCHQWALECEELSSPYDVQKIVSGGHTVELPYEFLLPCLCIEASYLQEDTVRRKKCPFQSWPEAYGSDFWKSVHFTDYSQHTQMVMALTLRCPLKLEAALCQRHDWHTLCKDLPNATARESDGWYVLEKVDLHPQLCFKFSFGNSSHVECPHQTGSLTSWNVSMDTQAQQLILHFSSRMHATFSAAWSLPGLGQDTLVPPVYTVSQARGSSPVSLDLIIPFLRPGCCVLVWRSDVQFAWKHLLCPDVSYRHLGLLILALLALLTLLGVVLALTCRRPQSGPGPARPVLLLHAADSEAQRRLVGALAELLRAALGGGRDVIVDLWEGRHVARVGPLPWLWAARTRVAREQGTVLLLWSGADLRPVSGPDPRAAPLLALLHAAPRPLLLLAYFSRLCAKGDIPPPLRALPRYRLLRDLPRLLRALDARPFAEATSWGRLGARQRRQSRLELCSRLEREAARLADLG

SEQ ID NO: 6926 - protein, 533 aa, Homo Sapiens
MGSSRLAALLLPLLLIVIDLSDSAGIGFRHLPHWNTRCPLASHTDDSFTGSSAYIPCRTWWALFSTKPWCVRVWHCSRCLCQHLLSGGSGLQRGLFHLLVQKSKKSSTFKFYRRHKMPAPAQRKLLPRRHLSEKSHHISIPSPDISHKGLRSKRTQPSDPETWESLPRLDSQRHGGPEFSFDLLPEARAIRVTISSGPEVSVRLCHQWALECEELSSPYDVQKIVSGGHTVELPYEFLLPCLCIEASYLQEDTVRRKKCPFQSWPEAYGSDFWKSVHFTDYSQHTQMVMALTLRCPLKLEAALCQRHDWHTLCKDLPNATARESDGWYVLEKVDLHPQLCFKFSFGNSSHVECPHQTGSLTSWNVSMDTQAQQLILHFSSRMHATFSAAWSLPGLGQDTLVPPVYTVSQARGSSPVSLDLIIPFLRPGCCVLLHASLSSPGGEDAWLIGVGGSVPSGVAVRCPVCLEAPLVSGCLLQTPGALDPGTAGPPHPTGCCSGPHLPAPTVRPGPSAASAPPARGGLGGAAAPGGSAG

SEQ ID NO: 6927 - protein, 186 aa, Homo Sapiens
MGSSRLAALLLPLLLIVIDLSDSAGIGFRHLPHWNTRCPLASHTEVLPISLAAPGGPSSPQSLGVCESGTVPAVCASICCQVAQVFNGASSTSWCRNPKSLPHSSSIGDTRCQHLLRGSCCLVVTCLRRAITFPSPPQTSPTRDFALKGPNLRIQRHGKVFPDWTHKGMEDPSSPLICCLRPGLFG

SEQ ID NO: 6928 - protein, 190 aa, Homo Sapiens
MGSSRLAALLLPLLLIVIDLSDSAGIGFRHLPHWNTRCPLASHTRKLLPRRHLSEKSHHISIPSPDISHKGLRSKRTQPSDPETWESLPRLDSQRHGGPEFSFDLLPEARAIRVTISSGPEVSVRLCHQWALECEELSSPYDVQKIVSGGHTVELPYEFLLPCLCIEMARTSGSQCTSLTTASTLRWSWP

SEQ ID NO: 6929 - protein, 146 aa, Homo Sapiens
MGSSRLAALLLPLLLIVIDLSDSAGIGFRHLPHWNTRCPLASHTVFNGASSTSWCRNPKSLPHSSSIGDTRCQHLLRGSCCLVVTCLRRAITFPSPPQTSPTRDFALKGPNLRIQRHGKVFPDWTHKGMEDPSSPLICCLRPGLFG

SEQ ID NO: 6930 - protein, 700 aa, Homo Sapiens
MLAPFLLLLTHSRSPLSFRPCSHVPGALIAQKPMGSSRLAALLLPLLLIVIDLSDSAGIGFRHLPHWNTRCPLASHTDDSFTGSSAYIPCRTWWALFSTKPWCVRVWHCSRCLCQHLLSGGSGLQRGLFHLLVQKSKKSSTFKFYRRHKMPAPAQRKLLPRRHLSEKSHHISIPSPDISHKGLRSKRTQPSDPETWESLPRLDSQRHGGPEFSFDLLPEARAIRVTISSGPEVSVRLCHQWALECEELSSPYDVQKIVSGGHTVELPYEFLLPCLCIEASYLQEDTVRRKKCPFQSWPEAYGSDFWKSVHFTDYSQHTQMVMALTLRCPLKLEAALCQRHDWHTLCKDLPNATARESDGWYVLEKVDLHPQLCFKFSFGNSSHVECPHQTGSLTSWNVSMDTQAQQLILHFSSRMHATFSAAWSLPGLGQDTLVPPVYTVSQARGSSPVSLDLIIPFLRPGCCVLVWRSDVQFAWKHLLCPDVSYRHLGLLILALLALLTLLGVVLALTCRRPQSGPGPARPVLLLHAADSEAQRRLVGALAELLRAALGGGRDVIVDLWEGRHVARVGPLPWLWAARTRVAREQGTVLLLWSGADLRPVSGPDPRAAPLLALLHAAPRPLLLLAYFSRLCAKGDIPPPLRALPRYRLLRDLPRLLRALDARPFAEATSWGRLGARQRRQSRLELCSRLEREAARLADLG

SEQ ID NO: 6931 - protein, 194 aa, Homo Sapiens
MTMRHNWTPDLSPLWVLLLCAHVVTLLVRATPVSQTTTAATASVRSTKDPCPSQPPVFPAAKQCPALEVTWPEVEVPLNGTLSLSCVACSRFPNFSILYWLGNGSFIEHLPGRLWEGSTSRERGSTGTQLCKALVLEQLTPALHSTNFSCVLVDPEQVVQRHVVLAQLWAGLRATLPPTQEALPSSHSSPQQQG

SEQ ID NO: 6932 - protein, 194 aa, Homo Sapiens; identical to SEQ ID NO: 6931

SEQ ID NO: 6933 - protein, 194 aa, Homo Sapiens; identical to SEQ ID NO: 6931

SEQ ID NO: 6934 - protein, 194 aa, Homo Sapiens; identical to SEQ ID NO: 6931

SEQ ID NO: 6935 - protein, 194 aa, Homo Sapiens; identical to SEQ ID NO: 6931

SEQ ID NO: 6936 - protein, 194 aa, Homo Sapiens; identical to SEQ ID NO: 6931

SEQ ID NO: 6937 - protein, 199 aa, Homo Sapiens
MTMRHNWTPDLSPLWVLLLCAHVVTLLVRATPVSQTTTAATASVRSTKDPCPSQPPVFPAAKQCPALEVTWPEVEVPLNGTLSLSCVACSRFPNFSILYWLGNGSFIEHLPGRLWEGSTSRERGSTGTQLCKALVLEQLTPALHSTNFSCVLVDPEQVVQRHVVLAQLWVRSPRRGLQEQEELCFHMWGGKGGLCQSSL

SEQ ID NO: 6938 - protein, 199 aa, Homo Sapiens; identical to SEQ ID NO: 6937

SEQ ID NO: 6939 - protein, 163 aa, Homo Sapiens
MTMRHNWTPDLSPLWVLLLCAHVVTLLVRATPVSQTTTAATASVRSTKDPCPSQPPVFPAAKQCPALEVTWPEVEVPLNGTLSLSCVACSRFPNFSILYWLGNGSFIEHLPGRLWEGSTSRERGSTGWAEGNLAPHPRSPALQPQQSTAAGLRLSTGPAAAQP

SEQ ID NO: 6940 - protein, 163 aa, Homo Sapiens; identical to SEQ ID NO: 6939

SEQ ID NO: 6941 - protein, 115 aa, Homo Sapiens
MTMRHNWTPDLSPLWVLLLCAHVVTLLVRATPVSQTTTAATASVRSTKDPCPSQPPVFPAAKQCPALEVTWPEVEVPLSWAEGNLAPHPRSPALQPQQSTAAGLRLSTGPAAAQP

SEQ ID NO: 6942 - protein, 170 aa, Homo Sapiens
MNCRELPLTLWVLISVSTAESCTSRPHITVVEGEPFYLKHCSCSLAHEIETTTKSWYKSSGSQEHVELNPRSSSRIALHDCVLEFWPVELNDTGSYFFQMKNYTQKWKLNVIRRNKHSCFTERQVTSKIVEVKKFFQITCENSYYQTLVNSTSLYKIGPPICRKTSSGLH

SEQ ID NO: 6943 - protein, 541 aa, Homo Sapiens
MNCRELPLTLWVLISVSTAESCTSRPHITVVEGEPFYLKHCSCSLAHEIETTTKSWYKSSGSQEHVELNPRSSSRIALHDCVLEFWPVELNDTGSYFFQMKNYTQKWKLNVIRRNKHSCFTERQVTSKIVEVKKFFQITCENSYYQTLVNSTSLYKNCKKLLLENNKNPTIKKNAEFEDQGYYSCVHFLHHNGKLFNITKTFNITIVEDRSNIVPVLLGPKLNHVAVELGKNVRLNCSALLNEEDVIYWMFGEENGSDPNIHEEKEMRIMTPEGKWHASKVLRIENIGESNLNVLYNCTVASTGGTDTKSFILVRKADMADIPGHVFTRGMIIAVLILVAVVCLVTVCVIYRVDLVLFYRHLTRRDETLTDGKTYDAFVSYLKECRPENGEEHTFAVEILPRVLEKHFGYKLCIFERDVVPGGAVVDEIHSLIEKSRRLIIVLSKSYMSNEVRYELESGLHEALVERKIKIILIEFTPVTDFTFLPQSLKLLKSHRVLKWKADKSLSYNSRFWKNLLYLMPAKTVKPGRDEPEVLPVLSES

SEQ ID NO: 6944 - protein, 541 aa, Homo Sapiens; identical to SEQ ID NO: 6943

SEQ ID NO: 6945 - protein, 541 aa, Homo Sapiens; identical to SEQ ID NO: 6943

SEQ ID NO: 6946 - protein, 457 aa, Homo Sapiens
MILEVKPQTNASCEYSASHKQDLLLGSTGSISCPSLSCQSDAQSPAVTWYKNGKLLSVERSNRIVVDEVYDYHQGTYVCDYTQSDTVSSWTVRAVVQVRTIVGDTKLKPDILDPVEDTLEVELGKPLTISCKARFGFERVFNPVIKWYIKDSDLEWEVSVPEAKSIKSTLKDEIIERNIILEKVTQRDLRRKFVCFVQNSIGNTTQSVQLKEKRGVVLLYILLGTIGTLVAVLAASALLYRHWIEIVLLYRTYQSKDQTLGDKKDFDAFVSYAKWSSFPSEATSSLSEEHLALSLFPDVLENKYGYSLCLLERDVAPGGVYAEDIVSIIKRSRRGIFILSPNYVNGPSIFELQAAVNLALDDQTLKLILIKFCYFQEPESLPHLVKKALRVLPTVTWRGLKSVPPNSRFWAKMRYHMPVKNSQGFTWNQLRITSRIFQWKGLSRTETTGRSSQPKEW

SEQ ID NO: 6947 - protein, 44 aa, Homo Sapiens
MLCLGWIFLWLVAGERIKGFNISGCSTKKLLWTYSTRSEEEFVL

SEQ ID NO: 6948 - protein, 599 aa, Homo Sapiens
MLCLGWIFLWLVAGERIKGFNISGCSTKKLLWTYSTRSEEEFVLFCDLPEPQKSHFCHRNRLSPKQVPEHLPFMGSNDLSDVQWYQQPSNGDPLEDIRKSYPHIIQDKCTLHFLTPGVNNSGSYICRPKMIKSPYDVACCVKMILEVKPQTNASCEYSASHKQDLLLGSTGSISCPSLSCQSDAQSPAVTWYKNGKLLSVERSNRIVVDEVYDYHQGTYVCDYTQSDTVSSWTVRAVVQVRTIVGDTKLKPDILDPVEDTLEVELGKPLTISCKARFGFERVFNPVIKWYIKDSDLEWEVSVPEAKSIKSTLKDEIIERNIILEKVTQRDLRRKFVCFVQNSIGNTTQSVQLKEKRGVVLLYILLGTIGTLVAVLAASALLYRHWIEIVLLYRTYQSKDQTLGDKKDFDAFVSYAKWSSFPSEATSSLSEEHLALSLFPDVLENKYGYSLCLLERDVAPGGVYAEDIVSIIKRSRRGIFILSPNYVNGPSIFELQAAVNLALDDQTLKLILIKFCYFQEPESLPHLVKKALRVLPTVTWRGLKSVPPNSRFWAKMRYHMPVKNSQGFTWNQLRITSRIFQWKGLSRTETTGRSSQPKEW

SEQ ID NO: 6949 - protein, 215 aa, Homo Sapiens
MCTEGAFPHRSACSLPLTHVHTHIHVCVPVLWGSVPRGMKLQCVSLWLLGTILILCSVDNHGLRRCLISTDMHHIEESFQEIKRAIQAKDTFPNVTILSTLETLQIIKPLDVCCVTKNLLAFYVDRVFKDHQEPNPKILRKISSIANSFLYMQKTLRQCQEQRQCHCRQEATNATRVIHDNYDQLEVHAAAIKSLGELDVFLAWINKNHEVMFSA

SEQ ID NO: 6950 - protein, 177 aa, Homo Sapiens
MKLQCVSLWLLGTILILCSVDNHGLRRCLISTDMHHIEESFQEIKRAIQAKDTFPNVTILSTLETLQIIKPLDVCCVTKNLLAFYVDRVFKDHQEPNPKILRKISSIANSFLYMQKTLRQCQEQRQCHCRQEATNATRVIHDNYDQLEVHAAAIKSLGELDVFLAWINKNHEVMFSA

SEQ ID NO: 6951 - protein, 177 aa, Homo Sapiens; identical to SEQ ID NO: 6950

SEQ ID NO: 6952 - protein, 298 aa, Homo Sapiens
MEFFKNENNELPKLQWYKDCKPLLLDNIHFSGVKDRLIVMNVAEKHRGNYTCHASYTYLGKQYPITRVIEFITLEENKPTRPVIVSPANETMEVDLGSQIQLICNVTGQLSDIAYWKWNGSVIDEDDPVLGEDYYSVENPANKRRSTLITVLNISEIESRFYKHPFTCFAKNTHGIDAAYIQLIYPVTNFQKHMIGICVTLTVIIVCSVFIYKIFKIDIVLWYRDSCYDFLPIKASDGKTYDAYILYPKTVGEGSTSDCDIFVFKVLPEVLEKQCGYKLFIYGRDDYVGEDIVEVINE

SEQ ID NO: 6953 - protein, 80 aa, Homo Sapiens
MKVLLRLICFIALLISSLEADKCKEREEKIILVSSANEIDVRPCPLNPNEHKGTITWYKDDSKTPVSTEQASRIHQHKEK

SEQ ID NO: 6954 - protein, 119 aa, Homo Sapiens
MKVLLRLICFIALLISSLEADKCKEREEKIILVSSANEIDVRPCPLNPNEHKGTITWYKDDSKTPVSTEQASRIHQHKEKLWFVPAKVEDSGHYYCVVRIANLYFLTIYTLVESKIGSS

SEQ ID NO: 6955 - protein, 106 aa, Homo Sapiens
MKVLLRLICFIALLISSLEADKCKEREEKIILVSSANEIDVRPCPLNPNEHKGTITWYKDDSKTPVSTEQASRIHQHKEKLWFVPAKVEDSGHYYCVVRNSSYCLR

SEQ ID NO: 6956 - protein, 114 aa, Homo Sapiens
MKVLLRLICFIALLISSLEADKCKEREEKIILVSSANEIDVRPCPLNPNEHKGTITWYKDDSKTPVSTEQASRIHQHKEKLWFVPAKVEDSGHYYCVVRNSSYCLRIKISAKFV

SEQ ID NO: 6957 - protein, 182 aa, Homo Sapiens
MKVLLRLICFIALLISSLEADKCKEREEKIILVSSANEIDVRPCPLNPNEHKGTITWYKDDSKTPVSTEQASRIHQHKEKLWFVPAKVEDSGHYYCVVRNSSYCLRIKISAKFVENEPNLCYNAQAIFKQKLPVAGDGGLVCPYMEFFKNENNELPKLQWYKDCKPLLLDNIHFSGVKDRLI

SEQ ID NO: 6958 - protein, 447 aa, Homo Sapiens
MKVLLRLICFIALLISSLEADKCKEREEKIILVSSANEIDVRPCPLNPNEHKGTITWYKDDSKTPVSTEQASRIHQHKEKLWFVPAKVEDSGHYYCVVRNSSYCLRIKISAKFVENEPNLCYNAQAIFKQKLPVAGDGGLVCPYMEFFKNENNELPKLQWYKDCKPLLLDNIHFSGVKDRLIVMNVAEKHRGNYTCHASYTYLGKQYPITRVIEFITLEENKPTRPVIVSPANETMEVDLGSQIQLICNVTGQLSDIAYWKWNGSVIDEDDPVLGEDYYSVENPANKRRSTLITVLNISEIESRFYKHPFTCFAKNTHGIDAAYIQLIYPVTNFQKHMIGICVTLTVIIVCSVFIYKIFKIDIVLWYRDSCYDFLPIKASDGKTYDAYILYPKTVGEGSTSDCDIFVFKVLPEVLEKQCGYKLFIYGRDDYVGEGMCVMEQSKGLLL

SEQ ID NO: 6959 - protein, 447 aa, Homo Sapiens; identical to SEQ ID NO: 6958

SEQ ID NO: 6960 - protein, 538 aa, Homo Sapiens
MKVLLRLICFIALLISSLEADKCKEREEKIILVSSANEIDVRPCPLNPNEHKGTITWYKDDSKTPVSTEQASRIHQHKEKLWFVPAKVEDSGHYYCVVRNSSYCLRIKISAKFVENEPNLCYNAQAIFKQKLPVAGDGGLVCPYMEFFKNENNELPKLQWYKDCKPLLLDNIHFSGVKDRLIVMNVAEKHRGNYTCHASYTYLGKQYPITRVIEFITLEENKPTRPVIVSPANETMEVDLGSQIQLICNVTGQLSDIAYWKWNGSVIDEDDPVLGEDYYSVENPANKRRSTLITVLNISEIESRFYKHPFTCFAKNTHGIDAAYIQLIYPVTNFQKHMIGICVTLTVIIVCSVFIYKIFKIDIVLWYRDSCYDFLPIKVLPEVLEKQCGYKLFIYGRDDYVGEDIVEVINENVKKSRRLIIILVRETSGFSWLGGSSEEQIAMYNALVQDGIKVVLLELEKIQDYEKMPESIKFIKQKHGAIRWSGDFTQGPQSAKTRFWKNVRYHMPVQRRSPSSKHQLLSPATKEKLQREAHVPLG

SEQ ID NO: 6961 - protein, 447 aa, Homo Sapiens; identical to SEQ ID NO: 6958

SEQ ID NO: 6962 - protein, 569 aa, Homo Sapiens
MKVLLRLICFIALLISSLEADKCKEREEKIILVSSANEIDVRPCPLNPNEHKGTITWYKDDSKTPVSTEQASRIHQHKEKLWFVPAKVEDSGHYYCVVRNSSYCLRIKISAKFVENEPNLCYNAQAIFKQKLPVAGDGGLVCPYMEFFKNENNELPKLQWYKDCKPLLLDNIHFSGVKDRLIVMNVAEKHRGNYTCHASYTYLGKQYPITRVIEFITLEENKPTRPVIVSPANETMEVDLGSQIQLICNVTGQLSDIAYWKWNGSVIDEDDPVLGEDYYSVENPANKRRSTLITVLNISEIESRFYKHPFTCFAKNTHGIDAAYIQLIYPVTNFQKHMIGICVTLTVIIVCSVFIYKIFKIDIVLWYRDSCYDFLPIKASDGKTYDAYILYPKTVGEGSTSDCDIFVFKVLPEVLEKQCGYKLFIYGRDDYVGEDIVEVINENVKKSRRLIIILVRETSGFSWLGGSSEEQIAMYNALVQDGIKVVLLELEKIQDYEKMPESIKFIKQKHGAIRWSGDFTQGPQSAKTRFWKNVRYHMPVQRRSPSSKHQLLSPATKEKLQREAHVPLG

SEQ ID NO: 6963 - protein, 173 aa, Homo Sapiens
MKVLLRLICFIALLISSLEADKCKEREEKIILVSSANEIDVRPCPLNPNEHKGTITWYKDDSKTPVSTEQASRIHQHKEKLWFVPAKVEDSGHYYCVVRNSSYCLRIKISAKFVENEPNLCYNAQAIFKQKLPVAGDGGLVCPYMEFFKNENNELPKLQWYKVAVSRVWATAL

SEQ ID NO: 6964 - protein, 124 aa, Homo Sapiens
  misc_feature (1)..(1): Xaa can be any naturally occurring amino acid
XKCKEREEKIILVSSANEIDVRPCPLNPNEHKGTITWYKDDSKTPVSTEQASRIHQHKEKLWFVPAKVEDSGHYYCVETEDLCALIWSFLKMKIMSYLNYSGIRIANLYFLTIYTLVESKIGSS

SEQ ID NO: 6965 - protein, 229 aa, Homo Sapiens
MLRLYVLVMGVSAFTLQPAAHTGAARSCRFRGRHYKREFRLEGEPVALRCPQVPYWLWASVSPRINLTWHKNDSARTVPGEEETRMWAQDGALWLLPALQEDSGTYVCTTRNASYCDKMSIELRVFENTDAFLPFISYPQILTLSTSGVLVCPDLSEFTRDKTDVKIQWYKDSLLLDKDNEKFLSVRGTTHLLVHDVALEDAGYYRCVLTFAHEGQQYNITRSIELRIK

SEQ ID NO: 6966 - protein, 398 aa, Homo Sapiens
MLRLYVLVMGVSAFTLQPAAHTGAARSCRFRGRHYKREFRLEGEPVALRCPQVPYWLWASVSPRINLTWHKNDSARTVPGEEETRMWAQDGALWLLPALQEDSGTYVCTTRNASYCDKMSIELRVFENTDAFLPFISYPQILTLSTSGVLVCPDLSEFTRDKTDVKIQWYKDSLLLDKDNEKFLSVRGTTHLLVHDVALEDAGYYRCVLTFAHEGQQYNITRSIELRIKKKKEETIPVIISPLKTISASLGSRLTIPCKVFLGTGTPLTTMLWWTANDTHIESAYPGGRVTEGPRQEYSENNENYIEVPLIFDPVTREDLHMDFKCVVHNTLSFQTLRTTVKEASSTFSWGIVLAPLSLAFLVLGGIWMHRRCKHRTGKADGLTVLWPHHQDFQSYPK

SEQ ID NO: 6967 - protein, 398 aa, Homo Sapiens; identical to SEQ ID NO: 6966

SEQ ID NO: 6968 - protein, 296 aa, Homo Sapiens
MLRLYVLVMGVSAFTLQPAAHTGAARSCRFRGRHYKREFRLEGEPVALRCPQVPYWLWASVSPRINLTWHKNDSARTVPGEEETRMWAQDGALWLLPALQEDSGTYVCTTRNASYCDKMSIELRVFENTDAFLPFISYPQILTLSTSGVLVCPDLSEFTRDKTDVKIQWYKDSLLLDKDNEKFLSVRGTTHLLVHDVALEDAGYYRCVLTFAHEGQQYNITRSIELRIKKKKEETIPVIISPLKTISASLGSRLTIPCKVFLGTGTPLTTMLWWTANDTHIESAYPGGRVTEGPRQ

SEQ ID NO: 6969 - protein, 215 aa, Homo Sapiens
MKLPVHKLYIEYGIQRITCPNVDGYFPSSVKPTITWYMGCYKIQNFNNVIPEGMNLSFLIALISNNGNYTCVVTYPENGRTFHLTRTLTVKVVGSPKNAVPPVIHSPNDHVVYEKEPGEELLIPCTVYFSFLMDSRNEVWWTIDGKKPDDITIDVTINESISHSRTEDETRTQILSIKKVTSEDLKRSYVCHARSAKGEVAKAAKVKQKGNRCGQ

SEQ ID NO: 6970 - protein, 113 aa, Homo Sapiens
MTLLWCVVSLYFYGILQSDASERCDDWGLDTMRQIQVFEDEPARIKCPLFEHFLKFNYSTAHSAGLTLIWYWTRQDRDLEEPINFRLPENRISKEKDVLWFRPTLLNDTGNYT

SEQ ID NO: 6971 - protein, 145 aa, Homo Sapiens
MTLLWCVVSLYFYGILQSDASERCDDWGLDTMRQIQVFEDEPARIKCPLFEHFLKFNYSTAHSAGLTLIWYWTRQDRDLEEPINFRLPENRISKEKDVLWFRPTLLNDTGNYTCMLRNTTYCSKVAFPLEVVQKDSCFNSPMKLP

SEQ ID NO: 6972 - protein, 570 aa, Homo Sapiens
MTLLWCVVSLYFYGILQSDASERCDDWGLDTMRQIQVFEDEPARIKCPLFEHFLKFNYSTAHSAGLTLIWYWTRQDRDLEEPINFRLPENRISKEKDVLWFRPTLLNDTGNYTCMLRNTTYCSKVAFPLEVVQKDSCFNSPMKLPVHKLYIEYGIQRITCPNVDGYFPSSVKPTITWYMGCYKIQNFNNVIPEGMNLSFLIALISNNGNYTCVVTYPENGRTFHLTRTLTVKVVGSPKNAVPPVIHSPNDHVVYEKEPGEELLIPCTVYFSFLMDSRNEVWWTIDGKKPDDITIDVTINESISHSRTEDETRTQILSIKKVTSEDLKRSYVCHARSAKGEVAKAAKVKQKVPAPRYTVELACGFGATVLLVVILIVVYHVYWLEMVLFYRAHFGTDETILDGKEYDIYVSYARNAEEEEFVLLTLRGVLENEFGYKLCIFDRDSLPGGIVTDETLSFIQKSRRLLVVLSPNYVLQGTQALLELKAGLENMASRGNINVILVQYKAVKETKVKELKRAKTVLTVIKWKGEKSKYPQGRFWKQLQVAMPVKKSPRRSSSDEQGLSYSSLKNV

SEQ ID NO: 6973 - protein, 346 aa, Homo Sapiens
MTLLWCVVSLYFYGILQSDASERCDDWGLDTMRQIQVFEDEPARIKCPLFEHFLKFNYSTAHSAGLTLIWYWTRQDRDLEEPINFRLPENRISKEKDVLWFRPTLLNDTGNYTCMLRNTTYCSKVAFPLEVVQKDSCFNSPMKLPVHKLYIEYGIQRITCPNVDGYFPSSVKPTITWYMGCYKIQNFNNVIPEGMNLSFLIALISNNGNYTCVVTYPENGRTFHLTRTLTVKVVGSPKNAVPPVIHSPNDHVVYEKEPGEELLIPCTVYFSFLMDSRNEVWWTIDGKKPDDITIDVTINESASSKIHSGTGLWFWSHSPASGDSHCCLPCLLARDGPILPGSFWNR

SEQ ID NO: 6974 - protein, 687 aa, Homo Sapiens
MTLLWCVVSLYFYGILQSDASERCDDWGLDTMRQIQVFEDEPARIKCPLFEHFLKFNYSTAHSAGLTLIWYWTRQDRDLEEPINFRLPENRISKEKDVLWFRPTLLNDTGNYTCMLRNTTYCSKVAFPLEVVQKDSCFNSPMKLPVHKLYIEYGIQRITCPNVDGYFPSSVKPTITWYMGCYKIQNFNNVIPEGMNLSFLIALISNNGNYTCVVTYPENGRTFHLTRTLTVKVVGSPKNAVPPVIHSPNDHVVYEKEPGEELLIPCTVYFSFLMDSRNEVWWTIDGKKPDDITIDVTINESISHSRTEDETRTQILSIKKVTSEDLKRSYVCHARSAKGEVAKAAKVKQKVPAPRYTVELACGFGATVLLVVILIVVYHVYWLEMVLFYRAHFGTDETILDGKEYDIYVSYARNAEEEEFVLLTLRGVLENEFGYKLCIFDRDSLPGGNTVEAVFDFIQRSRRMIVVLSPDYVTEKSISMLEFKLGVMCQNSIATKLIVVEYRPLEHPHPGILQLKESVSFVSWKGEKSKHSGSKFWKALRLALPLRSLSASSGWNESCSSQSDISLDHVQRRRSRLKEPPELQSSERAAGSPPAPGTMSKHRGKSSATCRCCVTYCEGENHLRNKSRAEIHNQPQWETHLCKPVPQESETQWIQNGTRLEPPAPQISALALHHFTDLSNNNDFYIL

SEQ ID NO: 6975 - protein, 570 aa, Homo Sapiens; identical to SEQ ID NO: 6972

SEQ ID NO: 6976 - protein, 687 aa, Homo Sapiens; identical to SEQ ID NO: 6974

SEQ ID NO: 6977 - protein, 356 aa, Homo Sapiens
MTLLWCVVSLYFYGILQSDASERCDDWGLDTMRQIQVFEDEPARIKCPLFEHFLKFNYSTAHSAGLTLIWYWTRQDRDLEEPINFRLPENRISKEKDVLWFRPTLLNDTGNYTCMLRNTTYCSKVAFPLEVVQKDSCFNSPMKLPVHKLYIEYGIQRITCPNVDGYFPSSVKPTITWYMGCYKIQNFNNVIPEGMNLSFLIALISNNGNYTCVVTYPENGRTFHLTRTLTVKVVGSPKNAVPPVIHSPNDHVVYEKEPGEELLIPCTVYFSFLMDSRNEVWWTIDGKKPDDITIDVTINESISHSRTEDETRTQILSIKKVTSEDLKRSYVCHARSAKGEVAKAAKVKQKGNRCGQ

SEQ ID NO: 6978 - protein, 356 aa, Homo Sapiens; identical to SEQ ID NO: 6977

SEQ ID NO: 6979 - protein, 346 aa, Homo Sapiens; identical to SEQ ID NO: 6973

SEQ ID NO: 6980 - protein, 570 aa, Homo Sapiens; identical to SEQ ID NO: 6972

SEQ ID NO: 6981 - protein, 570 aa, Homo Sapiens; identical to SEQ ID NO: 6972

SEQ ID NO: 6982 - protein, 193 aa, Homo Sapiens
  misc_feature (1)..(1): Xaa can be any naturally occurring amino acid
XFIHIGTSKHIEVKTQGCYKIQNFNNVIPEGMNLSFLIALISNNGNYTCVVTYPENGRTFHLTRTLTVKVVGSPKNAVPPVIHSPNDHVVYEKEPGEELLIPCTVYFSFLMDSRNEVWWTIDGKKPDDITIDVTINESISHSRTEDETRTQILSIKKVTSEDLKRSYVCHARSAKGEVAKAAKVKQKGNRCGQ

SEQ ID NO: 6983 - protein, 38 aa, Homo Sapiens
MGFWILAILTILMYSTAAKFSKQSWGLENEALIVRCPR

SEQ ID NO: 6984 - protein, 556 aa, Homo Sapiens
MGFWILAILTILMYSTAAKFSKQSWGLENEALIVRCPRQGKPSYTVDWYYSQTNKSIPTQERNRVFASGQLLKFLPAAVADSGIYTCIVRSPTFNRTGYANVTIYKKQSDCNVPDYLMYSTVSGSEKNSKIYCPTIDLYNWTAPLEWFKNCQALQGSRYRAHKSFLVIDNVMTEDAGDYTCKFIHNENGANYSVTATRSFTVKDEQGFSLFPVIGAPAQNEIKEVEIGKNANLTCSACFGKGTQFLAAVLWQLNGTKITDFGEPRIQQEEGQNQSFSNGLACLDMVLRIADVKEEDLLLQYDCLALNLHGLRRHTVRLSRKNPIDHHSIYCIIAVCSVFLMLINVLVIILKMFWIEATLLWRDIAKPYKTRNDGKLYDAYVVYPRNYKSSTDGASRVEHFVHQILPDVLENKCGYTLCIYGRDMLPGEDVVTAVETNIRKSRRHIFILTPQITHNKEFAYEQEVALHCALIQNDAKVILIEMEALSELDMLQAEALQDSLQHLMKVQGTIKWREDHIANKRSLNSKFWKHVRYQMPVPSKIPRKASSLTPLAAQKQ

SEQ ID NO: 6985 - protein, 328 aa, Homo Sapiens
MGFWILAILTILMYSTAAKFSKQSWGLENEALIVRCPRQGKPSYTVDWYYSQTNKSIPTQERNRVFASGQLLKFLPAAVADSGIYTCIVRSPTFNRTGYANVTIYKKQSDCNVPDYLMYSTVSGSEKNSKIYCPTIDLYNWTAPLEWFKNCQALQGSRYRAHKSFLVIDNVMTEDAGDYTCKFIHNENGANYSVTATRSFTVKDEQGFSLFPVIGAPAQNEIKEVEIGKNANLTCSACFGKGTQFLAAVLWQLNGTKITDFGEPRIQQEEGQNQSFSNGLACLDMVLRIADVKEEDLLLQYDCLALNLHGLRRHTVRLSRKNPSKECF

SEQ ID NO: 6986 - protein, 314 aa, Homo Sapiens
MGFWILAILTILMYSTAAKFSKQSWGLENEALIVRCPRQGKPSYTVDWYYSQTNKSIPTQERNRVFASGQLLKFLPAAVADSGIYTCIVRSPTFNRTGYANVTIYKKQSDCNVPDYLMYSTVSGSEKNSKIYCPTIDLYNWTAPLEWFKNCQALQGSRYRAHKSFLVIDNVMTEDAGDYTCKFIHNENGANYSVTATRSFTVKDEQGFSLFPVIGAPAQNEIKEVEIGTQFLAAVLWQLNGTKITDFGEPRIQQEEGQNQSFSNGLACLDMVLRIADVKEEDLLLQYDCLALNLHGLRRHTVRLSRKNPSKECF

SEQ ID NO: 6987 - protein, 259 aa, Homo Sapiens
MGFWILAILTILMYSTAAKFSKQSWGLENEALIVRCPRQGKPSYTVDWYYSQTNKSIPTQERNRVFASGQLLKFLPAAVADSGIYTCIVRSPTFNRTGYANVTIYKKQSDCNVPDYLMYSTVSGSEKNSKIYCPTIDLYNWTAPLEWFKNCQALQGSRYRAHKSFLVIDNVMTEDAGDYTCKFIHNENGANYSVTATRSFTVKVWCQSFCKLKKSLIFSNTHWIQSLMRGFVMVYYGVHKCCRVVFNLCLQYFQHHQWP

SEQ ID NO: 6988 - protein, 211 aa, Homo Sapiens
MYSTVSGSEKNSKIYCPTIDLYNWTAPLEWFKNCQALQGSRYRAHKSFLVIDNVMTEDAGDYTCKFIHNENGANYSVTATRSFTVKDEQGFSLFPVIGAPAQNEIKEVEIGKNANLTCSACFGKGTQFLAAVLWQLNGTKITDFGEPRIQQEEGQNQSFSNGLACLDMVLRIADVKEEDLLLQYDCLALNLHGLRRHTVRLSRKNPSKECF

SEQ ID NO: 6989 - protein, 457 aa, Homo Sapiens
MTGLVSLSYFPLSTRSCALQSCSPVWGCGPCCSAGCPSPFHCLSQQDCNEIKGERFTVLETRLLVSNVSAEDRGNYACQAILTHSGKQYEVLNGITVSIKRAGYGGSVPKIIYPKNHSIEVQLGTTLIVDCNVTDTKDNTNLRCWRVNNTLVDDYYDESKRIREGVETHVSFREHNLYTVNITFLEVKMEDYGLPFMCHAGVSTAYIILQLPAPDFRAYLIGGLIALVAVAVSVVYIYNIFKIDIVLWYRSAFHSTETIVDGKLYDAYVLYPKPHKESQRHAVDALVLNILPEVLERQCGYKLFIFGRDEFPGQAVANVIDENVKLCRRLIVIVVPESLGFGLLKNLSEEQIAVYSALIQDGMKVILIELEKIEDYTVMPESIQYIKQKHGAIRWHGDFTEQSQCMKTKFWKTVRYHMPPRRCRPFPPVQLLQHTPCYRTAGPELGSRRKKCTLTTG

SEQ ID NO: 6990 - protein, 172 aa, Homo Sapiens
MWSLLLCGLSIALPLSVTADGCKDIFMKNEILSASQPFAFNCTFPPITSGEVSVTWYKNSSKIPVSKIIQSRIHQDETWILFLPMEWGDSGVYQCVIKGRDSCHRIHVNLTVFEKHWCDTSIGGLPNLSDEYKQILHLGKDDSLTCHLHFPKSCVLGPIKWYKDCNEIKGER

SEQ ID NO: 6991 - protein, 575 aa, Homo Sapiens
MWSLLLCGLSIALPLSVTADGCKDIFMKNEILSASQPFAFNCTFPPITSGEVSVTWYKNSSKIPVSKIIQSRIHQDETWILFLPMEWGDSGVYQCVIKGRDSCHRIHVNLTVFEKHWCDTSIGGLPNLSDEYKQILHLGKDDSLTCHLHFPKSCVLGPIKWYKDCNEIKGERFTVLETRLLVSNVSAEDRGNYACQAILTHSGKQYEVLNGITVSITERAGYGGSVPKIIYPKNHSIEVQLGTTLIVDCNVTDTKDNTNLRCWRVNNTLVDDYYDESKRIREGVETHVSFREHNLYTVNITFLEVKMEDYGLPFMCHAGVSTAYIILQLPAPDFRAYLIGGLIALVAVAVSVVYIYNIFKIDIVLWYRSAFHSTETIVDGKLYDAYVLYPKPHKESQRHAVDALVLNILPEVLERQCGYKLFIFGRDEFPGQAVANVIDENVKLCRRLIVIVVPESLGFGLLKNLSEEQIAVYSALIQDGMKVILIELEKIEDYTVMPESIQYIKQKHGAIRWHGDFTEQSQCMKTKFWKTVRYHMPPRRCRPFPPVQLLQHTPCYRTAGPELGSRRKKCTLTTG

SEQ ID NO: 6992 - protein, 180 aa, Homo Sapiens
MALADLYEEGGGGGGEGEDNADSKETICRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 6993 - protein, 159 aa, Homo Sapiens
MALETICRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 6994 - protein, 177 aa, Homo Sapiens
MEICRGLRSHLITLLLFLFHSETICRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 6995 - protein, 143 aa, Homo Sapiens
MQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 6996 - protein, 143 aa, Homo Sapiens; identical to SEQ ID NO: 6995

SEQ ID NO: 6997 - protein, 153 aa, Homo Sapiens
MYRMQLLSCIALSLALVTNSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 6998 - protein, 176 aa, Homo Sapiens
MKASSLAFSLLSAAFYLLWTPSTGLKTLNLGSCVIATNLQEIRNGFSEIRGSVQAKDGNIDIRILRRTESLQDTKPANRCCLLRHLLRLYLDRVFKNYQTPDHYTLRKISSLANSFLTIKKDLRLCHAHMTCHCGEEAMKKYSQILSHFEKLEPQAAVVKALGELDILLQWMEETE

SEQ ID NO: 6999 - protein, 176 aa, Homo Sapiens; identical to SEQ ID NO: 6998

SEQ ID NO: 7000 - protein, 151 aa, Homo Sapiens
MKASSLAFSLLSAAFYLLWTPSTGLKTLNLGSCVIATNLQEIRNGFSEIRGSVQAKDGNIDIRILRRTESLQDTKPANRCCLLRHLLRLYLDRVFKNYQTPDHYTLRKISSLANSFLTIKKDLRLCLEPQAAVVKALGELDILLQWMEETE

SEQ ID NO: 7001 - protein, 504 aa, Homo Sapiens
MKNVLQWTPPEGLQGVKVTYTVQYFIYGQKKWLNKSECRNINRTYCDLSAETSDYEHQYYAKVKAIWGTKCSKWAESGRFYPFLETQIGPPEVALTTDEKSISVVLTAPEKWKRNPEDLPVSMQQIYSNLKYNVSVLNTKSNRTWSQCVTNHTLVLTWLEPNTLYCVHVESFVPGPPRRAQPSEKQCARTLKDQSSEFKAKIIFWYVLPVSITVFLFSVMGYSIYRYIHVGKEKHPANLILIYGNEFDKRFFVPAEKIVINFITLNISDDSKISHQDMSLLGKSSDVSSLNDPQPSGNLRPPQEEEEVKHLGYASHLMEIFCDSEENTEGTSLTQQESLSRTIPPDKTVIEYEYDVRTTDICAGPEEQELSLQEEVSTQGTLLESQAALAVLGPQTLQYSYTPQLQDLDPLAQEHTDSEEGPEEEPSTTLVDWDPQTGRLCIPSLSSFDQDSEGCEPSEGDGLGEEGLLSRLYEEPAPDRPPGENETYLMQFMEEWGLYVQMEN

SEQ ID NO: 7002 - protein, 42 aa, Homo Sapiens
MRAPGRPALRPLPLPPLLLLLLAAPWGRAGYSRPLLGLWAKV

SEQ ID NO: 7003 - protein, 209 aa, Homo Sapiens
MRAPGRPALRPLPLPPLLLLLLAAPWGRAVPCVSGGLPKPANITFLSINMKNVLQWTPPEGLQGVKVTYTVQYFIYGQKKWLNKSECRNINRTYCDLSAETSDYEHQYYAKVKAIWGTKCSKWAESGRFYPFLETQIGPPEVALTTDEKSISVVLTAPEKWKRNPEDLPVSMQQIYSNLKYNVSVLNTKSNRTVSLKWNGAYIHVPLCS

SEQ ID NO: 7004 - protein, 553 aa, Homo Sapiens
MRAPGRPALRPLPLPPLLLLLLAAPWGRAVPCVSGGLPKPANITFLSINMKNVLQWTPPEGLQGVKVTYTVQYFIYGQKKWLNKSECRNINRTYCDLSAETSDYEHQYYAKVKAIWGTKCSKWAESGRFYPFLETQIGPPEVALTTDEKSISVVLTAPEKWKRNPEDLPVSMQQIYSNLKYNVSVLNTKSNRTWSQCVTNHTLVLTWLEPNTLYCVHVESFVPGPPRRAQPSEKQCARTLKDQSSEFKAKIIFWYVLPVSITVFLFSVMGYSIYRYIHVGKEKHPANLILIYGNEFDKRFFVPAEKIVINFITLNISDDSKISHQDMSLLGKSSDVSSLNDPQPSGNLRPPQEEEEVKHLGYASHLMEIFCDSEENTEGTSLTQQESLSRTIPPDKTVIEYEYDVRTTDICAGPEEQELSLQEEVSTQGTLLESQAALAVLGPQTLQYSYTPQLQDLDPLAQEHTDSEEGPEEEPSTTLVDWDPQTGRLCIPSLSSFDQDSEGCEPSEGDGLGEEGLLSRLYEEPAPDRPPGENETYLMQFMEEWGLYVQMEN

SEQ ID NO: 7005 - protein, 89 aa, Homo Sapiens
MSYNGLHQRVFKELKLLTLCSISSPEKWKRNPEDLPVSMQQIYSNLKYNVSVLNTKSNRTWSQCVTNHTLVLTWLEPNTLYCVHVESFV

SEQ ID NO: 7006 - protein, 177 aa, Homo Sapiens
MSYNGLHQRVFKELKLLTLCSISSQIGPPEVALTTDEKSISVVLTAPEKWKRNPEDLPVSMQQIYSNLKYNVSVLNTKSNRTWSQCVTNHTLVLTWLEPNTLYCVHVESFVPGPPRRAQPSEKQCARTLKDQSSEFKAKIIFWYVLPVSITVFLFSVMGYSIYRYIHVGKEKHPANL

SEQ ID NO: 7007 - protein, 442 aa, Homo Sapiens
MSYNGLHQRVFKELKLLTLCSISSQIGPPEVALTTDEKSISVVLTAPEKWKRNPEDLPVSMQQIYSNLKYNVSVLNTKSNRTWSQCVTNHTLVLTWLEPNTLYCVHVESFVPGPPRRAQPSEKQCARTLKDQSSEFKAKIIFWYVLPVSITVFLFSVMGYSIYRYIHVGKEKHPANLILIYGNEFDKRFFVPAEKIVINFITLNISDDSKISHQDMSLLGKSSDVSSLNDPQPSGNLRPPQEEEEVKHLGYASHLMEIFCDSEENTEGTSLTQQESLSRTIPPDKTVIEYEYDVRTTDICAGPEEQELSLQEEVSTQGTLLESQAALAVLGPQTLQYSYTPQLQDLDPLAQEHTDSEEGPEEEPSTTLVDWDPQTGRLCIPSLSSFDQDSEGCEPSEGDGLGEEGLLSRLYEEPAPDRPPGENETYLMQFMEEWGLYVQMEN

SEQ ID NO: 7008 - protein, 162 aa, Homo Sapiens
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 7009 - protein, 153 aa, Homo Sapiens
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKVSTLSFI

SEQ ID NO: 7010 - protein, 179 aa, Homo Sapiens
MAALQKSVSSFLMGTLATSCLLLLALLVQGGAAAPISSHCRLDKSNFQQPYITNRTFMLAKEASLADNNTDVRLIGEKLFHGVSMSERCYLMKQVLNFTLEEVLFPQSDRFQPYMQEVVPFLARLSNRLSTCHIEGDDLHIQRNVQKLKDTVKKLGESGEIKAIGELDLLFMSLRNACI

SEQ ID NO: 7011 - protein, 179 aa, Homo Sapiens; identical to SEQ ID NO: 7010

SEQ ID NO: 7012 - protein, 263 aa, Homo Sapiens
MMPKHCFLGFLISFFLTGVAGTQSTHESLKPQRVQFQSRNFHNILQWQPGRALTGNSSVYFVQYKIMFSCSMKSSHQKPSGCWQHISCNFPGCRTLAKYGQRQWKNKEDCWGTQELSCDLTSETSDIQEPYYGRVRAASAGSYSEWSMTPRFTPWWETKIDPPVMNITQVNGSLLVILHAPNLPYRYQKEKNVSIEDYYELLYRVFIINNSLEKEQKVYEGAHRAVEIEALTPHSSYCVVAEIYQPMLDRRSQRSEERCVEIP

SEQ ID NO: 7013 - protein, 130 aa, Homo Sapiens
MMPKHCFLGFLISFFLTGVAGTQSTHESLKPQRVQFQSRNFHNILQWQPGRALTGNSSVYFVQYKIYGQRQWKNKEDCWGTQELSCDLTSETSDIQEPYYGRVRAASAGSYSEWSMTPRFTPWWERAKGL

SEQ ID NO: 7014 - protein, 231 aa, Homo Sapiens
MMPKHCFLGFLISFFLTGVAGTQSTHESLKPQRVQFQSRNFHNILQWQPGRALTGNSSVYFVQYKIYGQRQWKNKEDCWGTQELSCDLTSETSDIQEPYYGRVRAASAGSYSEWSMTPRFTPWWETKIDPPVMNITQVNGSLLVILHAPNLPYRYQKEKNVSIEDYYELLYRVFIINNSLEKEQKVYEGAHRAVEIEALTPHSSYCVVAEIYQPMLDRRSQRSEERCVEIP

SEQ ID NO: 7015 - protein, 189 aa, Homo Sapiens
MLGSRAVMLLLLLPWTAQGRAVPGGSSPAWTQCQQLSQKLCTLAWSAHPLVGHMDLREEGDEETTNDVPHIQCGDGCDPQGLRDNSQFCLQRIHQGLIFYEKLLGSDIFTGEPSLLPDSPVGQLHASLLGLSQLLQPEGHHWETQQIPSLSPSQPWQRLLLRFKILRSLQAFVAVAARVFAHGAATLSP

SEQ ID NO: 7016 - protein, 206 aa, Homo Sapiens
MNFQQRLQSLWTLARPFCPPLLATASQMQMVVLPCLGFTLLLWSQVSGAQGQEFHFGPCQVKGVVPQKLWEAFWAVKDTMQAQDNITSARLLQQEVLQNVSDAESCYLVHTLLEFYLKTVFKNYHNRTVEVRTLKSFSTLANNFVLIVSQLQPSQENEMFSIRDSAHRRFLLFRRAFKQLDVEAALTKALGEVDILLTWMQKFYKL

SEQ ID NO: 7017 - protein, 60 aa, Homo Sapiens
MNFQQRLQSLWTLASKLRITSRVPGCCSRRFCRTSRKKMRCFPSETVHTGGFCYSGEHSN

SEQ ID NO: 7018 - protein, 63 aa, Homo Sapiens
MNFQQRLQSLWTLASKLRITSRVPGCCSRRFCRTSRKKMRCFPSETVHTGGFCYSGEHSNSWT

SEQ ID NO: 7019 - protein, 51 aa, Homo Sapiens
MNFQQRLQSLWTLASKLRITSRVPGCCSRRFCRTSRMLRAVTLSTPCWSST

SEQ ID NO: 7020 - protein, 207 aa, Homo Sapiens
MNFQQRLQSLWTLASRPFCPPLLATASQMQMVVLPCLGFTLLLWSQVSGAQGQEFHFGPCQVKGVVPQKLWEAFWAVKDTMQAQDNITSARLLQQEVLQNVSDAESCYLVHTLLEFYLKTVFKNYHNRTVEVRTLKSFSTLANNFVLIVSQLQPSQENEMFSIRDSAHRRFLLFRRAFKQLDVEAALTKALGEVDILLTWMQKFYKL

SEQ ID NO: 7021 - protein, 154 aa, Homo Sapiens
MNFQQRLQSLWTLASRPFCPPLLATASQMQMVVLPCLGFTLLLWSQVSGAQGQEFHFGPCQVKGVVPQKLWEAFWAVKDTMQAQDNITSARLLQQEVLQNVSQENEMFSIRDSAHRRFLLFRRAFKQLDVEAALTKALGEVDILLTWMQKFYKL

SEQ ID NO: 7022 - protein, 177 aa, Homo Sapiens
MRERPRLGEDSSLISLFLQVVAFLAMVMGTHTYSHWPSCCPSKGQDTSEELLRWSTVPVPPLEPARPNRHPESCRASEDGPLNSRAISPWRYELDRDLNRLPQDLYHARCLCPHCVSLQTGSHMDPRGNSELLYHNQTVFYRRPCHGEKGTHKGYCLERRLYRVSLACVCVRPRVMG

SEQ ID NO: 7023 - protein, 161 aa, Homo Sapiens
MYQVVAFLAMVMGTHTYSHWPSCCPSKGQDTSEELLRWSTVPVPPLEPARPNRHPESCRASEDGPLNSRAISPWRYELDRDLNRLPQDLYHARCLCPHCVSLQTGSHMDPRGNSELLYHNQTVFYRRPCHGEKGTHKGYCLERRLYRVSLACVCVRPRVMG

SEQ ID NO: 7024 - protein, 171 aa, Homo Sapiens
MLVNFILRCGLLLVTLSLAIAKHKQSSFTKSCYPRGTLSQAVDALYIKAAWLKATIPEDRIKNIRLLKKKTKKQFMKNCQFQEQLLSFFMEDVFGQLQLQGCKKIRFVEDFHSLRQKLSHCISCASSAREMKSITRMKRIFYRIGNKGIYKAISELDILLSWIKKLLESSQ

SEQ ID NO: 7025 - protein, 24 aa, Homo Sapiens
MERMQLWAMRLDLRDLQRHLRFQV

SEQ ID NO: 7026 - protein, 243 aa, Homo Sapiens
MGQTAGDLGWRLSLLLLPLLLVQAGVWGFPRPPGRPQLSLQELRREFTVSLHLARKLLSEVRGQAHRFAESHLPGVNLYLLPLGEQLPDVSLTFQAWRRLSDPERLCFISTTLQPFHALLGGLGTQGRWTNMERMQLWAMRLDLRDLQRHLRFQVLAAGFNLPEEEEEEEEEEEEERKGLLPGALGSALQGPAQVSWPQLLSTYRLLHSLELVLSRAVRELLLLSKAGHSVWPLGFPTLSPQP

SEQ ID NO: 7027 - protein, 88 aa, Homo Sapiens
MAAPALSWRLPLLILLLPLATSWASAAVNGTSQFTCFYNSRANISCVWSQDGALQDTSCQVHAWPDRRRWNQTCELLPVSQASWACNL

SEQ ID NO: 7028 - protein, 146 aa, Homo Sapiens
MAAPALSWRLPLLILLLPLATSWASAAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETH

SEQ ID NO: 7029 - protein, 188 aa, Homo Sapiens
MAAPALSWRLPLLILLLPLATSWASAAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQ

SEQ ID NO: 7030 - protein, 551 aa, Homo Sapiens
MAAPALSWRLPLLILLLPLATSWASAAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKDTIPWLGHLLVGLSGAFGFIILVYLLINCRNTGPWLKKVLKCNTPDPSKFFSQLSSEHGGDVQKWLSSPFPSSSFSPGGLAPEISPLEVLERDKVTQLLLQQDKVPEPASLSSNHSLTSCFTNQGYFFFHLPDALEIEACQVYFTYDPYSEEDPDEGVAGAPTGSSPQPLQPLSGEDDAYCTFPSRDDLLLFSPSLLGGPSPPSTAPGGSGAGEERMPPSLQERVPRDWDPQPLGPPTPGVPDLVDFQPPPELVLREAGEEVPDAGPREGVSFPWSRPPGQGEFRALNARLPLNTDAYLSLQELQGQDPTHLV

SEQ ID NO: 7031 - protein, 105 aa, Homo Sapiens
TCFYNSRANISCVWSQDGALQDTSCQVHAWPDRRSLQLPWDQAGMREQDKVPMREECHGASGGGSAPHSGWHRGPSLALLPGAILAAERSEKSPLGQLCGSFLFF

SEQ ID NO: 7032 - protein, 152 aa, Homo Sapiens
MSRLPVLLLLQLLVRPGLQAPMTQTTPLKTSWVNCSNMIDEIITHLKQPPLPLLDFNNLNGEDQDILMENNLRRPNLEAFNRAVKSLQNASAIESILKNLLPCLPLATAAPTRHPIHIKDGDWNEFRRKLTFYLKTLENAQAQQTTLSLAIF

SEQ ID NO: 7033 - protein, 164 aa, Homo Sapiens
MASHSGPSTSVLFLFCCLGGWLASHTLPVRLLRPSDDVQKIVEELQSLSKMLLKDVEEEKGVLVSQNYTLPCLSPDAQPPNNIHSPAIRAYLKTIRQLDNKSVIDEIIEHLDKLIFQDAPETNISVPTDTHECKRFILTISQQFSECMDLALKSLTSGAQQATT

SEQ ID NO: 7034 - protein, 582 aa, Homo Sapiens
MCIRQLKFFTTACVCECPQNILSPQPSCVNLGMMWTWALWMLPSLCKFSLAALPAKPENISCVYYYRKNLTCTWSPGKETSYTQYTVKRTYAFGEKHDNCTTNSSTSENRASCSFFLPRITIPDNYTIEVEAENGDGVIKSHMTYWRLENIAKTEPPKIFRVKPVLGIKRMIQIEWIKPELAPVSSDLKYTLRFRTVNSTSWMEVNFAKNRKDKNQTYNLTGLQPFTEYVIALRCAVKESKFWSDWSQEKMGMTEEEAPCGLELWRVLKPAEADGRRPVRLLWKKARGAPVLEKTLGYNIWYYPESNTNLTETMNTTNQQLELHLGGESFWVSMISYNSLGKSPVATLRIPAIQEKSFQCIEVMQACVAEDQLVVKWQSSALDVNTWMIEWFPDVDSEPTTLSWESVSQATNWTIQQDKLKPFWCYNISVYPMLHDKVGEPYSIQAYAKEGVPSEGPETKVENIGVKTVTITWKEIPKSERKGIICNYTIFYQAEGGKGFCKHAHSEVEKNPKPQIDAMDRPVVGMAPPSHCDLQPGMNHLASLNLSENGAKSTHLLGFWGLNESEVTVPERRVLRKWKELL

SEQ ID NO: 7035 - protein, 681 aa, Homo Sapiens
MCIRQLKFFTTACVCECPQNILSPQPSCVNLGMMWTWALWMLPSLCKFSLAALPAKPENISCVYYYRKNLTCTWSPGKETSYTQYTVKRTYAFGEKHDNCTTNSSTSENRASCSFFLPRITIPDNYTIEVEAENGDGVIKSHMTYWRLENIAKTEPPKIFRVKPVLGIKRMIQIEWIKPELAPVSSDLKYTLRFRTVNSTSWMEVNFAKNRKDKNQTYNLTGLQPFTEYVIALRCAVKESKFWSDWSQEKMGMTEEEAPCGLELWRVLKPAEADGRRPVRLLWKKARGAPVLEKTLGYNIWYYPESNTNLTETMNTTNQQLELHLGGESFWVSMISYNSLGKSPVATLRIPAIQEKSFQCIEVMQACVAEDQLVVKWQSSALDVNTWMIEWFPDVDSEPTTLSWESVSQATNWTIQQDKLKPFWCYNISVYPMLHDKVGEPYSIQAYAKEGVPSEGPETKVENIGVKTVTITWKEIPKSERKGIICNYTIFYQAEGGKGFSKTVNSSILQYGLESLKRKTSYIVQVMASTSAGGTNGTSINFKTLSFSVFEIILITSLIGGGLLILIILTVAYGLKKPNKLTHLCWPTVPNPAESSIATWHGDDFKDKLNLKESDDSVNTEDRILKPCSTPSDKLVIDKLVVNFGNVLQEIFTDEARTGQENNLGGEKNGTRILSSCPTSI

SEQ ID NO: 7036 - protein, 764 aa, Homo Sapiens
MCIRQLKFFTTACVCECPQNILSPQPSCVNLGMMWTWALWMLPSLCKFSLAALPAKPENISCVYYYRKNLTCTWSPGKETSYTQYTVKRTYAFGEKHDNCTTNSSTSENRASCSFFLPRITIPDNYTIEVEAENGDGVIKSHMTYWRLENIAKTEPPKIFRVKPVLGIKRMIQIEWIKPELAPVSSDLKYTLRFRTVNSTSWMEVNFAKNRKDKNQTYNLTGLQPFTEYVIALRCAVKESKFWSDWSQEKMGMTEEEAPCGLELWRVLKPAEADGRRPVRLLWKKARGAPVLEKTLGYNIWYYPESNTNLTETMNTTNQQLELHLGGESFWVSMISYNSLGKSPVATLRIPAIQEKSFQCIEVMQACVAEDQLVVKWQSSALDVNTWMIEWFPDVDSEPTTLSWESVSQATNWTIQQDKLKPFWCYNISVYPMLHDKVGEPYSIQAYAKEGVPSEGPETKVENIGVKTVTITWKEIPKSERKGIICNYTIFYQAEGGKGFSKTVNSSILQYGLESLKRKTSYIVQVMASTSAGGTNGTSINFKTLSFSVFEIILITSLIGGGLLILIILTVAYGLKKPNKLTHLCWPTVPNPAESSIATWHGDDFKDKLNLKESDDSVNTEDRILKPCSTPSDKLVIDKLVVNFGNVLQEIFTDEARTGQENNLGGEKNGYVTCPFRPDCPLGKSFEELPVSPEIPPRKSQYLRSRMPEGTRPEAKEQLLFSGQSLVPDHLCEEGAPNPYLKNSVTAREFLVSEKLPEHTKGEV

SEQ ID NO: 7037 - protein, 745 aa, Homo Sapiens
MKLSPQPSCVNLGMMWTWALWMLPSLCKFSLAALPAKPENISCVYYYRKNLTCTWSPGKETSYTQYTVKRTYAFGEKHDNCTTNSSTSENRASCSFFLPRITIPDNYTIEVEAENGDGVIKSHMTYWRLENIAKTEPPKIFRVKPVLGIKRMIQIEWIKPELAPVSSDLKYTLRFRTVNSTSWMEVNFAKNRKDKNQTYNLTGLQPFTEYVIALRCAVKESKFWSDWSQEKMGMTEEEAPCGLELWRVLKPAEADGRRPVRLLWKKARGAPVLEKTLGYNIWYYPESNTNLTETMNTTNQQLELHLGGESFWVSMISYNSLGKSPVATLRIPAIQEKSFQCIEVMQACVAEDQLVVKWQSSALDVNTWMIEWFPDVDSEPTTLSWESVSQATNWTIQQDKLKPFWCYNISVYPMLHDKVGEPYSIQAYAKEGVPSEGPETKVENIGVKTVTITWKEIPKSERKGIICNYTIFYQAEGGKGFSKTVNSSILQYGLESLKRKTSYIVQVMASTSAGGTNGTSINFKTLSFSVFEIILITSLIGGGLLILIILTVAYGLKKPNKLTHLCWPTVPNPAESSIATWHGDDFKDKLNLKESDDSVNTEDRILKPCSTPSDKLVIDKLVVNFGNVLQEIFTDEARTGQENNLGGEKNGYVTCPFRPDCPLGKSFEELPVSPEIPPRKSQYLRSRMPEGTRPEAKEQLLFSGQSLVPDHLCEEGAPNPYLKNSVTAREFLVSEKLPEHTKGEV

SEQ ID NO: 7038 - protein, 662 aa, Homo Sapiens
MKLSPQPSCVNLGMMWTWALWMLPSLCKFSLAALPAKPENISCVYYYRKNLTCTWSPGKETSYTQYTVKRTYAFGEKHDNCTTNSSTSENRASCSFFLPRITIPDNYTIEVEAENGDGVIKSHMTYWRLENIAKTEPPKIFRVKPVLGIKRMIQIEWIKPELAPVSSDLKYTLRFRTVNSTSWMEVNFAKNRKDKNQTYNLTGLQPFTEYVIALRCAVKESKFWSDWSQEKMGMTEEEAPCGLELWRVLKPAEADGRRPVRLLWKKARGAPVLEKTLGYNIWYYPESNTNLTETMNTTNQQLELHLGGESFWVSMISYNSLGKSPVATLRIPAIQEKSFQCIEVMQACVAEDQLVVKWQSSALDVNTWMIEWFPDVDSEPTTLSWESVSQATNWTIQQDKLKPFWCYNISVYPMLHDKVGEPYSIQAYAKEGVPSEGPETKVENIGVKTVTITWKEIPKSERKGIICNYTIFYQAEGGKGFSKTVNSSILQYGLESLKRKTSYIVQVMASTSAGGTNGTSINFKTLSFSVFEIILITSLIGGGLLILIILTVAYGLKKPNKLTHLCWPTVPNPAESSIATWHGDDFKDKLNLKESDDSVNTEDRILKPCSTPSDKLVIDKLVVNFGNVLQEIFTDEARTGQENNLGGEKNGTRILSSCPTSI

SEQ ID NO: 7039 - protein, 662 aa, Homo Sapiens; identical to SEQ ID NO: 7038

SEQ ID NO: 7040 - protein, 324 aa, Homo Sapiens
MMWTWALWMLPSLCKFSLAALPAKPENISCVYYYRKNLTCTWSPGKETSYTQYTVKRTYAFGEKHDNCTTNSSTSENRASCSFFLPRITIPDNYTIEVEAENGDGVIKSHMTYWRLENIAKTEPPKIFRVKPVLGIKRMIQIEWIKPELAPVSSDLKYTLRFRTVNSTSWMEVNFAKNRKDKNQTYNLTGLQPFTEYVIALRCAVKESKFWSDWSQEKMGMTEEEAPCGLELWRVLKPAEADGRRPVRLLWKKARGAPVLEKTLGYNIWYYPESNTNLTETMNTTNQQLELHLGGESFWVSMISYNSLGKSPVATLRIPAIQEK

SEQ ID NO: 7041 - protein, 622 aa, Homo Sapiens
MTYWRLENIAKTEPPKIFRVKPVLGIKRMIQIEWIKPELAPVSSDLKYTLRFRTVNSTSWMEVNFAKNRKDKNQTYNLTGLQPFTEYVIALRCAVKESKFWSDWSQEKMGMTEEEAPCGLELWRVLKPAEADGRRPVRLLWKKARGAPVLEKTLGYNIWYYPESNTNLTETMNTTNQQLELHLGGESFWVSMISYNSLGKSPVATLRIPAIQEKSFQCIEVMQACVAEDQLVVKWQSSALDVNTWMIEWFPDVDSEPTTLSWESVSQATNWTIQQDKLKPFWCYNISVYPMLHDKVGEPYSIQAYAKEGVPSEGPETKVENIGVKTVTITWKEIPKSERKGIICNYTIFYQAEGGKGFSKTVNSSILQYGLESLKRKTSYIVQVMASTSAGGTNGTSINFKTLSFSVFEIILITSLIGGGLLILIILTVAYGLKKPNKLTHLCWPTVPNPAESSIATWHGDDFKDKLNLKESDDSVNTEDRILKPCSTPSDKLVIDKLVVNFGNVLQEIFTDEARTGQENNLGGEKNGYVTCPFRPDCPLGKSFEELPVSPEIPPRKSQYLRSRMPEGTRPEAKEQLLFSGQSLVPDHLCEEGAPNPYLKNSVTAREFLVSEKLPEHTKGEV

SEQ ID NO: 7042 - protein, 212 aa, Homo Sapiens
MCFPKGLGAWVSACDTEDTVGHLGPWRDKDPALWCQLCLSSQHQAIERFYDKMQNAESGRGQVMSSLAELEDDFKEGYLETVAAYYEEQHPELTPLLEKERDGLRCRGNRSPVPDVEDPATEEPGESFCDKVMRWFQAMLQRLQTWWHGVLAWVKEKVVALVHAVQALWKQFQSFCCSLSELFMSSFQSYGAPRGDKEELTPQKCSEPQSSK

SEQ ID NO: 7043 - protein, 131 aa, Homo Sapiens
MCFPKVLSDDMKKLKARMDDFKEGYLETVAAYYEEQHPELTPLLEKERDGLRCRGNRSPVPDVEDPATEEPGESFCDKVMRWFQAMLQRLQTWWHGVLAWVKEKVVALVHAVQALWKQFQSFCCSLSELFM

SEQ ID NO: 7044 - protein, 179 aa, Homo Sapiens
MCFPKVLSDDMKKLKARMHQAIERFYDKMQNAESGRGQDDFKEGYLETVAAYYEEQHPELTPLLEKERDGLRCRGNRSPVPDVEDPATEEPGESFCDKVMRWFQAMLQRLQTWWHGVLAWVKEKVVALVHAVQALWKQFQSFCCSLSELFMSSFQSYGAPRGDKEELTPQKCSEPQSSK

SEQ ID NO: 7045 - protein, 179 aa, Homo Sapiens; identical to SEQ ID NO: 7044

SEQ ID NO: 7046 - protein, 131 aa, Homo Sapiens
MCFPKVLSDDMKKLKARMHQAIERFYDKMQNAESGRGQVMSSLAELEDDFKEGYLETVAAYYEEQHPELTPLLEKERDGLRCRGNRSPVPDVEDPATEEPGESFCDKSYGAPRGDKEELTPQKCSEPQSSK

SEQ ID NO: 7047 - protein, 131 aa, Homo Sapiens; identical to SEQ ID NO: 7046

SEQ ID NO: 7048 - protein, 131 aa, Homo Sapiens; identical to SEQ ID NO: 7046

SEQ ID NO: 7049 - protein, 188 aa, Homo Sapiens
MCFPKVLSDDMKKLKARMHQAIERFYDKMQNAESGRGQVMSSLAELEDDFKEGYLETVAAYYEEQHPELTPLLEKERDGLRCRGNRSPVPDVEDPATEEPGESFCDKVMRWFQAMLQRLQTWWHGVLAWVKEKVVALVHAVQALWKQFQSFCCSLSELFMSSFQSYGAPRGDKEELTPQKCSEPQSSK

SEQ ID NO: 7050 - protein, 188 aa, Homo Sapiens; identical to SEQ ID NO: 7049

SEQ ID NO: 7051 - protein, 188 aa, Homo Sapiens; identical to SEQ ID NO: 7049

SEQ ID NO: 7052 - protein, 188 aa, Homo Sapiens; identical to SEQ ID NO: 7049

SEQ ID NO: 7053 - protein, 188 aa, Homo Sapiens; identical to SEQ ID NO: 7049

SEQ ID NO: 7054 - protein, 188 aa, Homo Sapiens; identical to SEQ ID NO: 7049

SEQ ID NO: 7055 - protein, 188 aa, Homo Sapiens; identical to SEQ ID NO: 7049

SEQ ID NO: 7056 - protein, 188 aa, Homo Sapiens; identical to SEQ ID NO: 7049

SEQ ID NO: 7057 - protein, 188 aa, Homo Sapiens; identical to SEQ ID NO: 7049

SEQ ID NO: 7058 - protein, 188 aa, Homo Sapiens; identical to SEQ ID NO: 7049

SEQ ID NO: 7059 - protein, 168 aa, Homo Sapiens
MCFPKVLSDDMKKLKARMHQAIERFYDKMQNAESGRGQVMSSLAELEELTPLLEKERDGLRCRGNRSPVPDVEDPATEEPGESFCDKVMRWFQAMLQRLQTWWHGVLAWVKEKVVALVHAVQALWKQFQSFCCSLSELFMSSFQSYGAPRGDKEELTPQKCSEPQSSK

SEQ ID NO: 7060 - protein, 168 aa, Homo Sapiens; identical to SEQ ID NO: 7059

SEQ ID NO: 7061 - protein, 225 aa, Homo Sapiens
MCFPKVLSDDMKKLKARMVMLLPTSAQGLGAWVSACDTEDTVGHLGPWRDKDPALWCQLCLSSQHQAIERFYDKMQNAESGRGQDDFKEGYLETVAAYYEEQHPELTPLLEKERDGLRCRGNRSPVPDVEDPATEEPGESFCDKVMRWFQAMLQRLQTWWHGVLAWVKEKVVALVHAVQALWKQFQSFCCSLSELFMSSFQSYGAPRGDKEELTPQKCSEPQSSK

SEQ ID NO: 7062 - protein, 225 aa, Homo Sapiens
MCFPKVLSDDMKKLKARMVMLLPTSAQGLGAWVSACDTEDTVGHLGPWRDKDPALWCQLCLSSQHQAIERFYDKMQNAESGRGQVMSSLAELEDDFKEGYLETVAAYYEEQHPELTPLLEKERDGLRCRGNRSPVPDVEDPATEEPGESFCDKVMRWFQAMLQRLQTWWHGVLAWVKEKVVALVHAVQALWKQFQSFCCSLSELFMSSFQSYGAPRGDKEELTPQ

SEQ ID NO: 7063 - protein, 234 aa, Homo Sapiens
MCFPKVLSDDMKKLKARMVMLLPTSAQGLGAWVSACDTEDTVGHLGPWRDKDPALWCQLCLSSQHQAIERFYDKMQNAESGRGQVMSSLAELEDDFKEGYLETVAAYYEEQHPELTPLLEKERDGLRCRGNRSPVPDVEDPATEEPGESFCDKVMRWFQAMLQRLQTWWHGVLAWVKEKVVALVHAVQALWKQFQSFCCSLSELFMSSFQSYGAPRGDKEELTPQKCSEPQSSK

SEQ ID NO: 7064 - protein, 234 aa, Homo Sapiens; identical to SEQ ID NO: 7063

SEQ ID NO: 7065 - protein, 234 aa, Homo Sapiens; identical to SEQ ID NO: 7063

SEQ ID NO: 7066 - protein, 221 aa, Homo Sapiens
MCFPKVLSDDMKKLKARMVMLLPTSAQGLGAWVSACDTEDTVGHLGPWRDKDPALWCQLCLSSQHQAIERFYDKMQNAESGRGQVMSSLAELEDDFKEGYLETVAAYYEEQHPELTPLLEKERDGLRCRGNRSPVPDVEDPATEEPGESFCDKVMRWFQAMLQRLQTWWHGVLAWVKEKVVALVHAVQALWKQFQSFCCSLSELFMSSFQSYGATRGARRS

SEQ ID NO: 7067 - protein, 168 aa, Homo Sapiens
MCFPKVLSDDMKKLKARMVMSSLAELEDDFKEGYLETVAAYYEEQHPELTPLLEKERDGLRCRGNRSPVPDVEDPATEEPGESFCDKVMRWFQAMLQRLQTWWHGVLAWVKEKVVALVHAVQALWKQFQSFCCSLSELFMSSFQSYGAPRGDKEELTPQKCSEPQSSK

SEQ ID NO: 7068 - protein, 168 aa, Homo Sapiens; identical to SEQ ID NO: 7067

SEQ ID NO: 7069 - protein, 168 aa, Homo Sapiens; identical to SEQ ID NO: 7067

SEQ ID NO: 7070 - protein, 148 aa, Homo Sapiens
MCFPKVLSDDMKKLKARMVMSSLAELEELTPLLEKERDGLRCRGNRSPVPDVEDPATEEPGESFCDKVMRWFQAMLQRLQTWWHGVLAWVKEKVVALVHAVQALWKQFQSFCCSLSELFMSSFQSYGAPRGDKEELTPQKCSEPQSSK

SEQ ID NO: 7071 - protein, 178 aa, Homo Sapiens
MKKLKARMHQAIERFYDKMQNAESGRGQVMSSLAELEDDFKEGYLETVAAYYEEQHPELTPLLEKERDGLRCRGNRSPVPDVEDPATEEPGESFCDKVMRWFQAMLQRLQTWWHGVLAWVKEKVVALVHAVQALWKQFQSFCCSLSELFMSSFQSYGAPRGDKEELTPQKCSEPQSSK

SEQ ID NO: 7072 - protein, 54 aa, Homo Sapiens
MPRGFTWLRYLGIFLGVALGNEPLEMWPLTQNEECTVTGFLRDKLQYRSRLQYM

SEQ ID NO: 7073 - protein, 242 aa, Homo Sapiens
MPRGFTWLRYLGIFLGVALGNEPLEMWPLTQNEECTVTGFLRDKLQYRSRLQYMKHYFPINYKISVPYEGVFRIANVTRLQRAQVSERELRYLWVLVSLSATESVQDVLLEGHPSWKYLQEVETLLLNVQQGLTDVEVSPKVESVLSLLNAPGPNLKLVRPKALLDNCFRVMELLYCSCCKQSSVLNWQDCEVPSPQSCSPEPSLQYAATQLYPPPPWSPSSPPHSTGSVRPVRAQGEGLLP

SEQ ID NO: 7074 - protein, 242 aa, Homo Sapiens; identical to SEQ ID NO: 7073

SEQ ID NO: 7075 - protein, 217 aa, Homo Sapiens
MWPLTQNEECTVTGFLRDKLQYRSRLQYMKHYFPINYKISVPYEGVFRIANVTRLQRAQVSERELRYLWVLVSLSATESVQDVLLEGHPSWKYLQEVETLLLNVQQGLTDVEVSPKVESVLSLLNAPGPNLKLVRPKALLDNCFRVMELLYCSCCKQSSVLNWQDCEVPSPQSCSPEPSLQYAATQLYPPPPWSPSSPPHSTGSVRPVRAQGEGLLP

SEQ ID NO: 7076 - protein, 378 aa, Homo Sapiens
MVLLWLTLLLIALPCLLQTKEDPNPPITNLRMKAKAQQLTWDLNRNVTDIECVKDADYSMPAVNNSYCQFGAISLCEVTNYTVRVANPPFSTWILFPENSGKPWAGAENLTCWIHDVDFLSCSWAVGPGAPADVQYDLYLNVANRRQQYECLHYKTDAQGTRIGCRFDDISRLSSGSQSSHILVRGRSAAFGIPCTDKFVVFSQIEILTPPNMTAKCNKTHSFMHWKMRSHFNRKFRYELQIQKRMQPVITEQVRDRTSFQLLNPGTYTVQIRARERVYEFLSAWSTPQRFECDQEEGANTRAWRTSLLIALGTLLALVCVFVICRRYLVMQRLFPRIPHMKDPIGDSFQNDKLVVWEAGKAGLEECLVTEVQVVQKT

SEQ ID NO: 7077 - protein, 164 aa, Homo Sapiens
MVLLWLTLLLIALPCLLQTKEGGKPWAGAENLTCWIHDVDFLSCSWAVGPGAPADVQYDLYLNVANRRQQYECLHYKTDAQGTRIGCRFDDISRLSSGSQSSHILVRGRSAAFGIPCTDKFVVFSQIEILTPPNMTAKCNKTHSFMHWKMRSHFNRKFRYELQI

SEQ ID NO: 7078 - protein, 300 aa, Homo Sapiens
MVLLWLTLLLIALPCLLQTKEGGKPWAGAENLTCWIHDVDFLSCSWAVGPGAPADVQYDLYLNVANRRQQYECLHYKTDAQGTRIGCRFDDISRLSSGSQSSHILVRGRSAAFGIPCTDKFVVFSQIEILTPPNMTAKCNKTHSFMHWKMRSHFNRKFRYELQIQKRMQPVITEQVRDRTSFQLLNPGTYTVQIRARERVYEFLSAWSTPQRFECDQEEGANTRAWRTSLLIALGTLLALVCVFVICRRYLVMQRLFPRIPHMKDPIGDSFQNDKLVVWEAGKAGLEECLVTEVQVVQKT

SEQ ID NO: 7079 - protein, 137 aa, Homo Sapiens
MGLTSQLLPPLFFLLACAGNFVHGHKCDITLQEIIKTLNSLTEQKNTTEKETFCRAATVLRQFYSHHEKDTRCLGATAQQFHRHKQLIRFLKRLDRNLWGLAGLNSCPVKEANQSTLENFLERLKTIMREKYSKCSS

SEQ ID NO: 7080 - protein, 153 aa, Homo Sapiens [sequence omitted]

SEQ ID NO: 7081 - protein, 136 aa, Homo Sapiens
MGLTSQLLPPLFFLLACAGNFVHGHKCDITLQEIIKTLNSLTEQKTLCTELTVTDIFAASKQHACLPTSRHTGTICRPPSARVPSTSTRLQSPERTQLRRKPSAGLRLCSGSSTATMRRTLAAWVRLHSSSTGTSS

SEQ ID NO: 7082 - protein, 32 aa, Homo Sapiens
MAPLALHLLVLVPILLSLVASQDWKAERSQDP

SEQ ID NO: 7083 - protein, 150 aa, Homo Sapiens
MAPLALHLLVLVPILLSLVASQDWKAERSQDPFEKCMQDPDYEQLLKVTILEADNRIGGRIFTYRDQNTGWIGELGAMRMPSSHRILHKLCQGLGLNLTKFTQYDKNTWTEVHEVKLRNYVVEKVPEKLGYALRPQEKGHSPEDIYQMAL

SEQ ID NO: 7084 - protein, 71 aa, Homo Sapiens
MAPLALHLLVLVPILLSLVASQDWKAERSQDPFEKCMQDPDYEQLLKVVTWGLNRTLKPQRVIVVGAGVAG

SEQ ID NO: 7085 - protein, 567 aa, Homo Sapiens
MAPLALHLLVLVPILLSLVASQDWKAERSQDPFEKCMQDPDYEQLLKVVTWGLNRTLKPQRVIVVGAGVAGLVAAKVLSDAGHKVTILEADNRIGGRIFTYRDQNTGWIGELGAMRMPSSHRILHKLCQGLGLNLTKFTQYDKNTWTEVHEVKLRNYVVEKVPEKLGYALRPQEKGHSPEDIYQMALNQALKDLKALGCRKAMKKFERHTLLEYLLGEGNLSRPAVQLLGDVMSEDGFFYLSFAEALRAHSCLSDRLQYSRIVGGWDLLPRALLSSLSGLVLLNAPVVAMTQGPHDVHVQIETSPPARNLKVLKADVVLLTASGPAVKRITFSPPLPRHMQEALRRLHYVPATKVFLSFRRPFWREEHIEGGHSNTDRPSRMIFYPPPREGALLLASYTWSDAAAAFAGLSREEALRLALDDVAALHGPVVRQLWDGTGVVKRWAEDQHSQGGFVVQPPALWQTEKDDWTVPYGRIYFAGEHTAYPHGWVETAVKSALRAAIKINSRKGPASDTASPEGHASDMEGQGHVHGVASSPSHDLAKEEGSHPPVQGQLSLQNTTHTRTSH

SEQ ID NO: 7086 - protein, 82 aa, Homo Sapiens
MPNDDFCPGLTIKAMGAERAPQRQPCNTISHRESWPHWPCTSSSSSPSSSAWWPPRTGRLNAAKTPSRNACRILTMSSCSRW

SEQ ID NO: 7087 - protein, 106 aa, Homo Sapiens
MPNDDFCPGLTIKAMGAERAPQRQPCTLHLLVLVPILLSLVASQDWKAERSQDPFEKCMQDPDYEQLLKVVTWGLNRTLKPQRVIVVGAGVAGLVAAKVLSDAGHK

SEQ ID NO: 7088 - protein, 589 aa, Homo Sapiens
MPNDDFCPGLTIKAMGAERAPQRQPCTLHLLVLVPILLSLVASQDWKAERSQDPFEKCMQDPDYEQLLKVVTWGLNRTLKPQRVIVVGAGVAGLVAAKVLSDAGHKVTILEADNRIGGRIFTYRDQNTGWIGELGAMRMPSSHRILHKLCQGLGLNLTKFTQYDKNTWTEVHEVKLRNYVVEKVPEKLGYALRPQEKGHSPEDIYQMALNQALKDLKALGCRKAMKKFERHTLLEYLLGEGNLSRPAVQLLGDVMSEDGFFYLSFAEALRAHSCLSDRLQYSRIVGGWDLLPRALLSSLSGLVLLNAPVVAMTQGPHDVHVQIETSPPARNLKVLKADVVLLTASGPAVKRITFSPPLPRHMQEALRRLHYVPATKVFLSFRRPFWREEHIEGGHSNTDRPSRMIFYPPPREGALLLASYTWSDAAAAFAGLSREEALRLALDDVAALHGPVVRQLWDGTGVVKRWAEDQHSQGGFVVQPPALWQTEKDDWTVPYGRIYFAGEHTAYPHGWVETAVKSALRAAIKINSRKGPASDTASPEGHASDMEGQGHVHGVASSPSHDLAKEEGSHPPVQGQLSLQNTTHTRTSH

SEQ ID NO: 7089 - protein, 589 aa, Homo Sapiens; identical to SEQ ID NO: 7088

SEQ ID NO: 7090 - protein, 10 aa, Homo Sapiens
MGWLCSGLLF

SEQ ID NO: 7091 - protein, 66 aa, Homo Sapiens
MGWLCSGLLFPVSCLVLLQVASSGLFRMPCGERKRVEARRSGGRSGVEEMRGSGSLWEVDLRTDWN

SEQ ID NO: 7092 - protein, 66 aa, Homo Sapiens; identical to SEQ ID NO: 7091

SEQ ID NO: 7093 - protein, 66 aa, Homo Sapiens; identical to SEQ ID NO: 7091

SEQ ID NO: 7094 - protein, 64 aa, Homo Sapiens
MGWLCSGLLFPVSCLVLLQVASSGNMKVLQEPTCVSDYMSISTCEWKMNGPTNCSTELRLLYQL

SEQ ID NO: 7095 - protein, 120 aa, Homo Sapiens
MGWLCSGLLFPVSCLVLLQVASSGNMKVLQEPTCVSDYMSISTCEWKMNGPTNCSTELRLLYQLVFLLSEAHTCIPENNGGAGCVCHLLMDDVVSADNYTLDLWAGQQLLWKGSFKPSEH

SEQ ID NO: 7096 - protein, 120 aa, Homo Sapiens; identical to SEQ ID NO: 7095

SEQ ID NO: 7097 - protein, 825 aa, Homo Sapiens
MGWLCSGLLFPVSCLVLLQVASSGNMKVLQEPTCVSDYMSISTCEWKMNGPTNCSTELRLLYQLVFLLSEAHTCIPENNGGAGCVCHLLMDDVVSADNYTLDLWAGQQLLWKGSFKPSEHVKPRAPGNLTVHTNVSDTLLLTWSNPYPPDNYLYNHLTYAVNIWSENDPADFRIYNVTYLEPSLRIAASTLKSGISYRARVRAWAQCYNTTWSEWSPSTKWHNSYREPFEQHLLLGVSVSCIVILAVCLLCYVSITKIKKEWWDQIPNPARSRLVAIIIQDAQGSQWEKRSRGQEPAKCPHWKNCLTKLLPCFLEHNMKRDEDPHKAAKEMPFQGSGKSAWCPVEISKTVLWPESISVVRCVELFEAPVECEEEEEVEEEKGSFCASPESSRDDFQEGREGIVARLTESLFLDLLGEENGGFCQQDMGESCLLPPSGSTSAHMPWDEFPSAGPKEAPPWGKEQPLHLEPSPPASPTQSPDNLTCTETPLVIAGNPAYRSFSNSLSQSPCPRELGPDPLLARHLEEVEPEMPCVPQLSEPTTVPQPEPETWEQILRRNVLQHGAAAAPVSAPTSGYQEFVHAVEQGGTQASAVVGLGPPGEAGYKAFSSLLASSAVSPEKCGFGASSGEEGYKPFQDLIPGCPGDPAPVPVPLFTFGLDREPPRSPQSSHLPSSSPEHLGLEPGEKVEDMPKPPLPQEQATDPLVDSLGSGIVYSALTCHLCGHLKQCHGQEDGGQTPVMASPCCGCCCGDRSSPPTTPLRAPDPSPGGVPLEASLCPASLAPSGISEKSKSSSSFHPAPGNAQSSSQTPKIVNFVSVGPTYMRVS

SEQ ID NO: 7098 - protein, 825 aa, Homo Sapiens; identical to SEQ ID NO: 7097

SEQ ID NO: 7099 - protein, 124 aa, Homo Sapiens
MGWLCSGLLFPVSCLVLLQVASSGNMKVLQEPTCVSDYMSISTCEWKMNGPTNCSTELRLLYQLVFLLSEAHTCIPENNGGAGCVCHLLMDDVVSADNYTLDLWAGQQLLWKGSFKPSEHVQNL

SEQ ID NO: 7100 - protein, 810 aa, Homo Sapiens
MQKDARREGNMKVLQEPTCVSDYMSISTCEWKMNGPTNCSTELRLLYQLVFLLSEAHTCIPENNGGAGCVCHLLMDDVVSADNYTLDLWAGQQLLWKGSFKPSEHVKPRAPGNLTVHTNVSDTLLLTWSNPYPPDNYLYNHLTYAVNIWSENDPADFRIYNVTYLEPSLRIAASTLKSGISYRARVRAWAQCYNTTWSEWSPSTKWHNSYREPFEQHLLLGVSVSCIVILAVCLLCYVSITKIKKEWWDQIPNPARSRLVAIIIQDAQGSQWEKRSRGQEPAKCPHWKNCLTKLLPCFLEHNMKRDEDPHKAAKEMPFQGSGKSAWCPVEISKTVLWPESISVVRCVELFEAPVECEEEEEVEEEKGSFCASPESSRDDFQEGREGIVARLTESLFLDLLGEENGGFCQQDMGESCLLPPSGSTSAHMPWDEFPSAGPKEAPPWGKEQPLHLEPSPPASPTQSPDNLTCTETPLVIAGNPAYRSFSNSLSQSPCPRELGPDPLLARHLEEVEPEMPCVPQLSEPTTVPQPEPETWEQILRRNVLQHGAAAAPVSAPTSGYQEFVHAVEQGGTQASAVVGLGPPGEAGYKAFSSLLASSAVSPEKCGFGASSGEEGYKPFQDLIPGCPGDPAPVPVPLFTFGLDREPPRSPQSSHLPSSSPEHLGLEPGEKVEDMPKPPLPQEQATDPLVDSLGSGIVYSALTCHLCGHLKQCHGQEDGGQTPVMASPCCGCCCGDRSSPPTTPLRAPDPSPGGVPLEASLCPASLAPSGISEKSKSSSSFHPAPGNAQSSSQTPKIVNFVSVGPTYMRVS

SEQ ID NO: 7101 - protein, 133 aa, Homo Sapiens
PSTKWHNSYREPFEQHLLLGVSVSCIVILAVCLLCYVSITKIKKEWWDQIPNPARSRLVAIIIQDAQGSQWEKRSRGPWAPRLVNELLAAPSTASAADCPCCNCPRHVLPTRSWPTWRPTCLCLTELEAEPRN

SEQ ID NO: 7102 - protein, 49 aa, Homo Sapiens
  misc_feature (1)..(1): Xaa can be any naturally occurring amino acid
XCVCHLLMDDVVSADNYTLDLWAGQQLLWKGSFKPSEHVLPPLKRSWSQ

SEQ ID NO: 7103 - protein, 193 aa, Homo Sapiens
  misc_feature (1)..(1): Xaa can be any naturally occurring amino acid
XNVTYLEPSLRIAASTLKSGISYRARVRAWAQCYNTTWSEWSPSTKWHNSYREPFEQHLLLGVSVSCIVILAVCLLCYVSITKIKKEWWDQIPNPARSRLVAIIIQDAQGSQWEKRSRGQEPAKCPLQGTAGGGVFWKRGLLAKPPEFHWCVRHWKNCLTKLLPCFLEHNMKRDEDPHKAAKEMPFQGSGKSA

SEQ ID NO: 7104 - protein, 51 aa, Homo Sapiens
MGVVVGWIGDPGSGTLRIPVPVHKNHQLCTEEIFQGIGTLESQTVQGGTVE

SEQ ID NO: 7105 - protein, 134 aa, Homo Sapiens
MRMLLHLSLLALGAAYVYAIPTEIPTSALVKETLALLSTHRTLLIANETLRIPVPVHKNHQLCTEEIFQGIGTLESQTVQGGTVERLFKNLSLIKKYIDGQKKKCGEERRRVNQFLDYLQEFLGVMNTEWIIES

SEQ ID NO: 7106 - protein, 109 aa, Homo Sapiens
MIIVAHVLLILLGATEILQADLLPDEKISLLPPVNFTIKVTGLAQVLLQWKPNPDQEQRNVNLEYQVKINAPKEDDYETRITESKCVTILHKGFSASVRTILQNDHSLL

SEQ ID NO: 7107 - protein, 196 aa, Homo Sapiens
MIIVAHVLLILLGATEILQADLLPDEKISLLPPVNFTIKVTGLAQVLLQWKPNPDQEQRNVNLEYQVKINAPKEDDYETRITESKCVTILHKGFSASVRTILQNDHSLLASSWASAELHAPPGSPGTSIVNLTCTTNTTEDNYSRLRSYQVSLHCTWLVGTDAPEDTQYFLYYRYGSWTEECQEYSKDTLGRNIAC

SEQ ID NO: 7108 - protein, 420 aa, Homo Sapiens
MIIVAHVLLILLGATEILQADLLPDEKISLLPPVNFTIKVTGLAQVLLQWKPNPDQEQRNVNLEYQVKINAPKEDDYETRITESKCVTILHKGFSASVRTILQNDHSLLASSWASAELHAPPGSPGTSIVNLTCTTNTTEDNYSRLRSYQVSLHCTWLVGTDAPEDTQYFLYYRYGSWTEECQEYSKDTLGRNIACWFPRTFILSKGRDWLAVLVNGSSKHSAIRPFDQLFALHAIDQINPPLNVTAEIEGTRLSIQWEKPVSAFPIHCFDYEVKIHNTRNGYLQIEKLMTNAFISIIDDLSKYDVQVRAAVSSMCREAGLWSEWSQPIYVGNDEHKPLREWFVIVIMATICFILLILSLICKICHLWIKLFPPIPAPKSNIKDLFVTTNYEKAGSSETEIEVICYIEKPGVETLEDSVF

SEQ ID NO: 7109 - protein, 335 aa, Homo Sapiens
MIIVAHVLLILLGATEILQADLLPDEKISLLPPVNFTIKVTGLAQVLLQWKPNPDQEQRNVNLEYQVKINAPKEDDYETRITESKCVTILHKGFSASVRTILQNDHSLLASSWASAELHAPPGSPGTSIVNLTCTTNTTEDNYSRLRSYQVSLHCTWLVGTDAPEDTQYFLYYRYGSWTEECQEYSKDTLGRNIACWFPRTFILSKGRDWLAVLVNGSSKHSAIRPFDQLFALHAIDQINPPLNVTAEIEGTRLSIQWEKPVSAFPIHCFDYEVKIHNTRNGYLQIEKLMTNAFISIIDDLSKYDVQVRAAVSSMCREAGLWSEWSQPIYVGFSR

SEQ ID NO: 7110 - protein, 335 aa, Homo Sapiens; identical to SEQ ID NO: 7109

SEQ ID NO: 7111 - protein, 333 aa, Homo Sapiens
MIIVAHVLLILLGATEILQADLLPDEKISLLPPVNFTIKVTGLAQVLLQWKPNPDQEQRNVNLEYQVKINAPKEDDYETRITESKCVTILHKGFSASVRTILQNDHSLLASSWASAELHAPPGSPGTSIVNLTCTTNTTEDNYSRLRSYQVSLHCTWLVGTDAPEDTQYFLYYRYGSWTEECQEYSKDTLGRNIACWFPRTFILSKGRDWLAVLVNGSSKHSAIRPFDQLFALHAIDQINPPLNVTAEIEGTRLSIQWEKPVSAFPIHCFDYEVKIHNTRNGYLQIEKLMTNAFISIIDDLSKYDVQVRAAVSSMCREAGLWSEWSQPIYVGK

SEQ ID NO: 7112 - protein, 420 aa, Homo Sapiens; identical to SEQ ID NO: 7108

SEQ ID NO: 7113 - protein, 378 aa, Homo Sapiens
MIIVAHVLLILLGATEILQADLLPDEKISLLPPVNFTIKVTGLAQVLLQWKPNPDQEQRNVNLEYQVKINAPKEDDYETRITESKCVTILHKGFSASVRTILQNDHSLLASSWASAELHAPPGSPGTSIVNLTCTTNTTEDNYSRLRSYQVSLHCTWLVGTDAPEDTQYFLYYRYGSWTEECQEYSKDTLGRNIACWFPRTFILSKGRDWLAVLVNGSSKHSAIRPFDQLFALHAIDQINPPLNVTAEIEGTRLSIQWEKPVSAFPIHCFDYEVKIHNTRNGYLQIEKLMTNAFISIIDDLSKYDVQVRAAVSSMCREAGLWSEWSQPIYVGNDEHKPLREWFVIVIMATICFILLILSLICKIKLGPVRRKLKSSVI

SEQ ID NO: 7114 - protein, 333 aa, Homo Sapiens; identical to SEQ ID NO: 7111

SEQ ID NO: 7115 - protein, 325 aa, Homo Sapiens
MIIVAHVLLILLGATEILQADLLPDEKISLLPPVNFTIKVTGLAQVLLQWKPNPDQEQRNVNLEYQVKINAPKEDDYETRITESKCVTILHKGFSASVRTILQNDHSLLASSWASAELHAPPGSPGTSIVNLTCTTNTTEDNYSRLRSYQVSLHCTWLVGTDAPEDTQYFLYYRYGSWTEECQEYSKDTLGRNIACWFPRTFILSKGRDWLAVLVNGSSKHSAIRPFDQLFALHAIGNDEHKPLREWFVIVIMATICFILLILSLICKICHLWIKLFPPIPAPKSNIKDLFVTTNYEKAGSSETEIEVICYIEKPGVETLEDSVF

SEQ ID NO: 7116 - protein, 136 aa, Homo Sapiens
MCESSKEALAENNLNLPKMAEKDGCFQSGFNEETCLVKIITGLLEFEVYLEYLQNRFESSEEQARAVQMSTKVLIQFLQKKAKNLDAITTPDPTTNASLLTKLQAQNQWLQDMTTHLILRSFKEFLQSSLRALRQM

SEQ ID NO: 7117 - protein, 122 aa, Homo Sapiens
MCESSKEALAENNLNLPKMAEKDGCFQSGFNEETCLVKIITGLLEFEVYLEYLQNRFESSEEQARAVQMSTKVLIQFLQKKVGVSSFPQLGVGEDRLKDSVLDNSGMQCHFQKRRLHVNKRV

SEQ ID NO: 7118 - protein, 189 aa, Homo Sapiens
MNSFSTIPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKAKNLDAITTPDPTTNASLLTKLQAQNQWLQDMTTHLILRSFKEFLQSSLRALRQM

SEQ ID NO: 7119 - protein, 152 aa, Homo Sapiens
MNSFSTSAFGPVAFSLGLLLVLPAAFPAPVPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQ

SEQ ID NO: 7120 - protein, 212 aa, Homo Sapiens
MNSFSTSAFGPVAFSLGLLLVLPAAFPAPVPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKAKNLDAITTPDPTTNASLLTKLQAQNQWLQDMTTHLILRSFKEFLQSSLRALRQM

SEQ ID NO: 7121 - protein, 212 aa, Homo Sapiens; identical to SEQ ID NO: 7120

SEQ ID NO: 7122 - protein, 198 aa, Homo Sapiens
MNSFSTSAFGPVAFSLGLLLVLPAAFPAPVPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKVGVSSFPQLGVGEDRLKDSVLDNSGMQCHFQKRRLHVNKRV

SEQ ID NO: 7123 - protein, 171 aa, Homo Sapiens [sequence omitted]

SEQ ID NO: 7124 - protein, 365 aa, Homo Sapiens [sequence omitted]

SEQ ID NO: 7125 - protein, 468 aa, Homo Sapiens
MLAVGCALLAALLAAPGAALAPRRCPAQEVARGVLTSLPGDSVTLTCPGVEPEDNATVHWVLRKPAAGSHPSRWAGMGRRLLLRSVQLHDSGNYSCYRAGRPAGTVHLLVDVPPEEPQLSCFRKSPLSNVVCEWGPRSTPSLTTKAVLLVRKFQNSPAEDFQEPCQYSQESQKFSCQLAVPEGDSSFYIVSMCVASSVGSKFSKTQTFQGCGILQPDPPANITVTAVARNPRWLSVTWQDPHSWNSSFYRLRFELRYRAERSKTFTTWMVKDLQHHCVIHDAWSGLRHVVQLRAQEEFGQGEWSEWSPEAMGTPWTESRSPPAENEVSTPMQALTTNKDDDNILFRDSANATSLPVQDSSSVPLPTFLVAGGSLAFGTLLCIAIVLRFKKTWKLRALKEGKTSMHPPYSLGQLVPERPRPTPVLVPLISPPVSPSSLGSDNTSSHNRPDARDPRSPYDISNTDYFFPR

SEQ ID NO: 7126 - protein, 352 aa, Homo Sapiens
MLAVGCALLAALLAAPGAALAPRRCPAQEVARGVLTSLPGDSVTLTCPGVEPEDNATVHWVLRKPAAGSHPSRWAGMGRRLLLRSVQLHDSGNYSCYRAGRPAGTVHLLVDVPPEEPQLSCFRKSPLSNVVCEWGPRSTPSLTTKAVLLVRKFQNSPAEDFQEPCQYSQESQKFSCQLAVPEGDSSFYIVSMCVASSVGSKFSKTQTFQGCGILQPDPPANITVTAVARNPRWLSVTWQDPHSWNSSFYRLRFELRYRAERSKTFTTWMVKDLQHHCVIHDAWSGLRHVVQLRAQEEFGQGEWSEWSPEAMGTPWTDRLSPRCPGWSTAVQSQLTATSASWVQAILPPQPPK

SEQ ID NO: 7127 - protein, 190 aa, Homo Sapiens
  misc_feature (1)..(1): Xaa can be any naturally occurring amino acid
XGSKFSKTQTFQGCGILQPDPPANITVTAVARNPRWLSVTWQDPHSWNSSFYRLRFELRYRAERSKTFTTWMVKDLQHHCVIHDAWSGLRHVVQLRAQEEFGQGEWSEWSPEAMGTPWTESRSPPAENEVSTPMQALTTNKDDDNILFRDSANATSLPVQDSSSVPLPTFLVAGGSLAFGTLLCIAIVLR

SEQ ID NO: 7128 - protein, 294 aa, Homo Sapiens
  misc_feature (1)..(1): Xaa can be any naturally occurring amino acid
XRRLLLRSVQLHDSGNYSCYRAGRPAGTVHLLVDVPPEEPQLSCFRKSPLSNVVCEWGPRSTPSLTTKAVLLVRKFQNSPAEDFQEPCQYSQESQKFSCQLAVPEGDSSFYIVSMCVASSVGSKFSKTQTFQGCGILQPDPPANITVTAVARNPRWLSVTWQDPHSWNSSFYRLRFELRYRAERSKTFTTWMVKDLQHHCVIHDAWSGLRHVVQLRAQEEFGQGEWSEWSPEAMGTPWTGFSPQTIPGGIWDPAGESRSPPAENEVSTPMQALTTNKDDDNILFRDSANATSLP

SEQ ID NO: 7129 - protein, 66 aa, Homo Sapiens
MLTLQTWLVQALFIFLTTESTELKNTSGLMFQILQRVILPSGHLTLLQGTILIQKIKCIQMAISLM

SEQ ID NO: 7130 - protein, 918 aa, Homo Sapiens
MLTLQTWLVQALFIFLTTESTGELLDPCGYISPESPVVQLHSNFTAVCVLKEKCMDYFHVNANYIVWKTNHFTIPKEQYTIINRTASSVTFTDIASLNIQLTCNILTFGQLEQNVYGITIISGLPPEKPKNLSCIVNEGKKMRCEWDGGRETHLETNFTLKSEWATHKFADCKAKRDTPTSCTVDYSTVYFVNIEVWVEAENALGKVTSDHINFDPVYKVKPNPPHNLSVINSEELSSILKLTWTNPSIKSVIILKYNIQYRTKDASTWSQIPPEDTASTRSSFTVQDLKPFTEYVFRIRCMKEDGKGYWSDWSEEASGITYEDRPSKAPSFWYKIDPSHTQGYRTVQLVWKTLPPFEANGKILDYEVTLTRWKSHLQNYTVNATKLTVNLTNDRYLATLTVRNLVGKSDAAVLTIPACDFQATHPVMDLKAFPKDNMLWVEWTTPRESVKKYILEWCVLSDKAPCITDWQQEDGTVHRTYLRGNLAESKCYLITVTPVYADGPGSPESIKAYLKQAPPSKGPTVRTKKVGKNEAVLEWDQLPVDVQNGFIRNYTIFYRTIIGNETAVNVDSSHTEYTLSSLTSDTLYMVRMAAYTDEGGKDGPEFTFTTPKFAQGEIEAIVVPVCLAFLLTTLLGVLFCFNKRDLIKKHIWPNVPDPSKSHIAQWSPHTPPRHNFNSKDQMYSDGNFTDVSVVEIEANDKKPFPEDLKSLDLFKKEKINTEGHSSGIGGSSCMSSSRPSISSSDENESSQNTSSTVQYSTVVHSGYRHQVPSVQVFSRSESTQPLLDSEERPEDLQLVDHVDGGDGILPRQQYFKQNCSQHESSPDISHFERSKQVSSVNEEDFVRLKQQISDHISQSCGSGQMKMFQEVSAADAFGPGTEGQVERFETVGMEAATDEGMPKSYLPQTVRQGGYMPQ

SEQ ID NO: 7131 - protein, 918 aa, Homo Sapiens; identical to SEQ ID NO: 7130

SEQ ID NO: 7132 - protein, 857 aa, Homo Sapiens
MLTLQTWLVQALFIFLTTESTGELLDPCGYISPESPVVQLHSNFTAVCVLKEKCMDYFHVNANYIVWKTNHFTIPKEQYTIINRTASSVTFTDIASLNIQLTCNILTFGQLEQNVYGITIISGLPPEKPKNLSCIVNEGKKMRCEWDGGRETHLETNFTLKSEWATHKFADCKAKRDTPTSCTVDYSTVYFVNIEVWVEAENALGKVTSDHINFDPVYKVKPNPPHNLSVINSEELSSILKLTWTNPSIKSVIILKYNIQYRTKDASTWSQIPPEDTASTRSSFTVQDLKPFTEYVFRIRCMKEDGKGYWSDWSEEASGITYEDRPSKAPSFWYKIDPSHTQGYRTVQLVWKTLPPFEANGKILDYEVTLTRWKSHLQNYTVNATKLTVNLTNDRYLATLTVRNLVGKSDAAVLTIPACDFQGNLAESKCYLITVTPVYADGPGSPESIKAYLKQAPPSKGPTVRTKKVGKNEAVLEWDQLPVDVQNGFIRNYTIFYRTIIGNETAVNVDSSHTEYTLSSLTSDTLYMVRMAAYTDEGGKDGPEFTFTTPKFAQGEIEAIVVPVCLAFLLTTLLGVLFCFNKRDLIKKHIWPNVPDPSKSHIAQWSPHTPPRHNFNSKDQMYSDGNFTDVSVVEIEANDKKPFPEDLKSLDLFKKEKINTEGHSSGIGGSSCMSSSRPSISSSDENESSQNTSSTVQYSTVVHSGYRHQVPSVQVFSRSESTQPLLDSEERPEDLQLVDHVDGGDGILPRQQYFKQNCSQHESSPDISHFERSKQVSSVNEEDFVRLKQQISDHISQSCGSGQMKMFQEVSAADAFGPGTEGQVERFETVGMEAATDEGMPKSYLPQTVRQGGYMPQ

SEQ ID NO: 7133 - protein, 329 aa, Homo Sapiens
MLTLQTWLVQALFIFLTTESTGELLDPCGYISPESPVVQLHSNFTAVCVLKEKCMDYFHVNANYIVWKTNHFTIPKEQYTIINRTASSVTFTDIASLNIQLTCNILTFGQLEQNVYGITIISGLPPEKPKNLSCIVNEGKKMRCEWDGGRETHLETNFTLKSEWATHKFADCKAKRDTPTSCTVDYSTVYFVNIEVWVEAENALGKVTSDHINFDPVYKVKPNPPHNLSVINSEELSSILKLTWTNPSIKSVIILKYNIQYRTKDASTWSQIPPEDTASTRSSFTVQDLKPFTEYVFRIRCMKEDGKGYWSDWSEEASGITYEDNIASF

SEQ ID NO: 7134 - protein, 918 aa, Homo Sapiens; identical to SEQ ID NO: 7130

SEQ ID NO: 7135 - protein, 329 aa, Homo Sapiens; identical to SEQ ID NO: 7133

SEQ ID NO: 7136 - protein, 333 aa, Homo Sapiens
MLTLQTWLVQALFIFLTTESTGELLDPCGYISPESPVVQLHSNFTAVCVLKEKCMDYFHVNANYIVWKTNHFTIPKEQYTIINRTASSVTFTDIASLNIQLTCNILTFGQLEQNVYGITIISGLPPEKPKNLSCIVNEGKKMRCEWDGGRETHLETNFTLKSEWATHKFADCKAKRDTPTSCTVDYSTVYFVNIEVWVEAENALGKVTSDHINFDPVYKVKPNPPHNLSVINSEELSSILKLTWTNPSIKSVIILKYNIQYRTKDASTWSQIPPEDTASTRSSFTVQDLKPFTEYVFRIRCMKEDGKGYWSDWSEEASGITYEDTLDKPLGSG

SEQ ID NO: 7137 - protein, 203 aa, Homo Sapiens
MLTLQTWLVQALFIFLTTESTGELLDPCGYISPESPVVQLHSNFTAVCVLKEKLKPNPPHNLSVINSEELSSILKLTWTNPSIKSVIILKYNIQYRTKDASTWSQIPPEDTASTRSSFTVQDLKPFTEYVFRIRCMKEDGKGYWSDWSEEASGITYEDKLKNTSGLMFQILQRVILPSGHLTLLQGTILIQKIKCIQMAISLM

SEQ ID NO: 7138 - protein, 55 aa, Homo Sapiens
MLTLQTWLVQALFIFLTTESTGQHTSLLIAKQNVTPPPHALLIILLCILSTLKSG

SEQ ID NO: 7139 - protein, 115 aa, Homo Sapiens
MFHVSFRYIFGLPPLILVLLPVASSDCDIEGKDGKQYESVLMVSIDQLLDSMKEIGSNCLNNEFNFFKRHICDANKEENKSLKEQKKLNDLCFLKRLLQEIKTCWNKILMGTKEH

SEQ ID NO: 7140 - protein, 159 aa, Homo Sapiens
MFHVSFRYIFGLPPLILVLLPVASSDCDIEGKDGKQYESVLMVSIDQLLDSMKEIGSNCLNNEFNFFKRHICDANKEGMFLFRAARKLRQFLKMNSTGDFDLHLLKVSEGTTILLNCTGQEENKSLKEQKKLNDLCFLKRLLQEIKTCWNKILMGTKEH

SEQ ID NO: 7141 - protein, 177 aa, Homo Sapiens
MFHVSFRYIFGLPPLILVLLPVASSDCDIEGKDGKQYESVLMVSIDQLLDSMKEIGSNCLNNEFNFFKRHICDANKEGMFLFRAARKLRQFLKMNSTGDFDLHLLKVSEGTTILLNCTGQVKGRKPAALGEAQPTKSLEENKSLKEQKKLNDLCFLKRLLQEIKTCWNKILMGTKEH

SEQ ID NO: 7142 - protein, 133 aa, Homo Sapiens
MFHVSFRYIFGLPPLILVLLPVASSDCDIEGKDGKQYESVLMVSIDQLLDSMKEIGSNCLNNEFNFFKRHICDANKVKGRKPAALGEAQPTKSLEENKSLKEQKKLNDLCFLKRLLQEIKTCWNKILMGTKEH

SEQ ID NO: 7143 - protein, 71 aa, Homo Sapiens
MFHVSFRYIFGLPPLILVLLPVASSDCDIEGKDGKQYESVLMVSIDQLLNQPYKKKEKRTERKQQSAMSNN

SEQ ID NO: 7144 - protein, 71 aa, Homo Sapiens; identical to SEQ ID NO: 7143

SEQ ID NO: 7145 - protein, 37 aa, Homo Sapiens
MFHVSFRYIFGLPPLILVLLPVASSDCDIEGQHERNW

SEQ ID NO: 7146 - protein, 37 aa, Homo Sapiens; identical to SEQ ID NO: 7145

SEQ ID NO: 7147 - protein, 65 aa, Homo Sapiens
AAMYEIKVRSIPDHYFKGFWSEWSPSYYFRTPEINNSSGLSLSYGPVSPIIRRLWNIFVRNQEKI

SEQ ID NO: 7148 - protein, 52 aa, Homo Sapiens
MTILGTTFGMVFSLLQVVSGESGYAQNGDLEDAELDDYSFSCYSQLEVNGSQ

SEQ ID NO: 7149 - protein, 59 aa, Homo Sapiens
MTILGTTFGMVFSLLQVVSGESGYAQNGDLEDAELDDYSFSCYSQLEVNGSQHSLTCAF

SEQ ID NO: 7150 - protein, 150 aa, Homo Sapiens
MTILGTTFGMVFSLLQVVSGESGYAQNGDLEDAELDDYSFSCYSQLEVNGSQHSLTCAFEDPDVNITNLEFEICGALVEVKCLNFRKLQEIYFIETKKFLLIGKSNICVKVGEKSLTCKKIDLTTIGKKLYIKVWLSLLGYLKTLCLDIL

SEQ ID NO: 7151 - protein, 180 aa, Homo Sapiens
MTILGTTFGMVFSLLQVVSGESGYAQNGDLEDAELDDYSFSCYSQLEVNGSQHSLTCAFEDPDVNITNLEFEICGALVEVKCLNFRKLQEIYFIETKKFLLIGKSNICVKVGEKSLTCKKIDLTTIVKPEAPFDLSVVYREGANDFVVTFNTSHLQKKYVKVLMHDVAYRQEKDENKWTD

SEQ ID NO: 7152 - protein, 459 aa, Homo Sapiens
MTILGTTFGMVFSLLQVVSGESGYAQNGDLEDAELDDYSFSCYSQLEVNGSQHSLTCAFEDPDVNITNLEFEICGALVEVKCLNFRKLQEIYFIETKKFLLIGKSNICVKVGEKSLTCKKIDLTTIVKPEAPFDLSVVYREGANDFVVTFNTSHLQKKYVKVLMHDVAYRQEKDENKWTHVNLSSTKLTLLQRKLQPAAMYEIKVRSIPDHYFKGFWSEWSPSYYFRTPEINNSSGEMDPILLTISILSFFSVALLVILACVLWKKRIKPIVWPSLPDHKKTLEHLCKKPRKNLNVSFNPESFLDCQIHRVDDIQARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQ

SEQ ID NO: 7153 - protein, 261 aa, Homo Sapiens
MTILGTTFGMVFSLLQVVSGESGYAQNGDLEDAELDDYSFSCYSQLEVNGSQHSLTCAFEDPDVNITNLEFEICGALVEVKCLNFRKLQEIYFIETKKFLLIGKSNICVKVGEKSLTCKKIDLTTIVKPEAPFDLSVVYREGANDFVVTFNTSHLQKKYVKVLMHDVAYRQEKDENKWTHVNLSSTKLTLLQRKLQPAAMYEIKVRSIPDHYFKGFWSEWSPSYYFRTPEINNSSGLSLSYGPVSPIIRRLWNIFVRNQEK

SEQ ID NO: 7154 - protein, 144 aa, Homo Sapiens
MLLAMVLTSALLLCSVAGQGCPTLAGILDINFLINKMQEDPASKCHCSANVTSCLCLGIPSDNCTRPCFSERLSQMTNTTMQTRYPLIFSRVKKSVEVLKNNKCPYFSCEQPCNQTTAGNALTFLKSLLEIFQKEKMRGMRGKI

SEQ ID NO: 7155 - protein, 457 aa, Homo Sapiens
MAWPKLPAPWLLLCTWLPAGCLSLLVTVQHTERYVTLFASIILKCDYTTSAQLQDVVVTWRFKSFCKDPIFDYYSASYQAALSLGQDPSNDCNDNQREVRIVAQRRGQNEPVLGVDYRQRKITIQNPLARHRYMKQAQALGPQMMGKPLYWGADRSSQVSSYPMHPLLQRDLSLPSSLPQMPMTQTTNQPPIANGVLEYLEKELRNLNLAQPLPPDLKGRFGHPCSMLSSLGSEVVERRIIHLPPLIRDLSSSRRTSDSLHQQWLTPIPSRPWDLREGRSHHHYPDFHQELQDRGPKSWALERRELDPSWSGRHRSSRLNGSPIHWSDRDSLSDVPSSSEARWRPSHPPFRSRCQERPRRPSPRESTQRHGRRRRHRSYSPPLPSGLSSWSSEEDKERQPQSWRAHRRGSHSPHWPEEKPPSYRSLDITPGKNSRKKGSVERRSEKDSSHSGRSVVI

SEQ ID NO: 7156 - protein, 546 aa, Homo Sapiens
MAWPKLPAPWLLLCTWLPAGCLSLLVTVQHTERYVTLFASIILKCDYTTSAQLQDVVVTWRFKSFCKDPIFDYYSASYQAALSLGQDPSNDCNDNQREVRIVAQRRGQNEPVLGVDYRQRKITIQNRADLVINEVMWWDHGVYYCTIEAPGDTSGDPDKEVKLIVLHWLTVIFIILGALLLLLLIGVCWCQCCPQYCCCYIRCPCCPAHCCCPEEALARHRYMKQAQALGPQMMGKPLYWGADRSSQVSSYPMHPLLQRDLSLPSSLPQMPMTQTTNQPPIANGVLEYLEKELRNLNLAQPLPPDLKGRFGHPCSMLSSLGSEVVERRIIHLPPLIRDLSSSRRTSDSLHQQWLTPIPSRPWDLREGRSHHHYPDFHQELQDRGPKSWALERRELDPSWSGRHRSSRLNGSPIHWSDRDSLSDVPSSSEARWRPSHPPFRSRCQERPRRPSPRESTQRHGRRRRHRSYSPPLPSGLSSWSSEEDKERQPQSWRAHRRGSHSPHWPEEKPPSYRSLDITPGKNSRKKGSVERRSEKDSSHSGRSVVI

SEQ ID NO: 7157 - protein, 546 aa, Homo Sapiens; identical to SEQ ID NO: 7156

SEQ ID NO: 7158 - protein, 265 aa, Homo Sapiens
MAWPKLPAPWLLLCTWLPAGCLSLLVTVQHTERYVTLFASIILKCDYTTSAQLQDVVVTWRFKSFCKDPIFDYYSASYQAALSLGQDPSNDCNDNQREVRIVAQRRGQNEPVLGVDYRQRKITIQNRADLVINEVMWWDHGVYYCTIEAPGDTSGDPDKEVKLIVLHWLTVIFIILGALLLLLLIGVCWCQCCPQYCCCYIRCPCCPAHCCCPEEALARHRYMKQAQALGPQMMGKPLYWGADRSSQVSSYPMHPLLQRASRRCQ

SEQ ID NO: 7159 - protein, 502 aa, Homo Sapiens
MAWPKLPAPWLLLCTWLPAGCLSLLVTVQHTERYVTLFASIILKCDYTTSAQLQDVVVTWRFKSFCKDPIFDYYSASYQAALSLGQDPSNDCNDNQREVRIVAQRRGQNEPVLGVDYRQRKITIQNRADLVINEVMWWDHGVYYCTIEAPGDTSGDPDKEVKLIVLHWLTVIFIILGALLLLLLIGVCWCQCCPQYCCCYIRCPCCPAHCCCPEEDLSLPSSLPQMPMTQTTNQPPIANGVLEYLEKELRNLNLAQPLPPDLKGRFGHPCSMLSSLGSEVVERRIIHLPPLIRDLSSSRRTSDSLHQQWLTPIPSRPWDLREGRSHHHYPDFHQELQDRGPKSWALERRELDPSWSGRHRSSRLNGSPIHWSDRDSLSDVPSSSEARWRPSHPPFRSRCQERPRRPSPRESTQRHGRRRRHRSYSPPLPSGLSSWSSEEDKERQPQSWRAHRRGSHSPHWPEEKPPSYRSLDITPGKNSRKKGSVERRSEKDSSHSGRSVVI

SEQ ID NO: 7160 - protein, 167 aa, Homo Sapiens
MDRVLLRWISLFWLTAMVEGLQVTVPDKKKVAMLFQPTVLRCHFSTSSHQPAVVQWKFKSYCQDRMGESLGMSSTRAQSLSKRNLEWDPYLDCLDSRRTVRVVASKQGSTVTLGDFYRGREITIVHDADLQIGKLMWGDSGLYYCIITTPDDLEGKNEDSVELLVLE

SEQ ID NO: 7161 - protein, 620 aa, Homo Sapiens
MDRVLLRWISLFWLTAMVEGLQVTVPDKKKVAMLFQPTVLRCHFSTSSHQPAVVQWKFKSYCQDRMGESLGMSSTRAQSLSKRNLEWDPYLDCLDSRRTVRVVASKQGSTVTLGDFYRGREITIVHDADLQIGKLMWGDSGLYYCIITTPDDLEGKNEDSVELLVLEWVFVGLVLLGVFLFFVLVGICWCQCCPHSCCCYVRCPCCPDSCCCPQALYEAGKAAKAGYPPSVSGVPGPYSIPSVPLGGAPSSGMLMDKPHPPPLAPSDSTGGSHSVRKGYRIQADKERDSMKVLYYVEKELAQFDPARRMRGRYNNTISELSSLHEEDSNFRQSFHQMRSKQFPVSGDLESNPDYWSGVMGGSSGASRGPSAMEYNKEDRESFRHSQPRSKSEMLSRKNFATGVPAVSMDELAAFADSYGQRPRRADGNSHEARGGSRFERSESRAHSGFYQDDSLEEYYGQRSRSREPLTDADRGWAFSPARRRPAEDAHLPRLVSRTPGTAPKYDHSYLGSARERQARPEGASRGGSLETPSKRSAQLGPRSASYYAWSPPGTYKAGSSQDDQEDASDDALPPYSELELTRGPSYRGRDLPYHSNSEKKRKKEPAKKTNDFPTRMSLVV

SEQ ID NO: 7162 - protein, 580 aa, Homo Sapiens
MDRVLLRWISLFWLTAMVEGLQVTVPDKKKVAMLFQPTVLRCHFSTSSHQPAVVQWKFKSYCQDRMGESLGMSSTRAQSLSKRNLEWDPYLDCLDSRRTVRVVASKQGSTVTLGDFYRGREITIVHDADLQIGKLMWGDSGLYYCIITTPDDLEGKNEDSVELLVLGRTGLLADLLPSFAVEIMPEWVFVGLVLLGVFLFFVLVGICWCQCCPHSCCCYVRCPCCPDSCCCPQAFRKGYRIQADKERDSMKVLYYVEKELAQFDPARRMRGRYNNTISELSSLHEEDSNFRQSFHQMRSKQFPVSGDLESNPDYWSGVMGGSSGASRGPSAMEYNKEDRESFRHSQPRSKSEMLSRKNFATGVPAVSMDELAAFADSYGQRPRRADGNSHEARGGSRFERSESRAHSGFYQDDSLEEYYGQRSRSREPLTDADRGWAFSPARRRPAEDAHLPRLVSRTPGTAPKYDHSYLGSARERQARPEGASRGGSLETPSKRSAQLGPRSASYYAWSPPGTYKAGSSQDDQEDASDDALPPYSELELTRGPSYRGRDLPYHSNSEKKRKKEPAKKTNDFPTRMSLVV

SEQ ID NO: 7163 - protein, 639 aa, Homo Sapiens
MDRVLLRWISLFWLTAMVEGLQVTVPDKKKVAMLFQPTVLRCHFSTSSHQPAVVQWKFKSYCQDRMGESLGMSSTRAQSLSKRNLEWDPYLDCLDSRRTVRVVASKQGSTVTLGDFYRGREITIVHDADLQIGKLMWGDSGLYYCIITTPDDLEGKNEDSVELLVLGRTGLLADLLPSFAVEIMPEWVFVGLVLLGVFLFFVLVGICWCQCCPHSCCCYVRCPCCPDSCCCPQALYEAGKAAKAGYPPSVSGVPGPYSIPSVPLGGAPSSGMLMDKPHPPPLAPSDSTGGSHSVRKGYRIQADKERDSMKVLYYVEKELAQFDPARRMRGRYNNTISELSSLHEEDSNFRQSFHQMRSKQFPVSGDLESNPDYWSGVMGGSSGASRGPSAMEYNKEDRESFRHSQPRSKSEMLSRKNFATGVPAVSMDELAAFADSYGQRPRRADGNSHEARGGSRFERSESRAHSGFYQDDSLEEYYGQRSRSREPLTDADRGWAFSPARRRPAEDAHLPRLVSRTPGTAPKYDHSYLGSARERQARPEGASRGGSLETPSKRSAQLGPRSASYYAWSPPGTYKAGSSQDDQEDASDDALPPYSELELTRGPSYRGRDLPYHSNSEKKRKKEPAKKTNDFPTRMSLVV

SEQ ID NO: 7164 - protein, 437 aa, Homo Sapiens
MDRVLLRWISLFWLTAMVEGLQVTVPDKKKVAMLFQPTVLRCHFSTSSHQPAVVQWKFKSYCQDRMGESLGMSSTRAQSLSKRNLEWDPYLDCLDSRRTVRVVASKQGSTVTLGDFYRGREITIVHDADLQIGKLMWGDSGLYYCIITTPDDLEGKNEDSVELLVLGRTGLLADLLPSFAVEIMPEWVFVGLVLLGVFLFFVLVGICWCQCCPHSCCCYVRCPCCPDSCCCPQALYEAGKAAKAGYPPSVSGVPGPYSIPSVPLGGAPSSGMLMDKPHPPPLAPSDSTGGSHSVRKGYRIQADKERDSMKVLYYVEKELAQFDPARRMRGRYNNTISELSSLHEEDSNFRQSFHQMRSKQFPVSGDLESNPDYWSGVMGGSSGASRGPSAMEYNKEDRESFRHRMTFQPGCPLWSDVVNISLDNEKSDMDYGDKTQI

SEQ ID NO: 7165 - protein, 531 aa, Homo Sapiens
MDRVLLRWISLFWLTAMVEGLQVTVPDKKKVAMLFQPTVLRCHFSTSSHQPAVVQWKFKSYCQDRMGESLGMSSTRAQSLSKRNLEWDPYLDCLDSRRTVRVVASKQGSTVTLGDFYRGREITIVHDADLQIGKLMWGDSGLYYCIITTPDDLEGKNEDSVELLVLGRTGLLADLLPSFAVEIMPVRKGYRIQADKERDSMKVLYYVEKELAQFDPARRMRGRYNNTISELSSLHEEDSNFRQSFHQMRSKQFPVSGDLESNPDYWSGVMGGSSGASRGPSAMEYNKEDRESFRHSQPRSKSEMLSRKNFATGVPAVSMDELAAFADSYGQRPRRADGNSHEARGGSRFERSESRAHSGFYQDDSLEEYYGQRSRSREPLTDADRGWAFSPARRRPAEDAHLPRLVSRTPGTAPKYDHSYLGSARERQARPEGASRGGSLETPSKRSAQLGPRSASYYAWSPPGTYKAGSSQDDQEDASDDALPPYSELELTRGPSYRGRDLPYHSNSEKKRKKEPAKKTNDFPTRMSLVV

SEQ ID NO: 7166 - protein, 512 aa, Homo Sapiens
MDRVLLRWISLFWLTAMVEGLQVTVPDKKKVAMLFQPTVLRCHFSTSSHQPAVVQWKFKSYCQDRMGESLGMSSTRAQSLSKRNLEWDPYLDCLDSRRTVRVVASKQGSTVTLGDFYRGREITIVHDADLQIGKLMWGDSGLYYCIITTPDDLEGKNEDSVELLVLVRKGYRIQADKERDSMKVLYYVEKELAQFDPARRMRGRYNNTISELSSLHEEDSNFRQSFHQMRSKQFPVSGDLESNPDYWSGVMGGSSGASRGPSAMEYNKEDRESFRHSQPRSKSEMLSRKNFATGVPAVSMDELAAFADSYGQRPRRADGNSHEARGGSRFERSESRAHSGFYQDDSLEEYYGQRSRSREPLTDADRGWAFSPARRRPAEDAHLPRLVSRTPGTAPKYDHSYLGSARERQARPEGASRGGSLETPSKRSAQLGPRSASYYAWSPPGTYKAGSSQDDQEDASDDALPPYSELELTRGPSYRGRDLPYHSNSEKKRKKEPAKKTNDFPTRMSLVV

SEQ ID NO: 7167 - protein, 172 aa, Homo Sapiens
MITTSRDPSSRLKMFAKELKLVFPGAQRMNRGRHEVGALVRACKANGVTDLLVVHEHRGTPVGLIVSHLPFGPTAYFTLCNVVMRHDIPDLGTMSEAKPHLITHGFSSRLGKRVSDILRYLFPVPKDDSHRVITFANQDDYISFRHHVYKKTDHRNVELTEVGPRFELKLYM

SEQ ID NO: 7168 - protein, 76 aa, Homo Sapiens
MLRREARLRREYLYRKAREEAQRSAQERKERLRRALEENRLIPTELRREALALQGSLEFDDAGGEGNYTRCDQPRG

SEQ ID NO: 7169 - protein, 248 aa, Homo Sapiens
MLRREARLRREYLYRKAREEAQRSAQERKERLRRALEENRLIPTELRREALALQGSLEFDDAGGEGVTSHVDDEYRWAGVEDPKVMITTSRDPSSRLKMFAKELKLVFPGAQRMNRGRHEVGALVRACKANGVTDLLVVHEHRGTPVGLIVSHLPFGPTAYFTLCNVVMRHDIPDLGTMSEAKPHLITHGFSSRLGKRVSDILRYLFPVPKDDSHRVITFANQDDYISFRHHVYKKTDHRNVELTECT

SEQ ID NO: 7170 - protein, 291 aa, Homo Sapiens
MLRREARLRREYLYRKAREEAQRSAQERKERLRRALEENRLIPTELRREALALQGSLEFDDAGGEGVTSHVDDEYRWAGVEDPKVMITTSRDPSSRLKMFAKELKLVFPGAQRMNRGRHEVGALVRACKANGVTDLLVVHEHRGTPVGLIVSHLPFGPTAYFTLCNVVMRHDIPDLGTMSEAKPHLITHGFSSRLGKRVSDILRYLFPVPKDDSHRVITFANQDDYISFRHHVYKKTDHRNVELTEVGPRFELKLYMIRLGTLEQEATADVEWRWHPYTNTARKRVFLSTE

SEQ ID NO: 7171 - protein, 236 aa, Homo Sapiens
MMLEVKVTIQGVTSHVDDEYRWAGVEDPKVMITTSRDPSSRLKMFAKELKLVFPGAQRMNRGRHEVGALVRACKANGVTDLLVVHEHRGTPVGLIVSHLPFGPTAYFTLCNVVMRHDIPDLGTMSEAKPHLITHGFSSRLGKRVSDILRYLFPVPKDDSHRVITFANQDDYISFRHHVYKKTDHRNVELTEVGPRFELKLYMIRLGTLEQEATADVEWRWHPYTNTARKRVFLSTE

SEQ ID NO: 7172 - protein, 280 aa, Homo Sapiens
  misc_feature (1)..(1): Xaa can be any naturally occurring amino acid
XSKCLPAVFLAHWVLLLVLRVFLPCDENRLIPTELRREALALQGSLEFDDAGGEGVTSHVDDEYRWAGVEDPKVMITTSRDPSSRLKMFAKELKLVFPGAQRMNRGRHEVGALVRACKANGVTDLLVVHEHRGTPVGLIVSHLPFGPTAYFTLCNVVMRHDIPDLGTMSEAKPHLITHGFSSRLGKRVSDILRYLFPVPKDDSHRVITFANQDDYISFRHHVYKKTDHRNVELTEVGPRFELKLYMIRLGTLEQEATADVEWRWHPYTNTARKRVFLSTE

SEQ ID NO: 7173 - protein, 158 aa, Homo Sapiens
ERPNGTSAQPAQVKPEFYRQAELKPCPWTGSNQRRCITFCPTPDQADPCKFLACGEFAQCVKNERTEEAECRCKPGYDSQGSLDGLEPGLCGPGTKECEVLQGKGAPCRLPDHSENQAYKTSVKKFQNQQNNKVISKRNSELLTVEYEEFNHQDWEGN

SEQ ID NO: 7174 - protein, 140 aa, Homo Sapiens
MKQILDSLQAYYRLRVCQEAVWEAYRIFLDRIPDTGEYQDWVSICQQETFCLFDIGKNFSNSQEHLDLLQQRIKQRSFPDRKDEISAEKTLGEPGETIVISTEKNKGKTKPFNILQFGNNHHEHLLPIFCLLSSIIYTYY

SEQ ID NO: 7175 - protein, 797 aa, Homo Sapiens
MYLETRRAIFVFWIFLQVQGTKDISINIYHSETKDIDNPPRNETTESTEKMYKMSTMRRIFDLAKHRTKRSAFFPTGVKVCPQESMKQILDSLQAYYRLRVCQEAVWEAYRIFLDRIPDTGEYQDWVSICQQETFCLFDIGKNFSNSQEHLDLLQQRIKQRSFPDRKDEISAEKTLGEPGETIVISTDVANVSLGPFPLTPDDTLLNEILDNTLNDTKMPTTERETEFAVLEEQRVELSVSLVNQKFKAELADSQSPYYQELAGKSQLQMQKIFKKLPGFKKIHVLGFRPKKEKDGSSSTEMQLTAIFKRHSAEAKSPASDLLSFDSNKIESEEVYHGTMEEDKQPEIYLTATDLKRLISKALEEEQSLDVGTIQFTDEIAGSLPAFGPDTQSELPTSFAVITEDATLSPELPPVEPQLETVDGAEHGLPDTSWSPPAMASTSLSEAPPFFMASSIFSLTDQGTTDTMATDQTMLVPGLTIPTSDYSAISQLALGISHPPASSDDSRSSAGGEDMVRHLDEMDLSDTPAPSEVPELSEYVSVPDHFLEDTTPVSALQYITTSSMTIAPKGRELVVFFSLRVANMAFSNDLFNKSSLEYRALEQQFTQLLVPYLRSNLTGFKQLEILNFRNGSVIVNSKMKFAKSVPYNLTKAVHGVLEDFRSAAAQQLHLEIDSYSLNIEPADQADPCKFLACGEFAQCVKNERTEEAECRCKPGYDSQGSLDGLEPGLCGPGTKECEVLQGKGAPCRLPDHSENQAYKTSVKKFQNQQNNKVISKRNSELLTVEYEEFNHQDWEGN

SEQ ID NO: 7176 - protein, 719 aa, Homo Sapiens
MYLETRRAIFVFWIFLQVQGTKVCQEAVWEAYRIFLDRIPDTGEYQDWVSICQQETFCLFDIGKNFSNSQEHLDLLQQRIKQRSFPDRKDEISAEKTLGEPGETIVISTDVANVSLGPFPLTPDDTLLNEILDNTLNDTKMPTTERETEFAVLEEQRVELSVSLVNQKFKAELADSQSPYYQELAGKSQLQMQKIFKKLPGFKKIHVLGFRPKKEKDGSSSTEMQLTAIFKRHSAEAKSPASDLLSFDSNKIESEEVYHGTMEEDKQPEIYLTATDLKRLISKALEEEQSLDVGTIQFTDEIAGSLPAFGPDTQSELPTSFAVITEDATLSPELPPVEPQLETVDGAEHGLPDTSWSPPAMASTSLSEAPPFFMASSIFSLTDQGTTDTMATDQTMLVPGLTIPTSDYSAISQLALGISHPPASSDDSRSSAGGEDMVRHLDEMDLSDTPAPSEVPELSEYVSVPDHFLEDTTPVSALQYITTSSMTIAPKGRELVVFFSLRVANMAFSNDLFNKSSLEYRALEQQFTQLLVPYLRSNLTGFKQLEILNFRNGSVIVNSKMKFAKSVPYNLTKAVHGVLEDFRSAAAQQLHLEIDSYSLNIEPADQADPCKFLACGEFAQCVKNERTEEAECRCKPGYDSQGSLDGLEPGLCGPGTKECEVLQGKGAPCRLPDHSENQAYKTSVKKFQNQQNNKVISKRNSELLTVEYEEFNHQDWEGN

SEQ ID NO: 7177 - protein, 366 aa, Homo Sapiens
MVLHLLLFLLLTPQGGHSCQGLELARELVLAKVRALFLDALGPPAVTREGGDPGVRRLPRRHALGGFTHRGSEPEEEEDVSQAILFPATDASCEDKSAARGLAQEAEEGLFRYMFRPSQHTRSRQVTSAQLWFHTGLDRQGTAASNSSEPLLGLLALSPGGPVAVPMSLGHAPPHWAVLHLATSALSLLTHPVLVLLLRCPLCTCSARPEATPFLVAHTRTRPPSGGERARRSTPLMSWPWSPSALRLLQRPPEEPAAHANCHRVALNISFQELGWERWIVYPPSFIFHYCHGGCGLHIPPNLSLPVPGAPPTPAQPYSLLPGAQPCCAALPGTMRPLHVRTTSDGGYSFKYETVPNLLTQHCACI

SEQ ID NO: 7178 - protein, 426 aa, Homo Sapiens
MPLLWLRGFLLASCWIIVRSSPTPGSEGHSAAPDCPSCALAALPKDVPNSQPEMVEAVKKHILNMLHLKKRPDVTQPVPKAALLNAIRKLHVGKVGENGYVEIEDDIGRRAEMNELMEQTSEIITFAESGTARKTLHFEISKEGSDLSVVERAEVWLFLKVPKANRTRTKVTIRLFQQQKHPQGSLDTGEEAEEVGLKGERSELLLSEKVVDARKSTWHVFPVSSSIQRLLDQGKSSLDVRIACEQCQESGASLVLLGKKKKKEEEGEGKKKGGGEGGAGADEEKEQSHRPFLMLQARQSEDHPHRRRRRGLECDGKVNICCKKQFFVSFKDIGWNDWIIAPSGYHANYCEGECPSHIAGTSGSSLSFHSTVINHYRMRGHSPFANLKSCCVPTKLRPMSMLYYDDGQNIIKKDIQNMIVEECGCS

SEQ ID NO: 7179 - protein, 426 aa, Homo Sapiens; identical to SEQ ID NO: 7178

SEQ ID NO: 7180 - protein, 426 aa, Homo Sapiens; identical to SEQ ID NO: 7178

SEQ ID NO: 7181 - protein, 407 aa, Homo Sapiens
MDGLPGRALGAACLLLLAAGWLGPEAWGSPTPPPTPAAPPPPPPPGSPGGSQDTCTSCGGFRRPEELGRVDGDFLEAVKRHILSRLQMRGRPNITHAVPKAAMVTALRKLHAGKVREDGRVEIPHLDGHASPGADGQERVSEIISFAETDGLASSRVRLYFFISNEGNQNLFVVQASLWLYLKLLPYVLEKGSRRKVRVKVYFQEQGHGDRWNMVEKRVDLKRSGWHTFPLTEAIQALFERGERRLNLDVQCDSCQELAVVPVFVDPGEESHRPFVVVQARLGDSRHRIRKRGLECDGRTNLCCRQQFFIDFRLIGWNDWIIAPTGYYGNYCEGSCPAYLAGVPGSASSFHTAVVNQYRMRGLNPGTVNSCCIPTKLSTMSMLYFDDEYNIVKRDVPNMIVEECGCA

SEQ ID NO: 7182 - protein, 352 aa, Homo Sapiens
MTSSLLLAFLLLAPTTVATPRAGGQCPACGGPTLELESQRELLLDLAKRSILDKLHLTQRPTLNRPVSRAALRTALQHLHGVPQGALLEDNREQECEIISFAETGLSTINQTRLDFHFSSDRTAGDREVQQASLMFFVQLPSNTTWTLKVRVLVLGPHNTNLTLATQYLLEVDASGWHQLPLGPEAQAACSQGHLTLELVLEGQVAQSSVILGGAAHRPFVAARVRVGGKHQIHRRGIDCQGGSRMCCRQEFFVDFREIGWHDWIIQPEGYAMNFCIGQCPLHIAGMPGIAASFHTAVLNLLKANTAAGTTGGGSCCVPTARRPLSLLYYDRDSNIVKTDIPDMVVEACGCS

SEQ ID NO: 7183 - protein, 274 aa, Homo Sapiens
METAAAVVKLERLEAALTRALRRLQPGSVAPGNGEEVISFATVTDSTSAYSSLLTFHLSTPRSHHLYHARLWLHVLPTLPGTLCLRIFRWGPRRRRQGSRTLLAEHHITNLGWHTLTLPSSGLRGEKSGVLKLQLDCRPLEGNSTVTGQPRRLLDTAGHQQPFLELKIRANEPGAGRARRRTPTCEPATPLCCRRDHYVDFQELGWRDWILQPEGYQLNYCSGQCPPHLAGSPGIAASFHSAVFSLLKANNPWPASTSCCVPTARRPLSLLYLD

SEQ ID NO: 7184 - protein, 350 aa, Homo Sapiens
MRLPDVQLWLVLLWALVRAQGTGSVCPSCGGSKLAPQAERALVLELAKQQILDGLHLTSRPRITHPPPQAALTRALRRLQPGSVAPGNGEEVISFATVTDSTSAYSSLLTFHLSTPRSHHLYHARLWLHVLPTLPGTLCLRIFRWGPRRRRQGSRTLLAEHHITNLGWHTLTLPSSGLRGEKSGVLKLQLDCRPLEGNSTVTGQPRRLLDTAGHQQPFLELKIRANEPGAGRARRRTPTCEPATPLCCRRDHYVDFQELGWRDWILQPEGYQLNYCSGQCPPHLAGSPGIAASFHSAVFSLLKANNPWPASTSCCVPTARRPLSLLYLDHNGNVVKTDVPDMVVEACGCS

SEQ ID NO: 7185 - protein, 104 aa, Homo Sapiens
LDISFPPSYPYSEDARQGEQYMNTRCPAWCDRILMSPSAKELVLRSESEEKVVTYDHIGPNVCMGDHKPVFLAFRIMPGAGKRCQRHERTLREPPCSRGPNTHS

SEQ ID NO: 7186 - protein, 412 aa, Homo Sapiens
MAGKAAAPGTAVLLVTANVGSLFDDPENLQKNWLREFYQVVHTHKPHFMALHCQEFGGKNYEASMSHVDKFVKELLSSDAMKEYNRARVYLDENYKSQEHFTALGSFYFLHESLKNIYQFDFKAKKYRKVAGKEIYSDTLESTPMLEKEKFPQDYFPECKWSRKGFIRTRWCIADCAFDLVNIHLFHDASNLVAWETSPSVYSGIRHKALGYVLDRIIDQRFEKVSYFVFGDFNFRLDSKSVVETLCTKATMQTVRAADTNEVVKLIFRESDNDRKVMLQLEKKLFDYFNQEVFRDNNGTALLEFDKELSVFKDRLYELDISFPPSYPYSEDARQGEQYMNTRCPAWCDRILMSPSAKELVLRSESEEKVVTYDHIGPNVCMGDHKPVFLAFRIMPGAGKPHAHVHKCCVVQ

SEQ ID NO: 7187 - protein, 387 aa, Homo Sapiens
MAGKAAAPGTAVLLVTANVGSLFDDPENLQKNWLREFYQVVHTHKPHFMALHCQEFGGKNYEASMSHVDKFVKELLSSDAMKEYNRARVYLDENYKSQEHFTALGSFYFLHESLKNIYQFDFKAKKYRKVAGKEIYSDTLESTPMLEKEKFPQDYFPECKWSRKGFIRTRWCIADCAFDLVNIHLFHDASNLVAWETSPSVYSGIRHKALGYVLDRIIDQRFEKVSYFVFGDFNFRLDSKSVVETLCTKATMQTVRAADTNEVVKLIFRESDNDRKVMLQLEKKLFDYFNQEVFRDNNGTALLEFDKELSVFKDRLYELDISFPPSYPYSEDARQGEQYMNTRCPAWCDRILMSPSAKELVLRVSVCCPSPGHRGMWSAGSGLAQPW

SEQ ID NO: 7188 - protein, 138 aa, Homo Sapiens
VTANVGSLFDDPENLQKNWLREFYQALGSFYFLHESLKNIYQFDFKAKKYRKVAGKEIYSDTLESTPMLEKEKFPQDYFPECKWSRKGFIRTRWCIADCAFDLVNIHLFHDASNLVAWETSPSVYSGIRHKALGYVLD

SEQ ID NO: 7189 - protein, 278 aa, Homo Sapiens
  misc_feature (1)..(1): Xaa can be any naturally occurring amino acid
XQKNWLREFYQVVHTHKPHFMALHCQEFGGKNYEASMSHVDKFVKELLSSDAMKEYNRARVYLDENYKSQEHFTALGSFYFLHESLKNIYQFDFKAKKYRKVAGKEIYSDTLESTPMLEKEKFPQDYFPECKWSRKGFIRTRWCIADCAFDLVNIHLFHDASNLVAWETSPSVYSGIRHKALGYVLDRIIDQRFEKVSYFVFGDFNFRLDSKSVVELLEFDKELSVFKDRLYELDISFPPSYPYSEDARQGEQYMNTRCPAWCDRILMSPSAKELVLR

SEQ ID NO: 7190 - protein, 92 aa, Homo Sapiens
MALWMRLLPLLALLALWGPDPAAAFVNQHLCGSHLVEALYLVCGERGFFYTPKTRREAEDLQAGELLQLDAARRQPHTRRLLHRERWNKALE

SEQ ID NO: 7191 - protein, 98 aa, Homo Sapiens
MALWMRLLPLLALLALWGPDPAAAFVNQHLCGSHLVEALYLVCGERGFFYTPKTRREAEDLQGSLQPLALEGSLQKRGIVEQCCTSICSLYQLENYCN

SEQ ID NO: 7192 - protein, 110 aa, Homo Sapiens
MALWMRLLPLLALLALWGPDPAAAFVNQHLCGSHLVEALYLVCGERGFFYTPKTRREAEDLQVGQVELGGGPGAGSLQPLALEGSLQKRGIVEQCCTSICSLYQLENYCN

SEQ ID NO: 7193 - protein, 110 aa, Homo Sapiens; identical to SEQ ID NO: 7192

SEQ ID NO: 7194 - protein, 110 aa, Homo Sapiens; identical to SEQ ID NO: 7192

SEQ ID NO: 7195 - protein, 200 aa, Homo Sapiens
MALWMRLLPLLALLALWGPDPAAAFVNQHLCGSHLVEALYLVCGERGFFYTPKTRREAEDLQASALSLSSSTSTWPEGLDATARAPPALVVTANIGQAGGSSSRQFRQRALGTSDSPVLFIHCPGAAGTAQGLEYRGRRVTTELVWEEVDSSPQPQGSESLPAQPPAQPAPQPEPQQAREPSPEVSCCGLWPRRPQRSQN

SEQ ID NO: 7196 - protein, 200 aa, Homo Sapiens; identical to SEQ ID NO: 7195

SEQ ID NO: 7197 - protein, 157 aa, Homo Sapiens
MDPRLPAWALVLLGPALVFALGPAPTPEMREKLCGHHFVRALVRVCGGPRWSTEARRPATGGDQRESHSVSQAGLKLLSSSNPPTLTFQSVGISDVSCYSGWRDDICSMGWWPTVISRWDLACSPCPRPLTITATTVQLPPTLHATAASVAVPNKTC

SEQ ID NO: 7198 - protein, 131 aa, Homo Sapiens
MDPRLPAWALVLLGPALVFALGPAPTPEMREKLCGHHFVRALVRVCGGPRWSTEARRPATGGDRELLQWLERRHLLHGLVADSNLTLGPGLQPLPQTSHHHRHHRAAATNPARYCCLSGCTQQDLLTLCPY

SEQ ID NO: 7199 - protein, 71 aa, Homo Sapiens
  misc_feature (1)..(1): Xaa can be any naturally occurring amino acid
XDPRLPAWALVLLGPALVFALGPAPTPEMREKLCGHHFVRALVRVCGGPRWSTEARRPATGGDPEFHSVPR

SEQ ID NO: 7200 - protein, 139 aa, Homo Sapiens
MASLFRSYLPAIWLLLSQLLRESLAAELRGCGPRFGKHLLSYCPMPEKTFTTTPGGWLLESGRPKEMVSTSNNKDGQALGTTSEFIPNLSPELKKPLSEGQPSLKKIILSRKKRSGRHRFDPFCCEVICDDGTSVKLCT

SEQ ID NO: 7201 - protein, 135 aa, Homo Sapiens
MKGSIFTLFLFSVLFAISEVRSKESVRLCGLEYIRTVIYICASSRWRRHQEGIPQAQQAETGNSFQLPHKREFSEENPAQNLPKVDASGEDRLWGGQMPTEELWKSKKHSVMSRQDLQTLCCTDGCSMTDLSALC

SEQ ID NO: 7202 - protein, 213 aa, Homo Sapiens
MPRLLRLSLLWLGLLLVRFSRELSDISSARKLCGRYLVKEIEKLCGHANWSQFRFEEETPFSRLIAQASEKVEAYSPYQFESPQTASPARGRGTNPVSTSWEEAVNSWEMQSLPEYKDKKGYSPLGKTREFSSSHNINVYIHENAKFQKKRRNKIKTLSNLFWGHHPQRKRRGYSEKCCLTGCTKEELSIACLPYIDFKRLKEKRSSLVTKIY

SEQ ID NO: 7203 - protein, 902 aa, Homo Sapiens
MAVYTYLRLIVDHHGTAQLQALRQKEVDFCISLLRERFMECLMIGRDLVRLLQNVARIPEFELLWKDIIHNPQALSPQFTGILQLLQSRTSRKFLACRLTPDMETKLLFMTSRVRFGQQKRYQDWFQRQYLSTPDSQSLRCDLIRYICGVVHPSNEVLSSDILPRWAIIGWLLTTCTSNVAASNAKLALFYDWLFFSPDKDSIMNIEPAILVMHHSMKPHPAITATLLDFMCRIIPNFYPPLEGHVRQGVFSSLNHIVEKRVLAHLAPLFDNPKLDKELRAMLREKFPEFCSSPSPPVEVKIEEPVSMEMDNHMSDKDESCYDNAEAAFSDDEEDLNSKGKKREFRFHPIKETVVEEPVDITPYLDQLDESLRDKVLQLQKGSDTEAQCEVMQEIVDQVLEEDFDSEQLSVLASCLQELFKAHFRGEVLPEEITEESLEESVGKPLYLIFRNLCQMQEDNSSFSLLLDLLSELYQKQPKIGYHLLYYLRASKAAAGKMNLYESFAQATQLGDLHTCLMMDMKACQEDDVRLLCHLTPSIYTEFPDETLRSGELLNMIVAVIDSAQLQELVCHVMMGNLVMFRKDSVLNILIQSLDWETFEQYCAWQLFLAHNIPLETIIPILQHLKYKEHPEALSCLLLQLRREKPSEEMVKMVLSRPCHPDDQFTTSILRHWCMKHDELLAEHIKSLLIKNNSLPRKRQSLRSSSSKLAQLTLEQILEHLDNLRLNLTNTKQNCMPSTLGVQCRRCCPGPDYAWSQAGGRGRTPGATTHTRDKTTCACCLISSQTSDCFSFPALPFLPLVFSQTPILQALQHVQASCDEAHKMKFSDLFSLAEEYEDSSTKPPKSRRKAALSSPRSRKNATQPPNAEEESGSSSASEEEDTKPKPTKRKRKGSSAVGSDSD

SEQ ID NO: 7204 - protein, 1042 aa, Homo Sapiens
MELQKGKGAAAAAAASGAAGGGGGGAGAGAPGGGRLLLSTSLDAKDELEERLERCMSIVTSMTAGVSEREANDALNAYVCKGLPQHEEICLGLFTLILTEPAQAQKCYRDLALVSRDGMNIVLNKINQILMEKYLKLQDTCRTQLVWLVRELVKSGVLGADGVCMTFMKQIAGGDVTAKNIWLAESVLDILTEQREWVLKSSILIAMAVYTYLRLIVDHHGTAQLQALRQKEVDFCISLLRERFMECLMIGRDLVRLLQNVARIPEFELLWKDIIHNPQALSPQFTGILQLLQSRTSRKFLACRLTPDMETKLLFMTSRVRFGQQKRYQDWFQRQYLSTPDSQSLRCDLIRYICGVVHPSNEVLSSDILPRWAIIGWLLTTCTSNVAASNAKLALFYDWLFFSPDKDSIMNIEPAILVMHHSMKPHPAITATLLDFMCRIIPNFYPPLEGHVRQGVFSSLNHIVEKRVLAHLAPLFDNPKLDKELRAMLREKFPEFCSSPSPPVEVKIEEPVSMEMDNHMSDKDESCYDNAEAAFSDDEEDLNSKGKKREFRFHPIKETVVEEPVDITPYLDQLDESLRDKVLQLQKGSDTEAQCEVMQEIVDQVLEEDFDSEQLSVLASCLQELFKAHFRGEVLPEEITEESLEESVGKPLYLIFRNLCQMQEDNSSFSLLLDLLSELYQKQPKIGYHLLYYLRASKAAAGKMNLYESFAQATQLGDLHTCLMMDMKACQEDDVRLLCHLTPSIYTEFPDETLRSGELLNMIVAVIDSAQLQELVCHVMMGNLVMFRKDSVLNILIQSLDWETFEQYCAWQLFLAHNIPLETIIPILQHLKYKEHPEALSCLLLQLRREKPSEEMVKMVLSRPCHPDDQFTTSILRHWCMKHDELLAEHIKSLLIKNNSLPRKRQSLRSSSSKLAQLTLEQILEHLDNLRLNLTNTKQNFFSQTPILQALQHVQASCDEAHKMKFSDLFSLAEEYEDSSTKPPKSRRKAALSSPRSRKNATQPPNAEEESGSSSASEEEDTKPKPTKRKRKGSSAVGSDSD

SEQ ID NO: 7205 - protein, 1042 aa, Homo Sapiens; identical to SEQ ID NO: 7204

SEQ ID NO: 7206 - protein, 41 aa, Homo Sapiens
TQPPNAEEESGSSSASEEEDTKPKPTKRKRKGSSAVGSDSD

SEQ ID NO: 7207 - protein, 280 aa, Homo Sapiens
VYTYLRLIVDHHGTAQLQALRQKEVDFCISLLRERFMECLMIGRDLVRLLQNVARIPEFELLWKDIIHNPQALSPQFTGILQLLQSRTSRKFLACRLTPDMETKLLFMTSRVRFGQQKRYQDWFQRQYLSTPDSQSLRCDLIRYICGVVHPSNEVLSSDILPRWAIIGWLLTTCTSNVAASNAKLALFYDWLFFSPDKDSIMNIEPAILVMHHSMKPHPAITATLLDFMCRIIPNFYPPLEGHVRQGVFSSLNHIVEKRVLACKKYWLYLRLLGICLLGS

SEQ ID NO: 7208 - protein, 49 aa, Homo Sapiens
  misc_feature (1)..(1): Xaa can be any naturally occurring amino acid
XSQSLRCDLIRYICGVVHPSNEVLSSDILPRWAIIGWLLTTCTTPSSPV

SEQ ID NO: 7209 - protein, 64 aa, Homo Sapiens
MDLNSASTVVLQVLTQATSQDTAVLKPAEEQLKQWETQPGFYSVLLNIFTNHTLDINVRWLAVL

SEQ ID NO: 7210 - protein, 149 aa, Homo Sapiens
MDLNSASTVVLQVLTQATSQDTAVLKPAEEQLKQWETQPGFYSVLLNIFTNHTLDINVRWLAVLYFKHGIDRYWRRVAPHALSEEEKTTLRAGLITNFNEPINQIATQIAVLIAKVARLDCPRQWPELIPTLIESVKVQDDLRQHRALL

SEQ ID NO: 7211 - protein, 162 aa, Homo Sapiens
MDLNSASTVVLQVLTQATSQDTAVLKPAEEQLKQWETQPGFYSVLLNIFTNHTLDINVRWLAVLYFKHGIDRYWRRVAPHALSEEEKTTLRAGLITNFNEPINQIATQIAVLIAKVARLDCPRQWPELIPTLIESVKVQDDLRQHRALLTFYHVTKTLASKR

SEQ ID NO: 7212 - protein, 975 aa, Homo Sapiens
MDLNSASTVVLQVLTQATSQDTAVLKPAEEQLKQWETQPGFYSVLLNIFTNHTLDINVRWLAVLYFKHGIDRYWRRVAPHALSEEEKTTLRAGLITNFNEPINQIATQIAVLIAKVARLDCPRQWPELIPTLIESVKVQDDLRQHRALLTFYHVTKTLASKRLAADRKLFYDLASGIYNFACSLWNHHTDTFLQEVSSGNEAAILSSLERTLLSLKVLRKLTVNGFVEPHKNMEVMGFLHGIFERLKQFLECSRSIGTDNVCRDRLEKTIILFTKVLLDFLDQHPFSFTPLIQRSLEFSVSYVFTEVGEGVTFERFIVQCMNLIKMIVKNYAYKPSKNFEDSSPETLEAHKIKMAFFTYPTLTEICRRLVSHYFLLTEEELTMWEEDPEGFTVEETGGDSWKYSLRPCTEVLFIDIFHEYNQTLTPVLLEMMQTLQGPTNVEDMNALLIKDAVYNAVGLAAYELFDSVDFDQWFKNQLLPELQVIHNRYKPLRRRVIWLIGQWISVKFKSDLRPMLYEAICNLLQDQDLVVRIETATTLKLTVDDFEFRTDQFLPYLETMFTLLFQLLQQVTECDTKMHVLHVLSCVIERVNMQIRPYVGCLVQYLPLLWKQSEEHNMLRCAILTTLIHLVQGLGADSKNLYPFLLPVIQLSTDVSQPPHVYLLEDGLELWLVTLENSPCITPELLRIFQNMSPLLELSSENLRTCFKIINGYIFLSSTEFLQTYAVGLCQSFCELLKEITTEGQVQVLKVVENALKVNPILGPQMFQPILPYVFKGIIEGERYPVVMSTYLGVMGRVLLQNTSFFSSLLNEMAHKFNQEMDQLLGNMIEMWVDRMDNITQPERRKLSALALLSLLPSDNSVIQDKFCGIINISVEGLHDVMTEDPETGTYKDCMLMSHLEEPKVTEDEEPPTEQDKRKKMLALKDPVHTVSLQQFIYEKLKAQQEMLGEQGFQSLMETVDTEIVTQLQEFLQGF

SEQ ID NO: 7213 - protein, 863 aa, Homo Sapiens
MDLNSASTVVLQVLTQATSQDTAVLKPAEEQLKQWETQPGFYSVLLNIFTNHTLDINVRWLAVLYFKHGIDRYWRRVAPHALSEEEKTTLRAGLITNFNEPINQIATQIAVLIAKVARLDCPRQWPELIPTLIESVKVQDDLRQHRALLTFYHVTKTLASKRLAADRKLFYDLASGIYNFACSLWNHHTDTFLQEVSSGNEAAILSSLERTLLSLKVLRKLTVNGFVEPHKNMEVMGFLHGIFERLKQFLECSRSIGTDNVCRDRLEKTIILFTKVLLDFLDQHPFSFTPLIQRSLEFSVSYVFTEVGEGVTFERFIVQCMNLIKMIVKNYAYKPSKNFEDSSPETLEAHKIKMAFFTYPTLTEICRRLVSHYFLLTEEELTMWEEDPEGFTVEETGGDSWKYSLRPCTEVLFIDIFHEYNQTLTPVLLEMMQTLQGPTNVEDMNALLIKDAVYNAVGLAAYELFDSVDFDQWFKNQLLPELQVIHNRYKPLRRRVIWLIGQWISVKFKSDLRPMLYEAICNLLQDQDLVVRIETATTLKLTVDDFEFRTDQFLPYLETMFTLLFQLLQQVTECDTKMHVLHVLSCVIERVNMQIRPYVGCLVQYLPLLWKQSEEHNMLRCAILTTLIHLVQGLGADSKNLYPFLLPVIQLSTDVSQPPHVYLLEDGLELWLVTLENSPCITPELLRIFQNMSPLLELSSENLRTCFKIINGYIFLSSTEFLQTYAVGLCQSFCELLKEITTEGQVQVLKVVENALKVNPILGPQMFQPILPYVFKGIIEGERYPVVMSTYLGVMGRVLLQNTSFFSSLLNEMAHKFNQEMDQLLGNMIEMWVDRMDNITQPERRKLSALALLSLLPSDNSQF

SEQ ID NO: 7214 - protein, 59 aa, Homo Sapiens
MDQLLGNMIEMWVDRMDNITQPERRKLSALALLSLLPSDNSFLYPWQPLFYTLTVKEPM

SEQ ID NO: 7215 - protein, 94 aa, Homo Sapiens
MTEDPETGTYKDCMLMSHLEEPKVTEDEEPPTEQDKRKKMLALKDPVHTVSLQQFIYEKLKAQQEMLGEQGFQSLMETVDTEIVTQLQEFLQGF

SEQ ID NO: 7216 - protein, 1015 aa, Homo Sapiens
MVQPIIHLGYVVYSLLYLGYKPVQHVTALNTVSSCHKMVSMDLNSASTVVLQVLTQATSQDTAVLKPAEEQLKQWETQPGFYSVLLNIFTNHTLDINVRWLAVLYFKHGIDRYWRRVAPHALSEEEKTTLRAGLITNFNEPINQIATQIAVLIAKVARLDCPRQWPELIPTLIESVKVQDDLRQHRALLTFYHVTKTLASKRLAADRKLFYDLASGIYNFACSLWNHHTDTFLQEVSSGNEAAILSSLERTLLSLKVLRKLTVNGFVEPHKNMEVMGFLHGIFERLKQFLECSRSIGTDNVCRDRLEKTIILFTKVLLDFLDQHPFSFTPLIQRSLEFSVSYVFTEVGEGVTFERFIVQCMNLIKMIVKNYAYKPSKNFEDSSPETLEAHKIKMAFFTYPTLTEICRRLVSHYFLLTEEELTMWEEDPEGFTVEETGGDSWKYSLRPCTEVLFIDIFHEYNQTLTPVLLEMMQTLQGPTNVEDMNALLIKDAVYNAVGLAAYELFDSVDFDQWFKNQLLPELQVIHNRYKPLRRRVIWLIGQWISVKFKSDLRPMLYEAICNLLQDQDLVVRIETATTLKLTVDDFEFRTDQFLPYLETMFTLLFQLLQQVTECDTKMHVLHVLSCVIERVNMQIRPYVGCLVQYLPLLWKQSEEHNMLRCAILTTLIHLVQGLGADSKNLYPFLLPVIQLSTDVSQPPHVYLLEDGLELWLVTLENSPCITPELLRIFQNMSPLLELSSENLRTCFKIINGYIFLSSTEFLQTYAVGLCQSFCELLKEITTEGQVQVLKVVENALKVNPILGPQMFQPILPYVFKGIIEGERYPVVMSTYLGVMGRVLLQNTSFFSSLLNEMAHKFNQEMDQLLGNMIEMWVDRMDNITQPERRKLSALALLSLLPSDNSVIQDKFCGIINISVEGLHDVMTEDPETGTYKDCMLMSHLEEPKVTEDEEPPTEQDKRKKMLALKDPVHTVSLQQFIYEKLKAQQEMLGEQGFQSLMETVDTEIVTQLQEFLQGF

SEQ ID NO: 7217 - protein, 160 aa, Homo Sapiens
  misc_feature (1)..(1): Xaa can be any naturally occurring amino acid
XLRCAILTTLIHLVQVVENALKVNPILGPQMFQPILPYVFKGIIEGERYPVVMSTYLGVMGRVLLQNTSFFSSLLNEMAHKFNQEMDQLLGNMIEMWVDRMDNITQPERRKLSALALLSLLPSDNSVIQDKFCGIINISVEGLHDVMTEDPETGTYKDWP

SEQ ID NO: 7218 - protein, 1041 aa, Homo Sapiens
MAAAAAAGAASGLPGPVAQGLKEALVDTLTGILSPVQEVRAAAEEQIKVLEVTEEFGVHLAELTVDPQGALAIRQLASVILKQYVETHWCAQSEKFRPPETTERAKIVIRELLPNGLRESISKVRSSVAYAVSAIAHWDWPEAWPQLFNLLMEMLVSGDLNAVHGAMRVLTEFTREVTDTQMPLVAPVILPEMYKIFTMAEVYGIRTRSRAVEIFTTCAHMICNMEELEKGAAKVLIFPVVQQFTEAFVQALQIPDGPTSDSGFKMEVLKAVTALVKNFPKHMVSSMQQILPIVWNTLTESAAFYVRTEVNYTEEVEDPVDSDGEVLGFENLVFSIFEFVHALLENSKFKSTVKKALPELIYYIILYMQITEEQIKVWTANPQQFVEDEDDDTFSYTVRIAAQDLLLAVATDFQNESAAALAAAATRHLQEAEQTKNSGTEHWWKIHEACMLALGSVKAIITDSVKNGRIHFDMHGFLTNVILADLNLSVSPFLLGRALWAASRFTVAMSPELIQQFLQATVSGLHETQPPSVRISAVRAIWGYCDQLKVSESTHVLQPFLPSILDGLIHLAAQFSSEVLNLVMETLCIVCTVDPEFTASMESKICPFTIAIFLKYSNDPVVASLAQDIFKELSQIEACQGPMQMRLIPTLVSIMQAPADKIPAGLCATAIDILTTVVRNTKPPLSQLLICQAFPAVAQCTLHTDDNATMQNGGECLRAYVSVTLEQVAQWHDEQGHNGLWYVMQVVSQLLDPRTSEFTAAFVGRLVSTLISKAGRELGENLDQILRAILSKMQQAETLSVMQSLIMVFAHLVHTQLEPLLEFLCSLPGPTGKPALEFVMAEWTSRQHLFYGQYEGKVSSVALCKLLQHGINADDKRLQDIRVKGEEIYSMDEGIRTRSKSAKNPERWTNIPLLVKILKLIINELSNVMEANAARQATPAEWSQDDSNDMWEDQEEEEEEEEDGLAGQLLSDILATSKYEEDYYEDDEEDDPDALKDPLYQIDLQAYLTDFLCQFAQQPCYIMFSGHLNDNERRVLQTIGI

SEQ ID NO: 7219 - protein, 155 aa, Homo Sapiens
SNVMEANAARQATPAEWSQDDSNDMWEDQEEEEEEEEDGLAGQLLSDILATSKYEEDYYEDDEEDDPDALKDPLYQIDLQATLMTMRGEFYRPSASKKGSLSTFAPSGPAANHFAALTGLEMHFLLNLKWHLDPWPLASAVTLMTIQTRLTGAVT

SEQ ID NO: 7220 - protein, 127 aa, Homo Sapiens
MDTQNLEKTAIKIQSWWRGNMVRRTLLQAALRAWVIQCWWRSMQAKMLEQRRRLALRLYTCQEWAVVKVQAQVRMWQARRRFLQARQAACIIQSHWRWHASQTRGLIRGHYEVRASRLELDIEILMT

SEQ ID NO: 7221 - protein, 107 aa, Homo Sapiens
MVRRTLLQAALRAWVIQCWWRSMQAKMLEQRRRLALRLYTCQEWAVVKVQAQVRMWQARRRFLQARQAACIIQSHWRWHASQTRGLIRGHYEVRASRLELDIEILMT

SEQ ID NO: 7222 - protein, 596 aa, Homo Sapiens
MAGNCGARGALSAHTLLFDLPPALLGELCAVLDSCDGALGWRGLAERLSSSWLDVRHIEKYVDQGKSGTRELLWSWAQKNKTIGDLLQVLQEMGHRRAIHLITNYGAVLSPSEKSYQEGGFPNILFKETANVTVDNVLIPEHNEKGILLKSSISFQNIIEGTRNFHKDFLIGEGEIFEVYRVEIQNLTYAVKLFKQEKKMQCKKHWKRFLSELEVLLLFHHPNILELAAYFTETEKFCLIYPYMRNGTLFDRLQCVGDTAPLPWHIRIGILIGISKAIHYLHNVQPCSVICGSISSANILLDDQFQPKLTDFAMAHFRSHLEHQSCTINMTSSSSKHLWYMPEEYIRQGKLSIKTDVYSFGIVIMEVLTGCRVVLDDPKHIQLRDLLRELMEKRGLDSCLSFLDKKVPPCPRNFSAKLFCLAGRCAATRAKLRPSMDEVLNTLESTQASLYFAEDPPTSLKSFRCPSPLFLENVPSIPVEDDESQNNNLLPSDEGLRIDRMTQKTPFECSQSEVMFLSLDKKPESKRNEEACNMPSSSCEESWFPKYIVPSQDLRPYKVNIDPSSEAPGHSCRSRPVESSCSSKFSWDEYEQYKKE

SEQ ID NO: 7223 - protein, 535 aa, Homo Sapiens
MAGNCGARGALSAHTLLFDLPPALLGELCAVLDSCDGALGWRGLGAVLSPSEKSYQEGGFPNILFKETANVTVDNVLIPEHNEKGILLKSSISFQNIIEGTRNFHKDFLIGEGEIFEVYRVEIQNLTYAVKLFKQEKKMQCKKHWKRFLSELEVLLLFHHPNILELAAYFTETEKFCLIYPYMRNGTLFDRLQCVGDTAPLPWHIRIGILIGISKAIHYLHNVQPCSVICGSISSANILLDDQFQPKLTDFAMAHFRSHLEHQSCTINMTSSSSKHLWYMPEEYIRQGKLSIKTDVYSFGIVIMEVLTGCRVVLDDPKHIQLRDLLRELMEKRGLDSCLSFLDKKVPPCPRNFSAKLFCLAGRCAATRAKLRPSMDEVLNTLESTQASLYFAEDPPTSLKSFRCPSPLFLENVPSIPVEDDESQNNNLLPSDEGLRIDRMTQKTPFECSQSEVMFLSLDKKPESKRNEEACNMPSSSCEESWFPKYIVPSQDLRPYKVNIDPSSEAPGHSCRSRPVESSCSSKFSWDEYEQYKKE

SEQ ID NO: 7224 - protein, 93 aa, Homo Sapiens
MAGNCGARGALSAHTLLFDLPPALLGELCAVLDSCDGALGWRGLVSKNKLCENGVLILQGFWHVVVCKYKDSKYGCVALFEKTPSETYLHMET

SEQ ID NO: 7225 - protein, 1257 aa, Homo Sapiens
MASCSFTRDQATRRLRGAAAAAAAALAAVVTTPLLSSGTPTALIGTGSSCPGAMWLSTATGSRSDSESEEEDLPVGEEVCKRGYLRKQKHGHRRYFVLKLETADAPARLEYYENARKFRHSVRAAAAAAAAAASGAAIPPLIPPRRVITLYQCFSVSQRADARYRHLIALFTQDEYFAMVAENESEQESWYLLLSRLILESKRRRCGTLGAQPDGEPAALAAAAAAEPPFYKDVWQVIVKPRGLGHRKELSGVFRLCLTDEEVVFVRLNTEVASVVVQLLSIRRCGHSEQYFFLEVGRSTVIGPGELWMQVDDCVVAQNMHELFLEKMRALCADEYRARCRSYSISIGAHLLTLLSARRHLGLVPLEPGGWLRRSRFEQFCHLRAIGDGEDEMLFTRRFVTPSEPVAHSRRGRLHLPRGRRSRRAVSVPASFFRRLAPSPARPRHPAEAPNNGARLSSEVSGSGSGNFGEEGNPQGKEDQEGSGGDYMPMNNWGSGNGRGSGGGQGSNGQGSSSHSSGGNQCSGEGQGSRGGQGSNGQGSGGNQCSRDGQGTAGGHGSGGGQRPGGGHGSGGGQGPGDGHGSGGGKNSGGGKGSGSGKGSDGDGERGKSLKKRSYFGKLTQSKQQQMPPPPPPPPPPPPAGGTGGKGKSGGRFRLYFCVDRGATKECKEAKEVKDAEIPEGAARGPHRARAFDEDEDDPYVPMRPGVATPLVSSSDYMPMAPQNVSASKKRHSRSPFEDSRGYMMMFPRVSPPPAPSPPKAPDTNKEDDSKDNDSESDYMFMAPGAGAIPKNPRNPQGGSSSKSWSSYFSLPNPFRSSPLGQNDNSEYVPMLPGKFLGRGLDKEVSYNWDPKDAASKPSGEGSFSKPGDGGSPSKPSDHEPPKNKAKRPNRLSFITKGYKIKPKPQKPTHEQREADSSSDYVNMDFTKRESNTPAPSTQGLPDSWGIIAEPRQSAFSNYVNVEFGVPFPNPANDLSDLLRAIPRANPLSLDSARWPLPPLPLSATGSNAIEEEGDYIEVIFNSAMTPAMALADSAIRYDAETGRIYVVDPFSECCMDISLSPSRCSEPPPVARLLQEEEQERRRPQSRSQSFFAAARAAVSAFPTDSLERDLSPSSAPAVASAAEPTLALSQVVAAASALAAAPGIGAAAAAAGFDSASARWFQPVANAADAEAVRGAQDVAGGSNPGAHNPSANLARGDNQAGGAAAAAAAPEPPPRSRRVPRPPEREDSDNDDDTHVRMDFARRDNQFDSPKRGR

SEQ ID NO: 7226 - protein, 147 aa, Homo Sapiens
MQELHLLWWALLLGLAQACPEPCDCGEKYGFQIADCAYRDLESVPPGFPANVTTLSLSANRLPGLPEGAFREVPLLQSLWLAHNEIRTVAAGALASLSHLKSLDLSHNLISDFAWSDLHNLSALQLLKMDSNELTFIPRDAFRSLRA

SEQ ID NO: 7227 - protein, 183 aa, Homo Sapiens
MQELHLLWWALLLGLAQACPEPCDCGEKYGFQIADCAYRDLESVPPGFPANVTTLSLSANRLPGLPEGAFREVPLLQSLWLAHNEIRTVAAGALASLSHLKSLDLSHNLISDFAWSDLHNLSALQLLKMDSNELTFIPRDAFRSLRALRSLQLNHNRLHTLAEGTFTPLTALSHLQINENPFD

SEQ ID NO: 7228 - protein, 428 aa, Homo Sapiens
MQELHLLWWALLLGLAQACPEPCDCGEKYGFQIADCAYRDLESVPPGFPANVTTLSLSANRLPGLPEGAFREVPLLQSLWLAHNEIRTVAAGALASLSHLKSLDLSHNLISDFAWSDLHNLSALQLLKMDSNELTFIPRDAFRSLRALRSLQLNHNRLHTLAEGTFTPLTALSHLQINENPFDCTCGIVWLKTWALTTAVSIPEQDNIACTSPHVLKGTPLSRLPPLPCSAPSVQLSYQPSQDGAELRPGFVLALHCDVDGQPAPQLHWHIQIPSGIVEITSPNVGTDGRALPGTPVASSQPRFQAFANGSLLIPDFGKLEEGTYSCLATNELGSAESSVDVALATPGEGGEDTLGRRFHGKAVEGKGCYTVDNEVQPSGPEDNVVIIYLSRAGNPEAAVAEGVPGQLPPGLLLLGQSLLLFFFLTSF

SEQ ID NO: 7229 - protein, 428 aa, Homo Sapiens; identical to SEQ ID NO: 7228

SEQ ID NO: 7230 - protein, 5 aa, Homo Sapiens
MFPLR

SEQ ID NO: 7231 - protein, 89 aa, Homo Sapiens
MFPLRALWLVWALLGVAGSCPEPCACVDKYAHQFADCAYKELREVPEGLPANVTTLSLSANKITVLRRGAFADVTQVTSLWLAHNEVRT

SEQ ID NO: 7232 - protein, 114 aa, Homo Sapiens
MFPLRALWLVWALLGVAGSCPEPCACVDKYAHQFADCAYKELREVPEGLPANVTTLSLSANKITVLRRGAFADVTQVTSLWLAHNEVRTVEPGALAVLSQLKNLDLSHNFISSF

SEQ ID NO: 7233 - protein, 138 aa, Homo Sapiens
MFPLRALWLVWALLGVAGSCPEPCACVDKYAHQFADCAYKELREVPEGLPANVTTLSLSANKITVLRRGAFADVTQVTSLWLAHNEVRTVEPGALAVLSQLKNLDLSHNFISSFPWSDLRNLSALQLLKMNHNRLGSL

SEQ ID NO: 7234 - protein, 334 aa, Homo Sapiens
MFPLRALWLVWALLGVAGSCPEPCACVDKYAHQFADCAYKELREVPEGLPANVTTLSLSANKITVLRRGAFADVTQVTSLWLAHNEVRTVEPGALAVLSQLKNLDLSHNFISSFPWSDLRNLSALQLLKMNHNRLGSLPRDALGALPDLRSLRINNNRLAGEACHVQVVFSTKKELPSLLVIVAVSVFLLVLATVPLLGAACCHLLAKHPGKPYRLILRPQAPDPMEKRIAADFDPRASYLESEKSYPAGGEAGGEEPEDVQGEGLDEDAEQGDPSGDLQREESLAACSLVESQSKANQEEFEAGSEYSDRLPLGAEAVNIAQEINGNYRQTAG

SEQ ID NO: 7235 - protein, 745 aa, Homo Sapiens
MFPLRALWLVWALLGVAGSCPEPCACVDKYAHQFADCAYKELREVPEGLPANVTTLSLSANKITVLRRGAFADVTQVTSLWLAHNEVRTVEPGALAVLSQLKNLDLSHNFISSFPWSDLRNLSALQLLKMNHNRLGSLPRDALGALPDLRSLRINNNRLRTLAPGTFDALSALSHLQLYHNPFHCGCGLVWLQAWAASTRVSLPEPDSIACASPPALQGVPVYRLPALPCAPPSVHLSAEPPLEAPGTPLRAGLAFVLHCIADGHPTPRLQWQLQIPGGTVVLEPPVLSGEDDGVGAEEGEGEGDGDLLTQTQAQTPTPAPAWPAPPATPRFLALANGSLLVPLLSAKEAGVYTCRAHNELGANSTSIRVAVAATGPPKHAPGAGGEPDGQAPTSERKSTAKGRGNSVLPSKPEGKIKGQGLAKVSILGETETEPEEDTSEGEEAEDQILADPAEEQRCGNGDPSRYVSNHAFNQSAELKPHVFELGVIALDVAEREARVQLTPLAARWGPGPGGAGGAPRPGRRPLRLLYLCPAGGGAAVQWSRVEEGVNAYWFRGLRPGTNYSVCLALAGEACHVQVVFSTKKELPSLLVIVAVSVFLLVLATVPLLGAACCHLLAKHPGKPYRLILRPQAPDPMEKRIAADFDPRASYLESEKSYPAGGEAGGEEPEDVQGEGLDEDAEQGDPSGDLQREESLAACSLVESQSKANQEEFEAGSEYSDRLPLGAEAVNIAQEINGNYRQTAG

SEQ ID NO: 7236 - protein, 745 aa, Homo Sapiens; identical to SEQ ID NO: 7235

SEQ ID NO: 7237 - protein, 745 aa, Homo Sapiens; identical to SEQ ID NO: 7235

SEQ ID NO: 7238 - protein, 745 aa, Homo Sapiens; identical to SEQ ID NO: 7235

SEQ ID NO: 7239 - protein, 745 aa, Homo Sapiens; identical to SEQ ID NO: 7235

SEQ ID NO: 7240 - protein, 464 aa, Homo Sapiens
MVRLAAELLLLLGLLLLTLHITVLRGSGAADGPDAAAGNASQAQLQNNLNVGSDTTSETSFSLSKEAPREHLDHQAAHQPFPRPRFRQETGHPSLQRDFPRSFLLDLPNFPDLSKADINGQNPNIQVTIEVVDGPDSEADKDQHPENKPSWSVPSPDWRAWWQRSLSLARANSGDQDYKYDSTSDDSNFLNPPRGWDHTAPGHRTFETKDQPEYDSTDGEGDWSLWSVCSVTCGNGNQKRTRSCGYACTATESRTCDRPNCPGIEDTFRTAATEVSLLAGSEEFNATKLFEVDTDSCERWMSCKSEFLKKYMHKVMNDLPSCPCSYPTEVAYSTADIFDRIKRKDFRWKDASGPKEKLEIYKPTARYCIRSMLSLESTTLAAQHCCYGDNMQLITRGKGAGTPNLISTEFSAELHYKVDVLPWIICKGDWSRYNEARPPNNGQKCTESPSDEDYIKQFQEAREY

SEQ ID NO: 7241 - protein, 76 aa, Homo Sapiens
MRALRDRAGLLLCVLLLAALLEAALGLPVKKPRLRGPRPGSLTRLAEPPFQVRASSERSPAGARNLALCGVAGQGR

SEQ ID NO: 7242 - protein, 292 aa, Homo Sapiens
MRALRDRAGLLLCVLLLAALLEAALGLPVKKPRLRGPRPGSLTRLAEVSASPDPRPLKEEEEAPLLPRTHLQAEPHQHGCWTVTEPAAMTPGNATPPRTPEVTPLRLELQKLPGLANTTLSTPNPDTQASASPDPRPLREEEEARLLPRTHLQAELHQHGCWTVTEPAALTPGNATPPRTQEVTPLLLELQKLPELVHATLSTPNPDNQTMSLRRSGVPGLPAVGTAALASSRGLGPVAMAALPPRPVPVTCPPVLALRTRTPWASPVRSGSSWPAMLRTCMIKMWTAVRSG

SEQ ID NO: 7243 - protein, 571 aa, Homo Sapiens
MRALRDRAGLLLCVLLLAALLEAALGLPVKKPRLRGPRPGSLTRLAEVSASPDPRPLKEEEEAPLLPRTHLQAEPHQHGCWTVTEPAAMTPGNATPPRTPEVTPLRLELQKLPGLANTTLSTPNPDTQASASPDPRPLREEEEARLLPRTHLQAELHQHGCWTVTEPAALTPGNATPPRTQEVTPLLLELQKLPELVHATLSTPNPDNQVTIKVVEDPQAEVSIDLLAEPSNPPPQDTLSWLPALWSFLWGDYKGEEKDRAPGEKGEEKEEDEDYPSEDIEGEDQEDKEEDEEEQALWFNGTTDNWDQGWLAPGDWVFKDSVSYDYEPQKEWSPWSPCSGNCSTGKQQRTRPCGYGCTATETRTCDLPSCPGTEDKDTLGLPSEEWKLLARNATDMHDQDVDSCEKWLNCKSDFLIKYLSQMLRDLPSCPCAYPLEAMDSPVSLQDEHQGRSFRWRDASGPRERLDIYQPTARFCLRSMLSGESSTLAAQHCCYDEDSRLLTRGKGAGMPNLISTDFSPKLHFKFDTTPWILCKGDWSRLHAVLPPNNGRACTDNPLEEEYLAQLQEAKEY

SEQ ID NO: 7244 - protein, 185 aa, Homo Sapiens
MRALRDRAGLLLCVLLLAALLEAALGLPVKKPRLRGPRPGSLTRLAEVSASPDPRPLKEEEEAPLLPRTHLQAEPHQHGCWTVTEPAAMTPGNATPPRTPEVTPLRLELQKLPGLANTTLSTPNPDTQVTIKVVEDPQAEVSIDLLAEPSNPPPQDTLSWLPALWSFLWGDYKGEEKDRAPGEKG

SEQ ID NO: 7245 - protein, 104 aa, Homo Sapiens
  misc_feature (1)..(1): Xaa can be any naturally occurring amino acid
XCVLLLAALLEAALGLPVKKPRLRGPRPGSLTRLAEVSGGGTGLRSALSVPPPQPAGSSRAGSGTGTHTGSDPPMERGAGAGRKLPDTGRCPGAPDFGASTPRA

SEQ ID NO: 7246 - protein, 73 aa, Homo Sapiens
  misc_feature (1)..(1): Xaa can be any naturally occurring amino acid
XRLAEVSGGGTGLRSALSVPPPQPAGSSRAGSGTGTHTGSDPPMERGAGAGRKLPDTGRCPGAPDFGASTPRA

SEQ ID NO: 7247 - protein, 614 aa, Homo Sapiens
MAWEARREPGPRRAAVRETVMLLLCLGVPTGRPYNVDTESALLYQGPHNTLFGYSVVLHSHGANRWLLVGAPTANWLANASVINPGAIYRCRIGKNPGQTCEQLQLGSPNGEPCGKTCLEERDNQWLGVTLSRQPGENGSIVTCGHRWKNIFYIKNENKLPTGGCYGVPPDLRTELSKRIAPCYQDYVKKFGENFASCQAGISSFYTKDLIVMGAPGSSYWTGSLFVYNITTNKYKAFLDKQNQVKFGSYLGYSVGAGHFRSQHTTEVVGGAPQHEQIGKAYIFSIDEKELNILHEMKGKKLGSYFGASVCAVDLNADGFSDLLVGAPMQSTIREEGRVFVYINSGSGAVMNAMETNLVGSDKYAARFGESIVNLGDIDNDGFEDVAIGAPQEDDLQGAIYIYNGRADGISSTFSQRIEGLQISKSLSMFGQSISGQIDADNNGYVDVAVGAFRSDSAVLLRTRPVVIVDASLSHPESVNRTKFDCVENGWPSVCIDLTLCFSYKGKEVPGYIVLFYNMSLDVNRKAESPPRFYFSSNGTSDVITGSIQVSSREANCRTHQAFMRKDVRDILTPIQIEAAYHLGPHVISKRSTEEFPPLQPILQQKKEKDIMKK

SEQ ID NO: 7248 - protein, 1032 aa, Homo Sapiens [sequence omitted]

SEQ ID NO: 7249 - protein, 195 aa, Homo Sapiens
MAWEARREPGPRRAAVRETVMLLLCLGVPTGRPYNVDTESALLYQGPHNTLFGYSVVLHSHGANRWLLVGAPTANWLANASVINPGAIYRCRIGKNPGQTCEQLQLGSPNGEPCGKTCLEERDNQWLGVTLSRQPGENGSIVTCGHRWKNIFYIKNENKLPTGGCYGVPPDLRTELSKRIAPCYQGSISKYRART

SEQ ID NO: 7250 - protein, 1035 aa, Homo Sapiens
MGGPAAPRGAGRLRALLLALVVAGIPAGAYNLDPQRPVHFQGPADSFFGYAVLEHFHDNTRWVLVGAPKADSKYSPSVKSPGAVFKCRVHTNPDRRCTELDMARGKNRGTSCGKTCREDRDDEWMGVSLARQPKADGRVLACAHRWKNIYYEADHILPHGFCYIIPSNLQAKGRTLIPCYEEYKKKYGEEHGSCQAGIAGFFTEELVVMGAPGSFYWAGTIKVLNLTDNTYLKLNDEVIMNRRYTYLGYAVTAGHFSHPSTIDVVGGAPQDKGIGKVYIFRADRRSGTLIKIFQASGKKMGSYFGSSLCAVDLNGDGLSDLLVGAPMFSEIRDEGQVTVYINRGNGALEEQLALTGDGAYNAHFGESIASLDDLDNDGFPDVAIGAPKEDDFAGAVYIYHGDAGGIVPQYSMKLSGQKINPVLRMFGQSISGGIDMDGNGYPDVTVGAFMSDSVVLLRARPVITVDVSIFLPGSINITAPQCHDGQQPVNCLNVTTCFSFHGKHVPGEIGLNYVLMADVAKKEKGQMPRVYFVLLGETMGQVTEKLQLTYMEETCRHYVAHVKRRVQDVISPIVFEAAYSLSEHVTGEEERELPPLTPVLRWKKGQKIAQKNQTVFERNCRSEDCAADLQLQGKLLLSSMDEKTLYLALGAVKNISLNISISNLGDDAYDANVSFNVSRELFFINMWQKEEMGISCELLESDFLKCSVGFPFMRSKSKYEFSVIFDTSHLSGEEEVLSFIVTAQSGNTERSESLHDNTLVLMVPLMHEVDTSITGIMSPTSFVYGESVDAANFIQLDDLECHFQPINITLQVYNTGPSTLPGSSVSISFPNRLSSGGAEMFHVQEMVVGQEKGNCSFQKNPTPCIIPQEQENIFHTIFAFFTKSGRKVLDCEKPGISCLTAHCNFSALAKEESRTIDIYMLLNTEILKKDSSSVIQFMSRAKVKVDPALRVVEIAHGNPEEVTVVFEALHNLEPRGYVVGWIIAISLLVGILIFLLLAVLLWKMGFFRRRYKEIIEAEKNRKENEDSWDWVQKNQ

SEQ ID NO: 7251 - protein, 632 aa, Homo Sapiens
MGGPAAPRGAGRLRALLLALVVAGIPAGAYNLDPQRPVHFQGPADSFFGYAVLEHFHDNTRWVLVGAPKADSKYSPSVKSPGAVFKCRVHTNPDRRCTELDMARGKNRGTSCGKTCREDRDDEWMGVSLARQPKADGRVLACAHRWKNIYYEADHILPHGFCYIIPSNLQAKGRTLIPCYEEYKKKYGEEHGSCQAGIAGFFTEELVVMGAPGSFYWAGTIKVLNLTDNTYLKLNDEVIMNRRYTYLGYAVTAGHFSHPSTIDVVGGAPQDKGIGKVYIFRADRRSGTLIKIFQASGKKMGSYFGSSLCAVDLNGDGLSDLLVGAPMFSEIRDEGQVTVYINRGNGALEEQLALTGDGAYNAHFGESIASLDDLDNDGFPDVAIGAPKEDDFAGAVYIYHGDAGGIVPQYSMKLSGQKINPVLRMFGQSISGGIDMDGNGYPDVTVGAFMSDSVVLLRARPVITVDVSIFLPGSINITAPQCHDGQQPVNCLNVTTCFSFHGKHVPGEIGLNYVLMADVAKKEKGQMPRVYFVLLGETMGQVTEKLQLTYMEETCRHYVAHVKRRVQDVISPIVFEAAYSLSEHVTGEEERELPPLTPVLRWKKGQKIAQKNQVRTLKLILSTQGGSCTEQK

SEQ ID NO: 7252 - protein, 69 aa, Homo Sapiens
  misc_feature (1)..(1): Xaa can be any naturally occurring amino acid
XKKDSSSVIQFMSRAKVKVDPALRVVEIAHGNPEEVTMGFFRRRYKEIIEAEKNRKENEDSWDWVQKNQ

SEQ ID NO: 7253 - protein, 404 aa, Homo Sapiens
MKDSCITVMAMALLSGFFFFAPASSYNLDVRGARSFSPPRAGRHFGYRVLQIKSLIPQFQGRLVANLTYTLQLDGHRTRRRGLFPGGRHELRRNIAVTTSMSCTDFSFHFPMMFNTLVNSSWGDSVELHANVTCNNEDSDLLEDNSATTIIPILYPINILIQDQEDSTLYVSFTPKGPKIHQVKHMYQVRIQPSIHDHNIPTLEAVVGVPQPPSEGPITHQWSVQMEPPVPCHYEDLERLPDAAEPCLPGALFRCPVVFRQEILVQVIGTLELVGEIEASSMFSLCSSLSISFNSSKHFHLYGSNASLAQVVMKVDVVYEKQMLYLYVLSGIGGLLLLLLIFIVLYKVGFFKRNLKEKMEAGRGVPNGIPAEDSEQLASGQEAGDPGCLKPLHEKDSESGGGKD

SEQ ID NO: 7254 - protein, 109 aa, Homo Sapiens
MKDSCITVMAMALLSGFFFFAPASSYNLDVRGARSFSPPRAGRHFGYRVLQLDGHRTRRRGLFPGGRHELRRNIAVTTSMSCTDFSFHFPIQSPASNCFCQPLCGAEPE

SEQ ID NO: 7255 - protein, 55 aa, Homo Sapiens
MKDSCITVMAMALLSGFFFFAPASSYNLDVRGARSFSPPRAGRHFGYRVLQVGNG

SEQ ID NO: 7256 - protein, 1170 aa, Homo Sapiens
MKDSCITVMAMALLSGFFFFAPASSYNLDVRGARSFSPPRAGRHFGYRVLQVGNGVIVGAPGEGNSTGSLYQCQSGTGHCLPVTLRGSNYTSKYLGMTLATDPTDGSILACDPGLSRTCDQNTYLSGLCYLFRQNLQGPMLQGRPGFQECIKGNVDLVFLFDGSMSLQPDEFQKILDFMKDVMKKLSNTSYQFAAVQFSTSYKTEFDFSDYVKRKDPDALLKHVKHMLLLTNTFGAINYVATEVFREELGARPDATKVLIIITDGEATDSGNIDAAKDIIRYIIGIGKHFQTKESQETLHKFASKPASEFVKILDTFEKLKDLFTELQKKIYVIEGTSKQDLTSFNMELSSSGISADLSRGHAVVGAVGAKDWAGGFLDLKADLQDDTFIGNEPLTPEVRAGYLGYTVTWLPSRQKTSLLASGAPRYQHMGRVLLFQEPQGGGHWSQVQTIHGTQIGSYFGGELCGVDVDQDGETELLLIGAPLFYGEQRGGRVFIYQRRQLGFEEVSELQGDPGYPLGRFGEAITALTDINGDGLVDVAVGAPLEEQGAVYIFNGRHGGLSPQPSQRIEGTQVLSGIQWFGRSIHGVKDLEGDGLADVAVGAESQMIVLSSRPVVDMVTLMSFSPAEIPVHEVECSYSTSNKMKEGVNITICFQIKSLIPQFQGRLVANLTYTLQLDGHRTRRRGLFPGGRHELRRNIAVTTSMSCTDFSFHFPVCVQDLISPINVSLNFSLWEEEGTPRDQRAQGKDIPPILRPSLHSETWEIPFEKNCGEDKKCEANLRVSFSPARSRALRLTAFASLSVELSLSNLEEDAYWVQLDLHFPPGLSFRKVEMLKPHSQIPVSCEELPEESRLLSRALSCNVSSPIFKAGHSVALQMMFNTLVNSSWGDSVELHANVTCNNEDSDLLEDNSATTIIPILYPINILIQDQEDSTLYVSFTPKGPKIHQVKHMYQVRIQPSIHDHNIPTLEAVVGVPQPPSEGPITHQWSVQMEPPVPCHYEDLERLPDAAEPCLPGALFRCPVVFRQEILVQVIGTLELVGEIEASSMFSLCSSLSISFNSSKHFHLYGSNASLAQVVMKVDVVYEKQMLYLYVLSGIGGLLLLLLIFIVLYKVGFFKRNLKEKMEAGRGVPNGIPAEDSEQLASGQEAGDPGCLKPLHEKDSESGGGKD

SEQ ID NO: 7257 - protein, 162 aa, Homo Sapiens
MKDSCITVMAMALLSGFFFFAPASSYNLDVRGARSFSPPRAGRHFGYRVLQVGNGVIVGAPGEGNSTGSLYQCQSGTGHCLPVTLRGSNYTSKYLGMTLATDPTDGSILACDPGLSRTCDQNTYLSGLCYLFRQNLQGPMLQGRPGFQVCCCSVFHKLQNRI

SEQ ID NO: 7258 - protein, 1086 aa, Homo Sapiens
MKDSCITVMAMALLSGFFFFAPASSYNLDVRGARSFSPPRAGRHFGYRVLQVGNGVIVGAPGEGNSTGSLYQCQSGTGHCLPVTLRGSNYTSKYLGMTLATDPTDGSILFAAVQFSTSYKTEFDFSDYVKRKDPDALLKHVKHMLLLTNTFGAINYVATEVFREELGARPDATKVLIIITDGEATDSGNIDAAKDIIRYIIGIGKHFQTKESQETLHKFASKPASEFVKILDTFEKLKDLFTELQKKIYVIEGTSKQDLTSFNMELSSSGISADLSRGHAVVGAVGAKDWAGGFLDLKADLQDDTFIGNEPLTPEVRAGYLGYTVTWLPSRQKTSLLASGAPRYQHMGRVLLFQEPQGGGHWSQVQTIHGTQIGSYFGGELCGVDVDQDGETELLLIGAPLFYGEQRGGRVFIYQRRQLGFEEVSELQGDPGYPLGRFGEAITALTDINGDGLVDVAVGAPLEEQGAVYIFNGRHGGLSPQPSQRIEGTQVLSGIQWFGRSIHGVKDLEGDGLADVAVGAESQMIVLSSRPVVDMVTLMSFSPAEIPVHEVECSYSTSNKMKEGVNITICFQIKSLIPQFQGRLVANLTYTLQLDGHRTRRRGLFPGGRHELRRNIAVTTSMSCTDFSFHFPVCVQDLISPINVSLNFSLWEEEGTPRDQRAGKDIPPILRPSLHSETWEIPFEKNCGEDKKCEANLRVSFSPARSRALRLTAFASLSVELSLSNLEEDAYWVQLDLHFPPGLSFRKVEMLKPHSQIPVSCEELPEESRLLSRALSCNVSSPIFKAGHSVALQMMFNTLVNSSWGDSVELHANVTCNNEDSDLLEDNSATTIIPILYPINILIQDQEDSTLYVSFTPKGPKIHQVKHMYQVRIQPSIHDHNIPTLEAVVGVPQPPSEGPITHQWSVQMEPPVPCHYEDLERLPDAAEPCLPGALFRCPVVFRQEILVQVIGTLELVGEIEASSMFSLCSSLSISFNSSKHFHLYGSNASLAQVVMKVDVVYEKQMLYLYVLSGIGGLLLLLLIFIVLYKVGFFKRNLKEKMEAGRGVPNGIPAEDSEQLASGQEAGDPGCLKPLHEKDSESGGGKD

SEQ ID NO: 7259 - protein, 204 aa, Homo Sapiens
MKDSCITVMAMALLSGFFFFAPASSYNLDVRGARSFSPPRAGRHFGYRVLQVGNGVIVGAPGEGNSTGSLYQCQSGTGHCLPVTLRGSNYTSKYLGMTLATDPTDGSILFAAVQFSTSYKTEFDFSDYVKRKDPDALLKHVKHMLLLTNTFGAINYVATEVFREELGARPDATKVLIIITDGEATDSGNIDAAKDIIRYIIGVG

SEQ ID NO: 7260 - protein, 90 aa, Homo Sapiens
MKDSCITVMAMALLSGFFFFERPNGKLYPQALGRAFRALGGPGVAPSIFPEVNALEGKRRVRVAWGATSGWAWDRPPAGHVQGRGSLGRS

SEQ ID NO: 7261 - protein, 41 aa, Homo Sapiens
MTLATDPTDGSILACDPGLSRTCDQNTYLSGLCYLFRQNLQ

SEQ ID NO: 7262 - protein, 38 aa, Homo Sapiens
  misc_feature (1)..(1): Xaa can be any naturally occurring amino acid
XKEGVNITICFQIKSLIPQFQAGWPPDQKTGVVPRRET

SEQ ID NO: 7263 - protein, 1163 aa, Homo Sapiens
MTRTRAALLLFTALATSLGFNLDTEELTAFRVDSAGFGDSVVQYANSWVVVGAPQKITAANQTGGLYQCGYSTGACEPIGLQVPPEAVNMSLGLSLASTTSPSQLLACGPTVHHECGRNMYLTGLCFLLGPTQLTQRLPVSRQECPRQEQDIVFLIDGSGSISSRNFATMMNFVRAVISQFQRPSTQFSLMQFSNKFQTHFTFEEFRRSSNPLSLLASVHQLQGFTYTATAIQNVVHRLFHASYGARRDAAKILIVITDGKKEGDSLDYKDVIPMADAAGIIRYAIGVGLAFQNRNSWKELNDIASKPSQEHIFKVEDFDALKDIQNQLKEKIFAIEGTETTSSSSFELEMAQEGFSAVFTPDGPVLGAVGSFTWSGGAFLYPPNMSPTFINMSQENVDMRDSYLGYSTELALWKGVQSLVLGAPRYQHTGKAVIFTQVSRQWRMKAEVTGTQIGSYFGASLCSVDVDSDGSTDLVLIGAPHYYEQTRGGQVSVCPLPRGWRRWWCDAVLYGEQGHPWGRFGAALTVLGDVNGDKLTDVVIGAPGEEENRGAVYLFHGVLGPSISPSHSQRIAGSQLSSRLQYFGQALSGGQDLTQDGLVDLAVGARGQVLLLRTRPVLWVGVSMQFIPAEIPRSAFECREQVVSEQTLVQSNICLYIDKRSKNLLGSRDLQSSVTLDLALDPGRLSPRATFQETKNRSLSRVRVLGLKAHCENFNLLLPSCVEDSVTPITLRLNFTLVGKPLLAFRNLRPMLAADAQRYFTASLPFEKNCGADHICQDNLGISFSFPGLKSLLVGSNLELNAEVMVWNDGEDSYGTTITFSHPAGLSYRYVAEGQKQGQLRSLHLTCDSAPVGSQGTWSTSCRINHLIFRGGAQITFLATFDVSPKAVLGDRLLLTANVSSENNTPRTSKTTFQLELPVKYAVYTVVSSHEQFTKYLNFSESEEKESHVAMHRYQVNNLGQRDLPVSINFWVPVELNQEAVWMDVEVSHPQNPSLRCSSEKIAPPASDFLAHIQKNPVLDCSIAGCLRFRCDVPSFSVQEELDFTLKGNLSFGWVRQILQKKVSVVSVAEITFDTSVYSQLPGQEAFMRAQTTTVLEKYKVHNPTPLIVGSSIGGLLLLALITAVLYKVGFFKRQYKEMMEEANGQIAPENGTQTPSPPSEK

SEQ ID NO: 7264 - protein, 1169 aa, Homo Sapiens
MTRTRAALLLFTALATSLGFNLDTEELTAFRVDSAGFGDSVVQYANSWVVVGAPQKITAANQTGGLYQCGYSTGACEPIGLQVPPEAVNMSLGLSLASTTSPSQLLACGPTVHHECGRNMYLTGLCFLLGPTQLTQRLPVSRQECPRQEQDIVFLIDGSGSISSRNFATMMNFVRAVISQFQRPSTQFSLMQFSNKFQTHFTFEEFRRSSNPLSLLASVHQLQGFTYTATAIQNVVHRLFHASYGARRDAAKILIVITDGKKEGDSLDYKDVIPMADAAGIIRYAIGVGLAFQNRNSWKELNDIASKPSQEHIFKVEDFDALKDIQNQLKEKIFAIEGTETTSSSSFELEMAQEGFSAVFTPDGPVLGAVGSFTWSGGAFLYPPNMSPTFINMSQENVDMRDSYLGYSTELALWKGVQSLVLGAPRYQHTGKAVIFTQVSRQWRMKAEVTGTQIGSYFGASLCSVDVDSDGSTDLVLIGAPHYYEQTRGGQVSVCPLPRGWRRWWCDAVLYGEQGHPWGRFGAALTVLGDVNGDKLTDVVIGAPGEEENRGAVYLFHGVLGPSISPSHSQRIAGSQLSSRLQYFGQALSGGQDLTQDGLVDLAVGARGQVLLLRTRPVLWVGVSMQFIPAEIPRSAFECREQVVSEQTLVQSNICLYIDKRSKNLLGSRDLQSSVTLDLALDPGRLSPRATFQETKNRSLSRVRVLGLKAHCENFNLLLPSCVEDSVTPITLRLNFTLVGKPLLAFRNLRPMLAADAQRYFTASLPFEKNCGADHICQDNLGISFSFPGLKSLLVGSNLELNAEVMVWNDGEDSYGTTITFSHPAGLSYRYVAEGQKQGQLRSLHLTCDSAPVGSQGTWSTSCRINHLIFRGGAQITFLATFDVSPKAVLGDRLLLTANVSSENNTPRTSKTTFQLELPVKYAVYTVVSSHEQFTKYLNFSESEEKESHVAMHRYQVNNLGQRDLPVSINFWVPVELNQEAVWMDVEVSHPQNPSLRCSSEKIAPPASDFLAHIQKNPVLDCSIAGCLRFRCDVPSFSVQEELDFTLKGNLSFGWVRQILQKKVSVVSVAEITFDTSVYSQLPGQEAFMRAQTTTVLEKYKVHNPTPLIVGSSIGGLLLLALITAVLYKVGFFKRQYKEMMEEANGQIAPENGTQTPSPPTPHYPQDNV

SEQ ID NO: 7265 - protein, 181 aa, Homo Sapiens
MTRTRAALLLFTALATSLGFNLDTEELTAFRVDSAGFGDSVVQYANSWVVVGAPQKITAANQTGGLYQCGYSTGACEPIGLQVPPEAVNMSLGLSLASTTSPSQLLLTQRLPVSRQGECRDHQGFEELTHIQLGVRWARDSLARVDQKEGIWKKSYHVLQWFLTLLPAHPADRPHAAGPFL

SEQ ID NO: 7266 - protein, 49 aa, Homo Sapiens
MNLQPIFWIGLISSVCCVFAQTDENRCLKANAKSCGECIQAGPNCGWCT

SEQ ID NO: 7267 - protein, 89 aa, Homo Sapiens
MNLQPIFWIGLISSVCCVFAQTDENRCLKANAKSCGECIQAGPNCGWCTNSTFLQEGMPTSARCDDLEALKKKGCPPDDIENPRGSKDI

SEQ ID NO: 7268 - protein, 104 aa, Homo Sapiens
MNLQPIFWIGLISSVCCVFAQTDENRCLKANAKSCGECIQAGPNCGWCTNSTFLQEGMPTSARCDDLEALKKKGCPPDDIENPRGSKDIKKNKNVTNRSKGTAE

SEQ ID NO: 7269 - protein, 125 aa, Homo Sapiens
MNLQPIFWIGLISSVCCVFAQTDENRCLKANAKSCGECIQAGPNCGWCTNSTFLQEGMPTSARCDDLEALKKKGCPPDDIENPRGSKDIKKNKNVTNRSKGTAEKLKPEDITQIQPQQLVLRLRS

SEQ ID NO: 7270 - protein, 136 aa, Homo Sapiens
MNLQPIFWIGLISSVCCVFAQTDENRCLKANAKSCGECIQAGPNCGWCTNSTFLQEGMPTSARCDDLEALKKKGCPPDDIENPRGSKDIKKNKNVTNRSKGTAEKLKPEDITQIQPQQLVLRLRSGEPQTFTLKFK

SEQ ID NO: 7271 - protein, 143 aa, Homo Sapiens
MNLQPIFWIGLISSVCCVFAQTDENRCLKANAKSCGECIQAGPNCGWCTNSTFLQEGMPTSARCDDLEALKKKGCPPDDIENPRGSKDIKKNKNVTNRSKGTAEKLKPEDITQIQPQQLVLRLRSGEPQTFTLKFKRAEDYPI

SEQ ID NO: 7272 - protein, 163 aa, Homo Sapiens
MNLQPIFWIGLISSVCCVFAQTDENRCLKANAKSCGECIQAGPNCGWCTNSTFLQEGMPTSARCDDLEALKKKGCPPDDIENPRGSKDIKKNKNVTNRSKGTAEKLKPEDITQIQPQQLVLRLRSGEPQTFTLKFKRAEDYPIDLYYLMDLSYSMKDDLENVK

SEQ ID NO: 7273 - protein, 798 aa, Homo Sapiens
MNLQPIFWIGLISSVCCVFAQTDENRCLKANAKSCGECIQAGPNCGWCTNSTFLQEGMPTSARCDDLEALKKKGCPPDDIENPRGSKDIKKNKNVTNRSKGTAEKLKPEDITQIQPQQLVLRLRSGEPQTFTLKFKRAEDYPIDLYYLMDLSYSMKDDLENVKSLGTDLMNEMRRITSDFRIGFGSFVEKTVMPYISTTPAKLRNPCTSEQNCTSPFSYKNVLSLTNKGEVFNELVGKQRISGNLDSPEGGFDAIMQVAVCGSLIGWRNVTRLLVFSTDAGFHFAGDGKLGGIVLPNDGQCHLENNMYTMSHYYDYPSIAHLVQKLSENNIQTIFAVTEEFQPVYKELKNLIPKSAVGTLSANSSNVIQLIIDAYNSLSSEVILENGKLSEGVTISYKSYCKNGVNGTGENGRKCSNISIGDEVQFEISITSNKCPKKDSDSFKIRPLGFTEEVEVILQYICECECQSEGIPESPKCHEGNGTFECGACRCNEGRVGRHCECSTDEVNSEDMDAYCRKENSSEICSNNGECVCGQCVCRKRDNTNEIYSGKFCECDNFNCDRSNGLICGGNGVCKCRVCECNPNYTGSACDCSLDTSTCEASNGQICNGRGICECGVCKCTDPKFQGQTCEMCQTCLGVCAEHKECVQCRAFNKGEKKDTCTQECSYFNITKVESRDKLPQPVQPDPVSHCKEKDVDDCWFYFTYSVNGNNEVMVHVVENPECPTGPDIIPIVAGVVAGIVLIGLALLLIWKLLMIIHDRREFAKFEKEKMNAKWDTGENPIYKSAVTTVVNPKYEGK

SEQ ID NO: 7274 - protein, 798 aa, Homo Sapiens; identical to SEQ ID NO: 7273

SEQ ID NO: 7275 - protein, 801 aa, Homo Sapiens
MNLQPIFWIGLISSVCCVFAQTDENRCLKANAKSCGECIQAGPNCGWCTNSTFLQEGMPTSARCDDLEALKKKGCPPDDIENPRGSKDIKKNKNVTNRSKGTAEKLKPEDITQIQPQQLVLRLRSGEPQTFTLKFKRAEDYPIDLYYLMDLSYSMKDDLENVKSLGTDLMNEMRRITSDFRIGFGSFVEKTVMPYISTTPAKLRNPCTSEQNCTSPFSYKNVLSLTNKGEVFNELVGKQRISGNLDSPEGGFDAIMQVAVCGSLIGWRNVTRLLVFSTDAGFHFAGDGKLGGIVLPNDGQCHLENNMYTMSHYYDYPSIAHLVQKLSENNIQTIFAVTEEFQPVYKELKNLIPKSAVGTLSANSSNVIQLIIDAYNSLSSEVILENGKLSEGVTISYKSYCKNGVNGTGENGRKCSNISIGDEVQFEISITSNKCPKKDSDSFKIRPLGFTEEVEVILQYICECECQSEGIPESPKCHEGNGTFECGACRCNEGRVGRHCECSTDEVNSEDMDAYCRKENSSEICSNNGECVCGQCVCRKRDNTNEIYSGKFCECDNFNCDRSNGLICGGNGVCKCRVCECNPNYTGSACDCSLDTSTCEASNGQICNGRGICECGVCKCTDPKFQGQTCEMCQTCLGVCAEHKECVQCRAFNKGEKKDTCTQECSYFNITKVESRDKLPQPVQPDPVSHCKEKDVDDCWFYFTYSVNGNNEVMVHVVENPECPTGPDIIPIVAGVVAGIVLIGLALLLIWKLLMIIHDRREFAKFEKEKMNAKWDTQENPIYKSPINNFKNPNYGRKAGL

SEQ ID NO: 7276 - protein, 152 aa, Homo Sapiens
MNLQPIFWIGLISSVCCVFAQTDENRCLKANAKSCGECIQAGPNCGWCTNSVSKTFLQEGMPTSARCDDLEALKKKGCPPDDIENPRGSKDIKKNKNVTNRSKGTAEKLKPEDITQIQPQQLVLRLRSGEPQTFTLKFKRAEDYPIDLYYLM

SEQ ID NO: 7277 - protein, 14 aa, Homo Sapiens
MPTSARCDDLEALK

SEQ ID NO: 7278 - protein, 31 aa, Homo Sapiens
MPTSARCDDLEALKKKGCPPDDIENPRGSKD

SEQ ID NO: 7279 - protein, 98 aa, Homo Sapiens
MPTSARCDDLEALKKKGCPPDDIENPRGSKDIKKNKNVTNRSKGTAEKLKPEDITQIQPQQLVLRLRSGEPQTFTLKFKRAEDYPIDLYYLMDLSYSM

SEQ ID NO: 7280 - protein, 108 aa, Homo Sapiens
  misc_feature (1)..(1): Xaa can be any naturally occurring amino acid
XDMDAYCRKENSSEICSNNGECVCGQCVCRKRDNTNEIYSGKFCECDNFNCDRSNGLICGGNGVCKCRVCECNPNYTGSACDCSLDTSTCEASNGQICNGRGICECGV

SEQ ID NO: 7281 - protein, 70 aa, Homo Sapiens
  misc_feature (1)..(1): Xaa can be any naturally occurring amino acid
XVAGVVAGIVLIGLALLLIWKLLMIIHDRREFAKFEKEKMNAKWDTQENPIYKSPINNFKNPNYGRKAGL

SEQ ID NO: 7282 - protein, 322 aa, Homo Sapiens
GRLGKDLATGVLSQECTKFKVSSCRECIESGPGCTWCQKLNFTGPGDPDSIRCDTRPQLLMRGCAADDIMDPTSLAETQEDHNGGQKQLSPQKVTLYLRPGQAAAFNVTFRRAKGYPIDLYYLMDLSYSMLDDLRNVKKLGGDLLRALNEITESGRIGFGSFVDKTVLPFVNTHPDKLRNPCPNKEKECQPPFAFRHVLKLTNNSNQFQTEVGKQLISGNLDAPEGGLDAMMQVAACPEEIGWRNVTRLLVFATDDGFHFAGDGKLGAILTPNDGRCHLEDNLYKRSNEFDYPSVGQLAHKLAENNIQPIFAVTSRMVKTYE

SEQ ID NO: 7283 - protein, 71 aa, Homo Sapiens
MLGLRPPLLALVGLLSLGCGRPRAPTHQPASSLSPLSGVHEVQGQQLPGMHRVGARLHLVPEAELHRAGGS

SEQ ID NO: 7284 - protein, 49 aa, Homo Sapiens
MLGLRPPLLALVGLLSLGCVLSQECTKFKVSSCRECIESGPGCTWCQKL

SEQ ID NO: 7285 - protein, 93 aa, Homo Sapiens
MLGLRPPLLALVGLLSLGCVLSQECTKFKVSSCRECIESGPGCTWCQKLGAALGPPAHATAASSPRRRSRVAPVCPRTEQGGQAPELHRAGGS

SEQ ID NO: 7286 - protein, 108 aa, Homo Sapiens
MLGLRPPLLALVGLLSLGCVLSQECTKFKVSSCRECIESGPGCTWCQKLGAALGPPAHATAASSPRRRSRVAPVCPRTEQGGQAPGGNYLGQAGFFPSPFWRFSAPLK

SEQ ID NO: 7287 - protein, 70 aa, Homo Sapiens
MLGLRPPLLALVGLLSLGCVLSQECTKFKVSSCRECIESGPGCTWCQKLNFTGPGDPDSIRCDTRPQLLM

SEQ ID NO: 7288 - protein, 712 aa, Homo Sapiens
MLGLRPPLLALVGLLSLGCVLSQECTKFKVSSCRECIESGPGCTWCQKLNFTGPGDPDSIRCDTRPQLLMRGCAADDIMDPTSLAETQEDHNGGQKQLSPQKVTLYLRPGFGSFVDKTVLPFVNTHPDKLRNPCPNKEKECQPPFAFRHVLKLTNNSNQFQTEVGKQLISGNLDAPEGGLDAMMQVAACPEEIGWRNVTRLLVFATDDGFHFAGDGKLGAILTPNDGRCHLEDNLYKRSNEFDYPSVGQLAHKLAENNIQPIFAVTSRMVKTYEKLTEIIPKSAVGELSEDSSNVVHLIKNAYNKLSSRVFLDHNALPDTLKVTYDSFCSNGVTHRNQPRGDCDGVQINVPITFQVKVTATECIQEQSFVIRALGFTDIVTVQVLPQCECRCRDQSRDRSLCHGKGFLECGICRCDTGYIGKNCECQTQGRSSQELEGSCRKDNNSIICSGLGDCVCGQCLCHTSDVPGKLIYGQYCECDTINCERYNGQVCGGPGRGLCFCGKCRCHPGFEGSACQCERTTEGCLNPRRVECSGRGRCRCNVCECHSGYQLPLCQECPGCPSPCGKYISCAECLKFEKGPFGKNCSAACPGLQLSNNPVKGRTCKERDSEGCWVAYTLEQQDGMDRYLIYVDESRECVAGPNIAAIVGGTVAGIVLIGILLLVIWKALIHLSDLREYRRFEKEKLKSQWNNDNPLFKSATTTVMNPKFAES

SEQ ID NO: 7289 - protein, 120 aa, Homo Sapiens
MLGLRPPLLALVGLLSLGCVLSQECTKFKVSSCRECIESGPGCTWCQKLNFTGPGDPDSIRCDTRPQLLMRGCAADDIMDPTSLAETQEDHNGGQKQLSPQKVTLYLRPGQAAAFNVTFR

SEQ ID NO: 7290 - protein, 160 aa, Homo Sapiens
MLGLRPPLLALVGLLSLGCVLSQECTKFKVSSCRECIESGPGCTWCQKLNFTGPGDPDSIRCDTRPQLLMRGCAADDIMDPTSLAETQEDHNGGQKQLSPQKVTLYLRPGQAAAFNVTFRRAKGYPIDLYYLMDLSYSMLDDLRNVKKLGGDLLRALNEI

SEQ ID NO: 7291 - protein, 166 aa, Homo Sapiens
MLGLRPPLLALVGLLSLGCVLSQECTKFKVSSCRECIESGPGCTWCQKLNFTGPGDPDSIRCDTRPQLLMRGCAADDIMDPTSLAETQEDHNGGQKQLSPQKVTLYLRPGQAAAFNVTFRRAKGYPIDLYYLMDLSYSMLDDLRNVKKLGGDLLRALNEITESGRI

SEQ ID NO: 7292 - protein, 769 aa, Homo Sapiens
MLGLRPPLLALVGLLSLGCVLSQECTKFKVSSCRECIESGPGCTWCQKLNFTGPGDPDSIRCDTRPQLLMRGCAADDIMDPTSLAETQEDHNGGQKQLSPQKVTLYLRPGQAAAFNVTFRRAKGYPIDLYYLMDLSYSMLDDLRNVKKLGGDLLRALNEITESGRIGFGSFVDKTVLPFVNTHPDKLRNPCPNKEKECQPPFAFRHVLKLTNNSNQFQTEVGKQLISGNLDAPEGGLDAMMQVAACPEEIGWRNVTRLLVFATDDGFHFAGDGKLGAILTPNDGRCHLEDNLYKRSNEFDYPSVGQLAHKLAENNIQPIFAVTSRMVKTYEKLTEIIPKSAVGELSEDSSNVVHLIKNAYNKLSSRVFLDHNALPDTLKVTYDSFCSNGVTHRNQPRGDCDGVQINVPITFQVKVTATECIQEQSFVIRALGFTDIVTVQVLPQCECRCRDQSRDRSLCHGKGFLECGICRCDTGYIGKNCECQTQGRSSQELEGSCRKDNNSIICSGLGDCVCGQCLCHTSDVPGKLIYGQYCECDTINCERYNGQVCGGPGRGLCFCGKCRCHPGFEGSACQCERTTEGCLNPRRVECSGRGRCRCNVCECHSGYQLPLCQECPGCPSPCGKYISCAECLKFEKGPFGKNCSAACPGLQLSNNPVKGRTCKERDSEGCWVAYTLEQQDGMDRYLIYVDESRECVAGPNIAAIVGGTVAGIVLIGILLLVIWKALIHLSDLREYRRFEKEKLKSQWNNDNPLFKSATTTVMNPKFAES

SEQ ID NO: 7293 - protein, 769 aa, Homo Sapiens; identical to SEQ ID NO: 7292

SEQ ID NO: 7294 - protein, 769 aa, Homo Sapiens; identical to SEQ ID NO: 7292

SEQ ID NO: 7295 - protein, 769 aa, Homo Sapiens; identical to SEQ ID NO: 7292

SEQ ID NO: 7296 - protein, 769 aa, Homo Sapiens; identical to SEQ ID NO: 7292

SEQ ID NO: 7297 - protein, 37 aa, Homo Sapiens
MRGCAADDIMDPTSLAETQEDHNGGQKQLSPQKVTLY

SEQ ID NO: 7298 - protein, 49 aa, Homo Sapiens
MRGCAADDIMDPTSLAETQEDHNGGQKQLSPQKVTLYLRPGQAAAFNVT

SEQ ID NO: 7299 - protein, 35 aa, Homo Sapiens
LKSCMGLKIGDTVRWAGQGLCPGASVGTQPPFFLL

SEQ ID NO: 7300 - protein, 788 aa, Homo Sapiens
MRARPRPRPLWATVLALGALAGVGVGGPNICTTRGVSSCQQCLAVSPMCAWCSDEALPLGSPRCDLKENLLKDNCAPESIEFPVSEARVLEDRPLSDKGSGDSSQVTQVSPQRIALRLRPDDSKNFSIQVRQVEDYPVDIYYLMDLSYSMKDDLWSIQNLGTKLATQMRKLTSNLRIGFGAFVDKPVSPYMYISPPEALENPCYDMKTTCLPMFGYKHVLTLTDQVTRFNEEVKKQSVSRNRDAPEGGFDAIMQATVCDEKIGWRNDASHLLVFTTDAKTHIALDGRLAGIVQPNDGQCHVGSDNHYSASTTMDYPSLGLMTEKLSQKNINLIFAVTENVVNLYQNYSELIPGTTVGVLSMDSSNVLQLIVDAYGKIRSKVELEVRDLPEELSLSFNATCLNNEVIPGLKSCMGLKIGDTVSFSIEAKVRGCPQEKEKSFTIKPVGFKDSLIVQVTFDCDCACQAQAEPNSHRCNNGNGTFECGVCRCGPGWLGSQCECSEEDYRPSQQDECSPREGQPVCSQRGECLCGQCVCHSSDFGKITGKYCECDDFSCVRYKGEMCSGHGQCSCGDCLCDSDWTGYYCNCTTRTDTCMSSNGLLCSGRGKCECGSCVCIQPGSYGDTCEKCPTCPDACTFKKECVECKKFDRGALHDENTCNRYCRDEIESVKELKDTGKDAVNCTYKNEDDCVVRFQYYEDSSGKSILYVVEEPECPKGPDILVVLLSVMGAILLIGLAALLIWKLLITIHDRKEFAKFEEERARAKWDTANNPLYKEATSTFTNITYRGT

SEQ ID NO: 7301 - protein, 443 aa, Homo Sapiens
MRARPRPRPLWATVLALGALAGVGVGGPNICTTRGVSSCQQCLAVSPMCAWCSDEALPLGSPRCDLKENLLKDNCAPESIEFPVSEARVLEDRPLSDKGSGDSSQVTQVSPQRIALRLRPDDSKNFSIQVRQVEDYPVDIYYLMDLSYSMKDDLWSIQNLGTKLATQMRKLTSNLRIGFGAFVDKPVSPYMYISPPEALENPCYDMKTTCLPMFGYKHVLTLTDQVTRFNEEVKKQSVSRNRDAPEGGFDAIMQATVCDEKIGWRNDASHLLVFTTDAKTHIALDGRLAGIVQPNDGQCHVGSDNHYSASTTMDYPSLGLMTEKLSQKNINLIFAVTENVVNLYQNYSELIPGTTVGVLSMDSSNVLQLIVDAYGKIRSKVELEVRDLPEELSLSFNATCLNNEVIPGLKSCMGLKIGDTVRWAGQGLCPGASVGTQPPFFLL

SEQ ID NO: 7302 - protein, 89 aa, Homo Sapiens
MVALPMVLVLLLVLSRGESELDAKIPSTGDATEWRNPHLSMLGSCQPAPSCQKCILSHPSCAWCKQLNFTASGEAEARRCARREELLAR

SEQ ID NO: 7303 - protein, 93 aa, Homo Sapiens
MVALPMVLVLLLVLSRGESELDAKIPSTGDATEWRNPHLSMLGSCQPAPSCQKCILSHPSCAWCKQLNFTASGEAEARRCARREELLARGCPL

SEQ ID NO: 7304 - protein, 158 aa, Homo Sapiens
MVALPMVLVLLLVLSRGESELDAKIPSTGDATEWRNPHLSMLGSCQPAPSCQKCILSHPSCAWCKQLNFTASGEAEARRCARREELLARGCPLEELEEPRGQQEVLQDQPLSQGARGEGATQLAPQRVRVTLRPGEPQQLQVRFLRAEGYPVDLYYLM

SEQ ID NO: 7305 - protein, 798 aa, Homo Sapiens
MVALPMVLVLLLVLSRGESELDAKIPSTGDATEWRNPHLSMLGSCQPAPSCQKCILSHPSCAWCKQLNFTASGEAEARRCARREELLARGCPLEELEEPRGQQEVLQDQPLSQGARGEGATQLAPQRVRVTLRPGEPQQLQVRFLRAEGYPVDLYYLMDLSYSMKDDLERVRQLGHALLVRLQEVTHSVRIGFGSFVDKTVLPFVSTVPSKLRHPCPTRLERCQSPFSFHHVLSLTGDAQAFEREVGRQSVSGNLDSPEGGFDAILQAALCQEQIGWRNVSRLLVFTSDDTFHTAGDGKLGGIFMPSDGHCHLDSNGLYSRSTEFDYPSVGQVAQALSAANIQPIFAVTSAALPVYQELSKLIPKSAVGELSEDSSNVVQLIMDAYNSLSSTVTLEHSSLPPGVHISYESQCEGPEKREGKAEDRGQCNHVRINQTVTFWVSLQATHCLPEPHLLRLRALGFSEELIVELHTLCDCNCSDTQPQAPHCSDGQGHLQCGVCSCAPGRLGRLCECSVAELSSPDLESGCRAPNGTGPLCSGKGHCQCGRCSCSGQSSGHLCECDDASCERHEGILCGGFGRCQCGVCHCHANRTGRACECSGDMDSCISPEGGLCSGHGRCKCNRCQCLDGYYGALCDQCPGCKTPCERHRDCAECGAFRTGPLATNCSTACAHTNVTLALAPILDDGWCKERTLDNQLFFFLVEDDARGTVVLRVRPQEKGADHTQAIVLGCVGGIVAVGLGLVLAYRLSVEIYDRREYSRFEKEQQQLNWKQDSNPLYKSAITTTINPRFQEADSPTL

SEQ ID NO: 7306 - protein, 798 aa, Homo Sapiens; identical to SEQ ID NO: 7305

SEQ ID NO: 7307 - protein, 650 aa, Homo Sapiens
MVALPMVLVLLLVLSRGESELDAKIPSTGDATEWRNPHLSMLGSCQPAPSCQKCILSHPSCAWCKQLNFTASGEAEARRCARREELLARGCPLEELEEPRGQQEVLQDQPLSQGARGEGATQLAPQRVRVTLRPGEPQQLQVRFLRAEGYPVDLYYLMDLSYSMKDDLERVRQLGHALLVRLQEVTHSVRIGFGSFVDKTVLPFVSTVPSKLRHPCPTRLERCQSPFSFHHVLSLTGDAQAFEREVGRQSVSGNLDSPEGGFDAILQAALCQEQIGWRNVSRLLVFTSDDTFHTAGDGKLGGIFMPSDGHCHLDSNGLYSRSTEFDYPSVGQVAQALSAANIQPIFAVTSAALPVYQELSKLIPKSAVGELSEDSSNVVQLIMDAYNSLSSTVTLEHSSLPPGVHISYESQCEGPEKREGKAEDRGQCNHVRINQTVTFWVSLQATHCLPEPHLLRLRALGFSEELIVELHTLCDCNCSDTQPQAPHCSDGQGHLQCGVCRDCAECGAFRTGPLATNCSTACAHTNVTLALAPILDDGWCKERTLDNQLFFFLVEDDARGTVVLRVRPQEKGADHTQAIVLGCVGGIVAVGLGLVLAYRLSVEIYDRREYSRFEKEQQQLNWKQDSNPLYKSAITTTINPRFQEADSPTL

SEQ ID NO: 7308 - protein, 471 aa, Homo Sapiens
MVALPMVLVLLLVLSRGESELDAKIPSTGDATEWRNPHLSMLGSCQPAPSCQKCILSHPSCAWCKQLNFTASGEAEARRCARREELLARGCPLEELEEPRGQQEVLQDQPLSQGARGEGATQLAPQRVRVTLRPGEPQQLQVRFLRAEGYPVDLYYLMDLSYSMKDDLERVRQLGHALLVRLQEVTHSVRIGFGSFVDKTVLPFVSTVPSKLRHPCPTRLERCQSPFSFHHVLSLTGDAQAFEREVGRQSVSGNLDSPEGGFDAILQAALCQEQIGWRNVSRLLVFTSDDTFHTAGDGKLGGIFMPSDGHCHLDSNGLYSRSTEFDYPSVGQVAQALSAANIQPIFAVTSAALPVYQELSKLIPKSAVGELSEDSSNVVQLIMDAYNSLSSTVTLEHSSLPPGVHISYESQCEGPEKREGKAEDRGQCNHVRINQTGLCRVWGLQDWPTGHQLQYSLCPYQCDPGLGPYLG

SEQ ID NO: 7309 - protein, 117 aa, Homo Sapiens
  misc_feature (1)..(1): Xaa can be any naturally occurring amino acid
XSTACAHTNVTLALAPILDDGWCKERTLDNQLFFFLVEDDARGTVVLRVRPQEKGADHTQAIVLGCVGGIVAVGLGLVLAYRLSVEIYDRREYSRFEKEQQQLNWKQLLGFGSRLAS

SEQ ID NO: 7310 - protein, 353 aa, Homo Sapiens
MCKNSQDIICSNAGTCHCGRCKCDNSDGSGLVYGKFCECDDRECIDDETEEICGGHGKCYCGNCYCKAGWHGDKCEFQCDITPWESKRRCTSPDGKICSNRGTCVCGECTCHDVDPTGDWGDIHGDTCECDERDCRAVYDRYSDDFCSGHGQCNCGRCDCKAGWYGKKCEHPQSCTLSAEESIRKCQGSSDLPCSGRGKCECGKCTCYPPGDRRVYGKTCECDDRRCEDLDGVVCGGHGTCSCGRCVCERGWFGKLCQHPRKCNMTEEQSKNLCESADGILCSGKGSCHCGKCICSAEEWYISGEFCDCDDRDCDKHDGLICTGNGICSCGNCECWDGWNGNACEIWLGSEYP

SEQ ID NO: 7311 - protein, 401 aa, Homo Sapiens
MNLVAVMGAFNKGHGKCDCGKCKCDQGWYGDACQYPTNCDLTKKKSNQMCKNSQDIICSNAGTCHCGRCKCDNSDGSGLVYGKFCECDDRECIDDETEEICGGHGKCYCGNCYCKAGWHGDKCEFQCDITPWESKRRCTSPDGKICSNRGTCVCGECTCHDVDPTGDWGDIHGDTCECDERDCRAVYDRYSDDFCSGHGQCNCGRCDCKAGWYGKKCEHPQSCTLSAEESIRKCQGSSDLPCSGRGKCECGKCTCYPPGDRRVYGKTCECDDRRCEDLDGVVCGGHGTCSCGRCVCERGWFGKLCQHPRKCNMTEEQSKNLCESADGILCSGKGSCHCGKCICSAEEWYISGEFCDCDDRDCDKHDGLICTGNGICSCGNCECWDGWNGNACEIWLGSEYP

SEQ ID NO: 7312 - protein, 494 aa, Homo Sapiens
MRPPGFRNFLLLASSLLFAGLSAVPQSFSPSLRSWPGAACRLSRAESERRCRAPGQPPGAALCHGRGRCDCGVCICHVTEPGMFFGPLCECHEWVCETYDGSTCAGHGKCDCGKCKCDQGWYGDACQYPTNCDLTKKKSNQMCKNSQDIICSNAGTCHCGRCKCDNSDGSGLVYGKFCECDDRECIDDETEEICGGHGKCYCGNCYCKAGWHGDKCEFQCDITPWESKRRCTSPDGKICSNRGTCVCGECTCHDVDPTGDWGDIHGDTCECDERDCRAVYDRYSDDFCSGHGQCNCGRCDCKAGWYGKKCEHPQSCTLSAEESIRKCQGSSDLPCSGRGKCECGKCTCYPPGDRRVYGKTCECDDRRCEDLDGVVCGGHGTCSCGRCVCERGWFGKLCQHPRKCNMTEEQSKNLCESADGILCSGKGSCHCGKCICSAEEWYISGEFCDCDDRDCDKHDGLICTGNGICSCGNCECWDGWNGNACEIWLGSEYP

SEQ ID NO: 7313 - protein, 445 aa, Homo Sapiens
MRPPGFRNFLLLASSLLFAGLSAVPQSFSPSLRSWPGAACRLSRAESERRCRAPGQPPGAALCHGRGRCDCGVCICHVTEPGMFFGPLCECHEWVCETYDGSTCAGTCHCGRCKCDNSDGSGLVYGKFCECDDRECIDDETEEICGGHGKCYCGNCYCKAGWHGDKCEFQCDITPWESKRRCTSPDGKICSNRGTCVCGECTCHDVDPTGDWGDIHGDTCECDERDCRAVYDRYSDDFCSGHGQCNCGRCDCKAGWYGKKCEHPQSCTLSAEESIRKCQGSSDLPCSGRGKCECGKCTCYPPGDRRVYGKTCECDDRRCEDLDGVVCGGHGTCSCGRCVCERGWFGKLCQHPRKCNMTEEQSKNLCESADGILCSGKGSCHCGKCICSAEEWYISGEFCDCDDRDCDKHDGLICTGNGICSCGNCECWDGWNGNACEIWLGSEYP

SEQ ID NO: 7314 - protein, 401 aa, Homo Sapiens
MSGCARPTTGAPVQAMVSVGKCKCDQGWYGDACQYPTNCDLTKKKSNQMCKNSQDIICSNAGTCHCGRCKCDNSDGSGLVYGKFCECDDRECIDDETEEICGGHGKCYCGNCYCKAGWHGDKCEFQCDITPWESKRRCTSPDGKICSNRGTCVCGECTCHDVDPTGDWGDIHGDTCECDERDCRAVYDRYSDDFCSGHGQCNCGRCDCKAGWYGKKCEHPQSCTLSAEESIRKCQGSSDLPCSGRGKCECGKCTCYPPGDRRVYGKTCECDDRRCEDLDGVVCGGHGTCSCGRCVCERGWFGKLCQHPRKCNMTEEQSKNLCESADGILCSGKGSCHCGKCICSAEEWYISGEFCDCDDRDCDKHDGLICTGNGICSCGNCECWDGWNGNACEIWLGSEYP

SEQ ID NO: 7315 - protein, 208 aa, Homo Sapiens
  misc_feature (1)..(1): Xaa can be any naturally occurring amino acid
XCEGHGQCNCGRCDCKAGWYGKKCEHPQSCTLSAEESIRKCQGSSDLPCSGRGKCECGKCTCYPPGDRRVYGKTCECDDRRCEDLDGVVCGGHGTCSCGRCVCERGWFGKLCQHPRKCNMTEEQSKNLCESADGILCSGKGSCHCGKCICSAEEWYISGEFCDCDDRDCDKHDGLICTGNGICSCGNCECWDGWNGNACEIWLGSEYP

SEQ ID NO: 7316 - protein, 911 aa, Homo Sapiens
MDGAMGPRGLLLCMYLVSLLILQAMPALGSATGRSKSSEKRQAVDTAVDGVFIRSLKVNCKVTSRFAHYVVTSQVVNTANEAREVAFDLEIPKTAFISDFAVTADGNAFIGDIKDKVTAWKQYRKAAISGENAGLVRASGRTMEQFTIHLTVNPQSKVTFQLTYEEVLKRNHMQYEIVIKVKPKQLVHHFEIDVDIFEPQGISKLDAQASFLPKELAAQTIKKSFSGKKGHVLFRPTVSQQQSCPTCSTSLLNGHFKVTYDVSRDKICDLLVANNHFAHFFAPQNLTNMNKNVVFVIDISGSMRGQKVKQTKEALLKILGDMQPGDYFDLVLFGTRVQSWKGSLVQASEANLQAAQDFVRGFSLDEATNLNGGLLRGIEILNQVQESLPELSNHASILIMLTDGDPTEGVTDRSQILKNVRNAIRGRFPLYNLGFGHNVDFNFLEVMSMENNGRAQRIYEDHDATQQLQGFYSQVAKPLLVDVDLQYPQDAVLALTQNHHKQYYEGSEIVVAGRIADNKQSSFKADVQAHGEGQEFSITCLVDEEEMKKLLRERGHMLENHVERLWAYLTIQELLAKRMKVDREERANLSSQALQMSLDYGFVTPLTSMSIRGMADQDGLKPTIDKPSEDSPPLEMLGPRRTFVLSALQPSPTHSSSNTQRLPDRVTGVDTDPHFIIHVPQKEDTLCFNINEEPGVILSLVQDPNTGFSVNGQLIGNKARSPGQHDGTYFGRLGIANPATDFQLEVTPQNITLNPGFGGPVFSWRDQAVLRQDGVVVTINKKRNLVVSVDDGGTFEVVLHRVWKGSSVHQDFLGFYVLDSHRMSARTHGLLGQFFHPIGFEVSDIHPGSDPTKPDATMVVRNRRLTVTRGLQKDYSKDPWHGAEVSCWFIHNNGAGLIDGAYTDYIVPDIF

SEQ ID NO: 7317 - protein, 213 aa, Homo Sapiens
MDGAMGPRGLLLCMYLVSLLILQAMPALGSATGRSKSSEKRQAVDTAVDGVFIRSLKVNCKVTSRFAHYVVTSQVVNTANEAREVAFDLEIPKTAFISDFAVTADGNAFIGDIKDKVTAWKQYRKAAISGENAGLVRASGRTMEQFTIHLTVNPQSKVTFQLTYEEVLKRNHMQYEIVIKVKPKQLVHHFEVDHRSRGRGPAPLSVTMAPNTG

SEQ ID NO: 7318 - protein, 623 aa, Homo Sapiens
MNKNVVFVIDISGSMRGQKVKQTKEALLKILGDMQPGDYFDLVLFGTRVQSWKGSLVQASEANLQAAQDFVRGFSLDEATNLNGGLLRGIEILNQVQESLPELSNHASILIMLTDGDPTEGVTDRSQILKNVRNAIRGRFPLYNLGFGHNVDFNFLEVMSMENNGRAQRIYEDHDATQQLQGFYSQVAKPLLVDVDLQYPQDAVLALTQNHHKQYYEGSEIVVAGRIADNKQSSFKADVQAHGEGQEFSITCLVDEEEMKKLLRERGHMLENHVERLWAYLTIQELLAKRMKVDREERANLSSQALQMSLDYGFVTPLTSMSIRGMADQDGLKPTIDKPSEDSPPLEMLGPRRTFVLSALQPSPTHSSSNTQRLPDRVTGVDTDPHFIIHVPQKEDTLCFNINEEPGVILSLVQDPNTGFSVNGQLIGNKARSPGQHDGTYFGRLGIANPATDFQLEVTPQNITLNPGFGGPVFSWRDQAVLRQDGVVVTINKKRNLVVSVDDGGTFEVVLHRVWKGSSVHQDFLGFYVLDSHRMSARTHGLLGQFFHPIGFEVSDIHPGSDPTKPDATMVVRNRRLTVTRGLQKDYSKDPWHGAEVSCWFIHNNGAGLIDGAYTDYIVPDIF

SEQ ID NO: 7319 - protein, 277 aa, Homo Sapiens
MPLPLPSAFVLSALQPSPTHSSSNTQRLPDRVTGVDTDPHFIIHVPQKEDTLCFNINEEPGVILSLVQDPNTGFSVNGQLIGNKARSPGQHDGTYFGRLGIANPATDFQLEVTPQNITLNPGFGGPVFSWRDQAVLRQDGVVVTINKKRNLVVSVDDGGTFEVVLHRVWKGSSVHQDFLGFYVLDSHRMSARTHGLLGQFFHPIGFEVSDIHPGSDPTKPDATMVVRNRRLTVTRGLQKDYSKDPWHGAEVSCWFIHNNGAGLIDGAYTDYIVPDIF

SEQ ID NO: 7320 - protein, 464 aa, Homo Sapiens
SMENNGRAQRIYEDHDATQQLQGFYSQVAKPLLVDVDLQYPQDAVLALTQNHHKQYYEGSEIVVAGRIADNKQSSFKADVQAHGEGQEFSITCLVDEEEMKKLLRERGHMLENHVERLWAYLTIQELLAKRMKVDREERANLSSQALQMSLDYGFVTPLTSMSIRGMADQDGLKPTIDKPSEGIGCREMLGPRRTFVLSALQPSPTHSSSNTQRLPDRVTGVDTDPHFIIHVPQKEDTLCFNINEEPGVILSLVQDPNTGFSVNGQLIGNKARSPGQHDGTYFGRLGIANPATDFQLEVTPQNITLNPGFGGPVFSWRDQAVLRQDGVVVTINKKRNLVVSVDDGGTFEVVLHRVWKGSSVHQDFLGFYVLDSHRMSARTHGLLGQFFHPIGFEVSDIHPGSDPTKPDATMVVRNRRLTVTRGLQKDYSKDPWHGAEVSCWFIHNNGAGLIDGAYTDYIVPDIF

SEQ ID NO: 7321 - protein, 74 aa, Homo Sapiens
  misc_feature (1)..(1): Xaa can be any naturally occurring amino acid
XMKVDREERANLSSQALQMSLDYGFVTPLTSMSIRGMADQDGLKPTIDKPSEDSPPLEMLGPRRTPIPSGCQTE

SEQ ID NO: 7322 - protein, 935 aa, Homo Sapiens
MKRLTCFFICFFLSEVSGFEIPINGLSEFVDYEDLVELAPGKFQLVAENRRYQEEVDQVTLYSYKVQSTITSRMATTMIQSKVVNNSPQPQNVVFDVQIPKGAFISNFSMTVDGKTFRSSIKEKTVGRALYAQARAKGKTAGLVRSSALDMENFRTEVNVLPGAKVQFELHYQEVKWRKLGSYEHRIYLQPGRLAKHLEVDVWVIEPQGLRFLHVPDTFEGHFDGVPVISKGQQKAHVSFKPTVAQQRICPNCRETAVDGELVVLYDVKREEKAGELEVFNGYFVHFFAPDNLDPIPKNILFVIDVSGSMWGVKMKQTVEAMKTILDDLRAEDHFSVIDFNQNIRTWRNDLISATKTQVADAKRYIEKIQPSGGTNINEALLRAIFILNEANNLGLLDPNSVSLIILVSDGDPTVGELKLSKIQKNVKENIQDNISLFSLGMGFDVDYDFLKRLSNENHGIAQRIYGNQDTSSQLKKFYNQVSTPLLRNVQFNYPHTSVTDVTQNNFHNYFGGSEIVVAGKFDPAKLDQIESVITATSANTQLVLETLAQMDDLQDFLSKDKHADPDFTRKLWAYLTINQLLAERSLAPTAAAKRRITRSILQMSLDHHIVTPLTSLVIENEAGDERMLADAPPQDPSCCSGALYYGSKVVPDSTPSWANPSPTPVISMLAQGSQVLESTPPPHVMRVENDPHFIIYLPKSQKNICFNIDSEPGKILNLVSDPESGIVVNGQLVGAKKPNNGKLSTYFGKLGFYFQSEDIKIEISTETITLSHGSSTFSLSWSDTAQVTNQRVQISVKKEKVVTITLDKEMSFSVLLHRVWKKHPVNVDFLGIYIPPTNKFSPKAHGLIGQFMQEPKIHIFNERPGKDPEKPEASMEVKGQKLIITRGLQKDYRTDLVFGTDVTCWFVHNSGKGFIDGHYKDYFVPQLYSFLKRP

SEQ ID NO: 7323 - protein, 946 aa, Homo Sapiens
MKRLTCFFICFFLSEVSGFEIPINGLSEFVDYEDLVELAPGKFQLVAENRRYQRSLPGESEEMMEEVDQVTLYSYKVQSTITSRMATTMIQSKVVNNSPQPQNVVFDVQIPKGAFISNFSMTVDGKTFRSSIKEKTVGRALYAQARAKGKTAGLVRSSALDMENFRTEVNVLPGAKVQFELHYQEVKWRKLGSYEHRIYLQPGRLAKHLEVDVWVIEPQGLRFLHVPDTFEGHFDGVPVISKGQQKAHVSFKPTVAQQRICPNCRETAVDGELVVLYDVKREEKAGELEVFNGYFVHFFAPDNLDPIPKNILFVIDVSGSMWGVKMKQTVEAMKTILDDLRAEDHFSVIDFNQNIRTWRNDLISATKTQVADAKRYIEKIQPSGGTNINEALLRAIFILNEANNLGLLDPNSVSLIILVSDGDPTVGELKLSKIQKNVKENIQDNISLFSLGMGFDVDYDFLKRLSNENHGIAQRIYGNQDTSSQLKKFYNQVSTPLLRNVQFNYPHTSVTDVTQNNFHNYFGGSEIVVAGKFDPAKLDQIESVITATSANTQLVLETLAQMDDLQDFLSKDKHADPDFTRKLWAYLTINQLLAERSLAPTAAAKRRITRSILQMSLDHHIVTPLTSLVIENEAGDERMLADAPPQDPSCCSGALYYGSKVVPDSTPSWANPSPTPVISMLAQGSQVLESTPPPHVMRVENDPHFIIYLPKSQKNICFNIDSEPGKILNLVSDPESGIVVNGQLVGAKKPNNGKLSTYFGKLGFYFQSEDIKIEISTETITLSHGSSTFSLSWSDTAQVTNQRVQISVKKEKVVTITLDKEMSFSVLLHRVWKKHPVNVDFLGIYIPPTNKFSPKAHGLIGQFMQEPKIHIFNERPGKDPEKPEASMEVKGQKLIITRGLQKDYRTDLVFGTDVTCWFVHNSGKGFIDGHYKDYFVPQLYSFLKRP

SEQ ID NO: 7324 - protein, 237 aa, Homo Sapiens
MKRLTCFFICFFLSEVSGFEIPINGLSERSLPGESEEMMEEVDQVTLYSYKVQSTITSRMATTMIQSKVVNNSPQPQNVVFDVQIPKGAFISNFSMTVDGKTFRSSIKEKTVGRALYAQARAKGKTAGLVRSSALDMENFRTEVNVLPGAKVQFELHYQEVKWRKLGSYEHRIYLQPGRLAKHLEVDVWVIEPQGLRFLHVPDTFEGHFDGVPVISKGQQKAHVSFKPTVAQQRICP

SEQ ID NO: 7325 - protein, 698 aa, Homo Sapiens
MAFAWWPCLILALLSSLAASGFPRSPFRLLGKRSLPEGVANGIEVYSTKINSKVTSRFAHNVVTMRAVNRADTAKEVSFDVELPKTAFITNFTLTIDGVTYPGNVKEKEVAKKQYEKAVSQGKTAGLVKASGRKLEKFTVSVNVAAGSKVTFELTYEELLKRHKGKYEMYLKVQPKQLVKHFEIEVDIFEPQGISMLDAEASFITNDLLGSALTKSFSGKKGHVSFKPSLDQQRSCPTCTDSLLNGDFTITYDVNRESPGNVQIVNGYFVHFFAPQGLPVVPKNVAFVIDISGSMAGRKLEQTKEALLRILEDMQEEDYLNFILFSGDVSTWKEHLVQATPENLQEARTFVKSMEDKGMTNINDGLLRGISMLNKAREEHRIPERSTSIVIMLTDGDANVGESRPEKIQENVRNAIGGKFPLYNLGFGNNLNYNFLENMALENHGFARRIYEDSDADLQLQGFYEEVANPLLTGVEMEYPENAILDLTQNTYQHFYDGSEIVVAGRLVDEDMNSFKADVKGHGATNDLTFTEEVTTEKITLWNRAVPSTFSWLDTVTVTQDGLSMMINRKNMVVSFGDGVTFVVVLHQVWKKHPVHRDFLGFYVVDSHRMSAQTHGLLGQFFQPFDFKVSDIRPGSDPTKPDATLVVKNHQLIVTRGSQKDYRKDASIGTKVVCWFVHNNGEGLIDGVHTDYIVPNLF

SEQ ID NO: 7326 - protein, 890 aa, Homo Sapiens
MAFAWWPCLILALLSSLAASGFPRSPFRLLGKRSLPEGVANGIEVYSTKINSKVTSRFAHNVVTMRAVNRADTAKEVSFDVELPKTAFITNFTLTIDGVTYPGNVKEKEVAKKQYEKAVSQGKTAGLVKASGRKLEKFTVSVNVAAGSKVTFELTYEELLKRHKGKYEMYLKVQPKQLVKHFEIEVDIFEPQGISMLDAEASFITNDLLGSALTKSFSGKKGHVSFKPSLDQQRSCPTCTDSLLNGDFTITYDVNRESPGNVQIVNGYFVHFFAPQGLPVVPKNVAFVIDISGSMAGRKLEQTKEALLRILEDMQEEDYLNFILFSGDVSTWKEHLVQATPENLQEARTFVKSMEDKGMTNINDGLLRGISMLNKAREEHRIPERSTSIVIMLTDGDANVGESRPEKIQENVRNAIGGKFPLYNLGFGNNLNYNFLENMALENHGFARRIYEDSDADLQLQGFYEEVANPLLTGVEMEYPENAILDLTQNTYQHFYDGSEIVVAGRLVDEDMNSFKADVKGHGATNDLTFTEEVDMKEMEKALQERDYIFGNYIERLWAYLTIEQLLEKRKNAHGEEKENLTARALDLSLKYHFVTPLTSMVVTKPEDNEDERAIADKPGEDAEATPVSPAMSYLTSYQPPQNPYYYVDGDPHFIIQIPEKDDALCFNIDEAPGTVLRLIQDAVTGLTVNGQITGDKRGSPDSKTRKTYFGKLGIANAQMDFQVEVTTEKITLWNRAVPSTFSWLDTVTVTQDGLSMMINRKNMVVSFGDGVTFVVVLHQVWKKHPVHRDFLGFYVVDSHRMSAQTHGLLGQFFQPFDFKVSDIRPGSDPTKPDATLVVKNHQLIVTRGSQKDYRKDASIGTKVVCWFVHNNGEGLIDGVHTDYIVPNLF

SEQ ID NO: 7327 - protein, 670 aa, Homo Sapiens [sequence omitted]

SEQ ID NO: 7328 - protein, 930 aa, Homo Sapiens
MKPPRPVRTCSKVLVLLSLLAIHQTTTAEKNGIDIYSLTVDSRVSSRFAHTVVTSRVVNRANTVQEATFQMELPKKAFITNFSMIIDGMTYPGIIKEKAEAQAQYSAAVAKGKSAGLVKATGRNMEQFQVSVSVAPNAKITFELVYEELLKRRLGVYELLLKVRPQQLVKHLQMDIHIFEPQGISFLETESTFMTNQLVDALTTWQNKTKAHIRFKPTLSQQQKSPEQQETVLDGNLIIRYDVDRAISGGSIQIENGYFVHYFAPEGLTTMPKNVVFVIDKSGSMSGRKIQQTREALIKILDDLSPRDQFNLIVFSTEATQWRPSLVPASAENVNKARSFAAGIQALGGTNINDAMLMAVQLLDSSNQEERLPEGSVSLIILLTDGDPTVGETNPRSIQNNVREAVSGRYSLFCLGFGFDVSYAFLEKLALDNGGLARRIHEDSDSALQLQDFYQEVANPLLTAVTFEYPSNAVEEVTQNNFRLLFKGSEMVVAGKLQDRGPDVLTATVSGKLPTQNITFQTESSVAEQEAEFQSPKYIFHNFMERLWAYLTIQQLLEQTVSASDADQQALRNQALNLSLAYSFVTPLTSMVVTKPDDQEQSQVAEKPMEGESRNRNVHSGSTFFKYYLQGAKIPKPEASFSPRRGWNRQAGAAGSRMNFRPGVLSSRQLGLPGPPDVPDHAAYHPFRRLAILPASAPPATSNPDPAVSRVMNMKIEETTMTTQTPAPIQAPSAILPLPGQSVERLCVDPRHRQGPVNLLSDPEQGVEVTGQYEREKAGFSWIEVTFKNPLVWVHASPEHVVVTRNRRSSAYKWKETLFSVMPGLKMTMDKTGLLLLSDPDKVTIGLLFWDGRGEGLRLLLRDTDRFSSHVGGTLGQFYQEVLWGSPAASDDGRRTLRVQGNDHSATRERRLDYQEGPPGVEISCWSVEL

SEQ ID NO: 7329 - protein, 900 aa, Homo Sapiens
MKPPRPVRTCSKVLVLLSLLAIHQTTTAEKNGIDIYSLTVDSRVSSRFAHTVVTSRVVNRANTVQEATFQMELPKKAFITNFSMIIDGMTYPGIIKEKAEAQAQYSAAVAKGKSAGLVKATGRNMEQFQVSVSVAPNAKITFELVYEELLKRRLGVYELLLKVRPQQLVKHLQMDIHIFEPQGISFLETESTFMTNQLVDALTTWQNKTKAHIRFKPTLSQQQKSPEQQETVLDGNLIIRYDVDRAISGGSIQIENGYFVHYFAPEGLTTMPKNVVFVIDKSGSMSGRKIQQTREALIKILDDLSPRDQFNLIVFSTEATQWRPSLVPASAENVNKARSFAAGIQALGGTNINDAMLMAVQLLDSSNQEERLPEGSVSLIILLTDGDPTVGETNPRSIQNNVREAVSGRYSLFCLGFGFDVSYAFLEKLALDNGGLARRIHEDSDSALQLQDFYQEVANPLLTAVTFEYPSNAVEEVTQNNFRLLFKGSEMVVAGKLQDRGPDVLTATVSGKLPTQNITFQTESSVAEQEAEFQSPKYIFHNFMERLWAYLTIQQLLEQTVSASDADQQALRNQALNLSLAYSFVTPLTSMVVTKPDDQEQSQVAEKPMEGESRNRNVHSAGAAGSRMNFRPGVLSSRQLGLPGPPDVPDHAAYHPFRRLAILPASAPPATSNPDPAVSRVMNMKIEETTMTTQTPAPIQAPSAILPLPGQSVERLCVDPRHRQGPVNLLSDPEQGVEVTGQYEREKAGFSWIEVTFKNPLVWVHASPEHVVVTRNRRSSAYKWKETLFSVMPGLKMTMDKTGLLLLSDPDKVTIGLLFWDGRGEGLRLLLRDTDRFSSHVGGTLGQFYQEVLWGSPAASDDGRRTLRVQGNDHSATRERRLDYQEGPPGVEISCWSVEL

SEQ ID NO: 7330 - protein, 935 aa, Homo Sapiens
MKPPRPVRTCSKVLVLLSLLAIHQTTTAEKNGIDIYSLTVDSRVSSRFAHTVVTSRVVNRANTVQEATFQMELPKKAFITNFSMIIDGMTYPGIIKEKAEAQAQYSAAVAKGKSAGLVKATGRNMEQFQVSVSVAPNAKITFELVYEELLKRRLGVYELLLKVRPQQLVKHLQMDIHIFEPQGISFLETESTFMTNQLVDALTTWQNKTKAHIRFKPTLSQQQKSPEQQETVLDGNLIIRYDVDRAISGGSIQIENGYFVHYFAPEGLTTMPKNVVFVIDKSGSMSGRKIQQTREALIKILDDLSPRDQFNLIVFSTEATQWRPSLVPASAENVNKARSFAAGIQALGGTNINDAMLMAVQLLDSSNQEERLPEGSVSLIILLTDGDPTVGETNPRSIQNNVREAVSGRYSLFCLGFGFDVSYAFLEKLALDNGGLARRIHEDSDSALQLQDFYQEVANPLLTAVTFEYPSNAVEEVTQNNFRLLFKGSEMVVAGKLQDRGPDVLTATVSGKLPTQNITFQTESSVAEQEAEFQSPKYIFHNFMERLWAYLTIQQLLEQTVSASDADQQALRNQALNLSLAYSFVTPLTSMVVTKPDDQEQSQVAEKPMEGESRNRNVHSGSTFFKYYLQGAKIPKPGLDHTEASFSPRRGWNRQAGAAGSRMNFRPGVLSSRQLGLPGPPDVPDHAAYHPFRRLAILPASAPPATSNPDPAVSRVMNMKIEETTMTTQTPAPIQAPSAILPLPGQSVERLCVDPRHRQGPVNLLSDPEQGVEVTGQYEREKAGFSWIEVTFKNPLVWVHASPEHVVVTRNRRSSAYKWKETLFSVMPGLKMTMDKTGLLLLSDPDKVTIGLLFWDGRGEGLRLLLRDTDRFSSHVGGTLGQFYQEVLWGSPAASDDGRRTLRVQGNDHSATRERRLDYQEGPPGVEISCWSVEL

SEQ ID NO: 7331 - protein, 719 aa, Homo Sapiens
  misc_feature (1)..(1): Xaa can be any naturally occurring amino acid
XVSVAPNAKITFELVYEELLKRRLGVYELLLKVRPQQLVKHLQMDIHIFEPQGISFLETESTFMTNQLVDALTTWQNKTKQKSPEQQETVLDGNLIIRYDVDRAISGGSIQIENGYFVHYFAPEGLTTMPKNVVFVIDKSGSMSGRKIQQTREALIKILDDLSPRDQFNLIVFSTEATQWRPSLVPASAENVNKARSFAAGIQALGGTNINDAMLMAVQLLDSSNQEERLPEGSVSLIILLTDGDPTVGETNPRSIQNNVREAVSGRYSLFCLGFGFDVSYAFLEKLALDNGGLARRIHEDSDSALQLQDFYQEVANPLLTAVTFEYPSNAVEEVTQNNFRLLFKGSEMVVAGKLQDRGPDVLTATVSGKLPTQNITFQTESSVAEQEAEFQSPKYIFHNFMERLWAYLTIQQLLEQTVSASDADQQALRNQALNLSLAYSFVTPLTSMVVTKPDDQEQSQVAEKPMEGESRNRNVHSAGAAGSRMNFRPGVLSSRQLGLPGPPDVPDHAAYHPFRRLAILPASAPPATSNPDPAVSRVMNMKIEETTMTTQTPGVEVTGQYEREKAGFSWIEVTFKNPLVWVHASPEHVVVTRNRRSSAYKWKETLFSVMPGLKMTMDKTGLLLLSDPDKVTIGLLFWDGRGEGLRLLLRDTDRFSSHVGGTLGQFYQEVLWGSPAASDDGRRTLRVQGNDHSATRERRLDYQEGPPGVEISCWSVEL

SEQ ID NO: 7332 - protein, 942 aa, Homo Sapiens
MLLLLGLCLGLSLCVGSQEEAQSWGHSSEQDGLRVPRQVRLLQRLKTKPLMTEFSVKSTIISRYAFTTVSCRMLNRASEDQDIEFQMQIPAAAFITNFTMLIGDKVYQGEITEREKKSGDRVKEKRNKTTEENGEKGTEIFRASAVIPSKDKAAFFLSYEELLQRRLGKYEHSISVRPQQLSGRLSVDVNILESAGIASLEVLPLHNSRQRGSGRGEDDSGPPPSTVINQNETFANIIFKPTVVQQARIAQNGILGDFIIRYDVNREQSIGDIQVLNGYFVHYFAPKDLPPLPKNVVFVLDSSASMVGTKLRQTKDALFTILHDLRPQDRFSIIGFSNRIKVWKDHLISVTPDSIRDGKVYIHHMSPTGGTDINGALQRAIRLLNKYVAHSGIGDRSVSLIVFLTDGKPTVGETHTLKILNNTREAARGQVCIFTIGIGNDVDFRLLEKLSLENCGLTRRVHEEEDAGSQLIGFYDEIRTPLLSDIRIDYPPSSVVQATKTLFPNYFNGSEIIIAGKLVDRKLDHLHVEVTASNSKKFIILKTDVPVRPQKAGKDVTGSPRPGGDGEGDTNHIERLWSYLTTKELLSSWLQSDDEPEKERLRQRAQALAVSYRFLTPFTSMKLRGPVPRMDGLEEAHGMSAAMGPEPVVQSVRGAGTQPGPLLKKPYQPRIKISKTSVDGDPHFVVDFPLSRLTVCFNIDGQPGDILRLVSDHRDSGVTVNGELIGAPAPPNGHKKQRTYLRTITILINKPERSYLEITPSRVILDGGDRLVLPCNQSVVVGSWGLEVSVSANANVTVTIQGSIAFVILIHLYKKPAPFQRHHLGFYIANSEGLSSNCHGLLGQFLNQDARLTEDPAGPSQNLTHPLLLQVGEGPEAVLTVKGHQVPVVWKQRKIYNGEEQIDCWFARNNAAKLIDGEYKDYLASHPFDTGMTLGRGMSREL

SEQ ID NO: 7333 - protein, 702 aa, Homo Sapiens
MLLLLGLCLGLSLCVGSQEEAQSWGHSSEQDGLRVPRQVRLLQRLKTKPLMTEFSVKSTIISRYAFTTVSCRMLNRASEDQDIEFQMQIPAAAFITNFTMLIGDKVYQGEITEREKKSGDRVKEKRNKTTEENGEKGTEIFRASAVIPSKDKAAFFLSYEELLQRRLGKYEHSISVRPQQLSGRLSVDVNILESAGIASLEVLPLHNSRQRGSGRGEDDSGPPPSTVINQNETFANIIFKPTVVQQARIAQNGILGDFIIRYDVNREQSIGDIQVLNGYFVHYFAPKDLPPLPKNVVFVLDSSASMVGTKLRQTKDALFTILHDLRPQDRFSIIGFSNRIKVWKDHLISVTPDSIRDGKVYIHHMSPTGGTDINGALQRAIRLLNKYVAHSGIGDRSVSLIVFLTDGKPTVGETHTLKILNNTREAARGQVCIFTIGIGNDVDFRLLEKLSLENCGLTRRVHEEEDAGSQLIGFYDEIRTPLLSDIRIDYPPSSVVQATKTLFPNYFNGSEIIIAGKLVDRKLDHLHVEVTASNSKKFIILKTDVPVRPQKAGKDVTGSPRPGGDGEGDTNHIERLWSYLTTKELLSSWLQSDDEPEKERLRQRAQALAVSYRFLTPFTSMKLRGPVPRMDGLEEAHGMSAAMGPEPVVQSVRGAGTQPGPLLKKPYQPRIKISKTSVRGFRREEQIFSNVMKFPFASILEL

SEQ ID NO: 7334 - protein, 728 aa, Homo Sapiens
MRNYDSGPPPSTVINQNETFANIIFKPTVVQQARIAQNGILGDFIIRYDVNREQSIGDIQVLNGYFVHYFAPKDLPPLPKNVVFVLDSSASMVGTKLRQTKDALFTILHDLRPQDRFSIIGFSNRIKVWKDHLISVTPDSIRDGKVYIHHMSPTGGTDINGALQRAIRLLNKYVAHSGIGDRSVSLIVFLTDGKPTVGETHTLKILNNTREAARGQVCIFTIGIGNDVDFRLLEKLSLENCGLTRRVHEEEDAGSQLIGFYDEIRTPLLSDIRIDYPPSSVVQATKTLFPNYFNGSEIIIAGKLVDRKLDHLHVEVTASNSKKFIILKTDVPVRPQKAGKDVTGSPRPGGDGEGDTNHIERLWSYLTTKELLSSWLQSDDEPEKERLRQRAQALAVSYRFLTPFTSMKLRGPVPRMDGLEEAHGMSAAMGPEPVVQSVRGAGTQPGPLLKKPYQPRIKISKTSVDGDPHFVVDFPLSRLTVCFNIDGQPGDILRLVSDHRDSGVTVNGELIGAPAPPNGHKKQRTYLRTITILINKPERSYLEITPSRVILDGGDRLVLPCNQSVVVGSWGLEVSVSANANVTVTIQGSIAFVILIHLYKKPAPFQRHHLGFYIANSEGLSSNCHGLLGQFLNQDARLTEDPAGPSQNLTHPLLLQVGEGPEAVLTVKGHQVPVVWKQRKIYNGEEQIDCWFARNNAAKLIDGEYKDYLASHPFDTGMTLGRGMSREL

SEQ ID NO: 7335 - protein, 119 aa, Homo Sapiens
  misc_feature (1)..(1): Xaa can be any naturally occurring amino acid
XPSTVINQNETFANIIFKPTVVQQARIAQNGILGDFIIRYDVNREQSIGDIQVLNGYFVHYFAPKDLPPLPKNVVFVLDSSASMVGTKLRQDIGFSLAVQNWVPKGYLDISCVTLQVHV

SEQ ID NO: 7336 - protein, 1313 aa, Homo Sapiens
MSGWRYLICVSFLLTILLELTYQGPPVPASSSTKLLMTSYSMRSTVVSRYAHTLVTSVLFNPHAEAHEAIFDLDLPHLAFISNFTMTINNKVYIAEVKEKHQAKKIYEEAHQQGKTAAHVGIRDRESEKFRISTSLAAGTEVTFSLAYEELLQRHQGQYQLVVSLRPGQLVKRLSIEVTVSERTGISYVHIPPLRTGRLRTNAHASEVDSPPSTRIERGETCVRITYCPTLQDQSSISGSGIMADFLVQYDVVMEDIIGDVQIYDDYFIHYFAPRGLPPMEKNVVFVIDVSSSMFGTKMEQTKTAMNVILSDLQANDYFNIISFSDTVNVWKAGGSIQATIQNVHSAKDYLHCMEADGWTDVNSALLAAASVLNHSNQEPGRGPSVGRIPLIIFLTDGEPTAGVTTPSVILSNVRQALGHRVSLFSLAFGDDADFTLLRRLSLENRGIARRIYEDTDAALQLKGLYEEISMPLLADVRLNYLGGLVGASPWAVFPNYFGGSELVVAGQVQPGKQELGIHLAARGPKDQLLVAHHSEGATNNSQKAFGCPGEPAPNVAHFIRRLWAYVTIGELLDAHFQARDTTTRHLLAAKVLNLSLEYNFVTPLTSLVMVQPKQASEETRRQTSTSAGPDTIMPSSSSRHGLGVSTAQPALVPKVISPKSRPVKPKFYLSSTTTASTKKMLSSKELEPLGESPHTLSMPTYPKAKIPAQQDSGTLAQPTLRTKPTILVPSNSGTLLPLKPGSLSHQNPDILPTNSRTQVPPVKPGIPASPKADTVKCVTPLHSKPGAPSHPQLGALTSQAPKGLPQSRPGVSTLQVPKYPLHTRPRVPAPKTRNNMPHLGPGILLSKTPKILLSLKPSAPPHQISTSISLSKPETPNPHMPQTPLPPRPDRPRPPLPESLSTFPNTISSSTGPSSTTTTSVLGEPLPMPFTPTLPPGRFWHQYDLLPGPQRTRQVLGPSRPGVPTMSLLNSSRPTPEGSPPNLPILLPSSILPEAISLLLLPEELELLSESMVESKFVESLNPPAFYTFLTPDEDGSPNWDGNSEEILGGAGGSMESQGSSVGLAKGTLPSIFTFSSSVDGDPHFVIQIPHSEEKICFTLNGHPGDLLQLIEDPKAGLHVSGKLLGAPPRPGHKDQTRTYFQIITVTTDKPRAYTITISRSSISLRGEGTLRLSWDQPALLKRPQLELYVAAAARLTLRLGPYLEFLVLRHRYRHPSTLQLPHLGFYVANGSGLSPSARGLIGQFQHADIRLVTGPMGPCLRRHHGPDVPVILGKRLLKDSPRLLPRWASCWLVKRSHVELLLGHPYLSYVL

SEQ ID NO: 7337 - protein, 313 aa, Homo Sapiens
MNQLSFLLFLIATTRGWSTDEANTYFKEWTCSSSPSLPRSCKEIKDECPSAFDGLYFLRTENGVIYQTFCDMTSGGGGWTLVASVHENDMRGKCTVGDRWSSQQGSKAVYPEGDGNWANYNTFGSAEAATSDDYKNPGYYDIQAKDLGIWHVPNKSPMQHWRNSSLLRYRTDTGFLQTLGHNLFGIYQKYPVKYGEGKCWTDNGPVIPVVYDFGDAQKTASYYSPYGQREFTAGFVQFRVFNNERAANALCAGMRVTGCNTEHHCIGGGGYFPEASPQQCGDFSGFDWSGYGTHVGYSSSREITEAAVLLFYR

SEQ ID NO: 7338 - protein, 325 aa, Homo Sapiens
MLSMLRTMTRLCFLLFFSVATSGCSAAAASSLEMLSREFETCAFSFSSLPRSCKEIKERCHSAGDGLYFLRTKNGVVYQTFCDMTSGGGGWTLVASVHENDMRGKCTVGDRWSSQQGNKADYPEGDGNWANYNTFGSAEAATSDDYKNPGYYDIQAKDLGIWHVPNKSPMQHWRNSALLRYRTNTGFLQRLGHNLFGIYQKYPVKYRSGKCWNDNGPAIPVVYDFGDAKKTASYYSPYGQREFVAGFVQFRVFNNERAANALCAGIKVTGCNTEHHCIGGGGFFPQGKPRQCGDFSAFDWDGYGTHVKSSCSREITEAAVLLFYR

SEQ ID NO: 7339 - protein, 243 aa, Homo Sapiens
MACWWPLLLELWTVMPTWAGDELLNICMNAKHHKRVPSPEDKLYEECIPWKDNACCTLTTSWEAHLDVSPLYNFSLFHCGLLMPGCRKHFIQAICFYECSPNLGPWIQPVAPSGQGERVVNVPLCQEDCEEWWEDCRMSYTCKSNWRGGWDWSQGKNRCPKGAQCLPFSHYFPTPADLCEKTWSNSFKASPERRNSGRCLQKWFEPAQGNPNVAVARLFASSAPSWELSYTIMVCSLFLPFLS

SEQ ID NO: 7340 - protein, 250 aa, Homo Sapiens
MACWWPLLLELWTVMPTWAGDELLNICMNAKHHKRVPSPEDKLYEECIPWKDNACCTLTTSWEAHLDVSPLYNFSLFHCGLLMPGCRKHFIQAICFYECSPNLGPWIQPVGSLGWEVAPSGQGERVVNVPLCQEDCEEWWEDCRMSYTCKSNWRGGWDWSQGKNRCPKGAQCLPFSHYFPTPADLCEKTWSNSFKASPERRNSGRCLQKWFEPAQGNPNVAVARLFASSAPSWELSYTIMVCSLFLPFLS

SEQ ID NO: 7341 - protein, 184 aa, Homo Sapiens
MALLLCLVCLTAALAHGCLHCHSNFSKKFSFYRHHVNFKSWWVGDIPVSGALLTDWSDDTMKELHLAIPAKITREKLDQVATAVYQMMDQLYQGKMYFPGKGRETEAGPPHPGTPRPPPEPDLLLPRRLRVFPQRAAKHLPGAGAPHPERHHRKPHRLSAPLWSSAQWKSAVQGLLNYINNWHK

SEQ ID NO: 7342 - protein, 232 aa, Homo Sapiens
MALLLCLVCLTAALAHGCLHCHSNFSKKFSFYRHHVNFKSWWVGDIPVSGALLTDWSDDTMKELHLAIPAKITREKLDQVATAVYQMMDQLYQGKMYFPGYFPNELRNIFREQVHLIQNAIIESRIDCQHRCGIFQYETISCNNCTDSHVACFGYNCESSAQWKSAVQGLLNYINNWHKQDTSMRPRSSAFSWPGTHRATPAFLVSPALRCLEPPHLANLTLEDAAECLKQH

SEQ ID NO: 7343 - protein, 214 aa, Homo Sapiens
MALLLCLVCLTAALAHGCLHCHSNFSKKFSFYRHHVNFKSWWVGDIPVSGALLTDWSDDTMKELHLAIPAKITREKLDQVATAVYQMMDQLYQGKMYFPGYFPNELRNIFREQVHLIQNAIIESRIDCQHRCGIFQYETISCNNCTDSHVACFGYNCESSAQWKSAVQGLLNYINNWHKQDTSMSLVSPALRCLEPPHLANLTLEDAAECLKQH

SEQ ID NO: 7344 - protein, 208 aa, Homo Sapiens
MALLLCLVCLTAALAHGCLHCHSNFSKKFSFYRHHVNFKSWWVGDIPVSGALLTDWSDDTMKELHLAIPAKITREKLDQVATAVYQMMDQLYQGKMYFPGYFPNELRNIFREQVHLIQNAIIESRIDCQHRCGIFQYETISCNNCTDSHVACFGYNCESSAQWKSAVQGLLNYINNWHNLVSPALRCLEPPHLANLTLEDAAECLKQH

SEQ ID NO: 7345 - protein, 152 aa, Homo Sapiens
VSGALLTDWSDDTMKELHLAIPAKITREKLDQVATAVYQMMDQLYQGKMYFPGYFPNELRNIFREQVHLIQNAIIESIFQYETISCNNCTDSHVACFGYNCESSAQWKSAVQGLLNYINNWHNLVSPALRCLEPPHLANLTLEDAAECLKQH

SEQ ID NO: 7346 - protein, 152 aa, Homo Sapiens
  misc_feature (1)..(1): Xaa can be any naturally occurring amino acid
XPQQLLQEVLLLPPPCELQVLVGGRHPRVRGAAHRLERRHDEGAAPGHPRQDHPGEAGPSGDSSVPDDGSAVPGEDVLPRVFPQRAAKHLPGAGAPHPERHHRKPHRLSAPLWSSAQWKSAVQGLLNYINNWHKPRSSAFSWPGTHRATPAL

SEQ ID NO: 7347 - protein, 138 aa, Homo Sapiens
  misc_feature (1)..(1): Xaa can be any naturally occurring amino acid
XSALPQQLLQEVLLLPPPCELQVLVGGRHPRVRGAAHRLERRHDEGAAPGHPRQDHPGEAGPSGDSSVPDDGSAVPGEDVLPRVFPQRAAKHLPGAGAPHPERHHRKPHRLSAPLWHLPVRDHLLQQLHRLARRLLWL

SEQ ID NO: 7348 - protein, 155 aa, Homo Sapiens
MFCPLKLILLPVLLDYSLGLNDLNVSPPELTVHVGDSALMGCVFQSTEDKCIFKIDWTLSPGEHAKDEYVLYYYSNLSVPIGRFQNRVHLMGDILCNDGSLLLQDVQEADQGTYICEIRLKGESQVFKKAVVLHVLPEEPKELMVHVGGLIQMGC

SEQ ID NO: 7349 - protein, 383 aa, Homo Sapiens
MFCPLKLILLPVLLDYSLGLNDLNVSPPELTVHVGDSALMGCVFQSTEDKCIFKIDWTLSPGEHAKDEYVLYYYSNLSVPIGRFQNRVHLMGDILCNDGSLLLQDVQEADQGTYICEIRLKGESQVFKKAVVLHVLPEEPKELMVHVGGLIQMGCVFQSTEVKHVTKEEIVFRYYHKLRMSVEYSQSWGHFQNRVNLVGDIFRNDGSIMLQGVRESDGGNYTCSIHLGNLVFKKTIVLHVSPEEPRTLVTPAALRPLVLGGNQLVIIVGIVCATILLLPVLILIVKKTCGNKSSVNSTVLVKNTKKTNPEIKEKPCHFERCEGEKHIYSPIIVREVIEEEEPSEKSEATYMTMHPVWPSLRSDRNNSLEKKSGGGMPKTQQAF

SEQ ID NO: 7350 - protein, 394 aa, Homo Sapiens
MFCPLKLILLPVLLDYSLGLNDLNVSPPELTVHVGDSALMGCVFQSTEDKCIFKIDWTLSPGEHAKDEYVLYYYSNLSVPIGRFQNRVHLMGDILCNDGSLLLQDVQEADQGTYICEIRLKGESQVFKKAVVLHVLPEEPKELMVHVGGLIQMGCVFQSTEVKHVTKVEWIFSGRRAKEEIVFRYYHKLRMSVEYSQSWGHFQNRVNLVGDIFRNDGSIMLQGVRESDGGNYTCSIHLGNLVFKKTIVLHVSPEEPRTLVTPAALRPLVLGGNQLVIIVGIVCATILLLPVLILIVKKTCGNKSSVNSTVLVKNTKKTNPEIKEKPCHFERCEGEKHIYSPIIVREVIEEEEPSEKSEATYMTMHPVWPSLRSDRNNSLEKKSGGGMPKTQQAF

SEQ ID NO: 7351 - protein, 66 aa, Homo Sapiens
MFCPLKLILLPVLLEHRRQMYIQDRLDSVTRRARQGRICAILLLQSQCAYWALPEPRTLDGGHLMQ

SEQ ID NO: 7352 - protein, 121 aa, Homo Sapiens
MGCVFQSTEDKCIFKIDWTLSPGEHAKDEYVLYYYSNLSVPIGRFQNRVHLMGDILCNDGSLLLQDVQEADQGTYICEIRLKGESQVFKKAVVLHVLPEEPKELMVHVGGLIQMGCVFQST

SEQ ID NO: 7353 - protein, 220 aa, Homo Sapiens
MGCVFQSTEDKCIFKIDWTLSPGEHAKDEYVLYYYSNLSVPIGRFQNRVHLMGDILCNDGSLLLQDVQEADQGTYICEIRLKGESQVFKKAVVLHVLPEEPKELMVHVGGLIQMGCVFQSTEVKHVTKVEWIFSGRRAKEEIVFRYYHKLRMSVEYSQSWGHFQNRVNLVGDIFRNDGSIMLQGVRESDGGNYTCSIHLGNLVFKKTIVLHVSPEEPRKW

SEQ ID NO: 7354 - protein, 305 aa, Homo Sapiens
MGCVFQSTEDKCIFKIDWTLSPGEHAKDEYVLYYYSNLSVPIGRFQNRVHLMGDILCNDGSLLLQDVQEADQGTYICEIRLKGESQVFKKAVVLHVLPEEPKELMVHVGGLIQMGCVFQSTEVKHVTKVEWIFSGRRAKEEIVFRYYHKLRMSVEYSQSWGHFQNRVNLVGDIFRNDGSIMLQGVRESDGGNYTCSIHLGNLVFKKTIVLHVSPEEPRTLVTPAALRPLVLGGNQLVIIVGIVCATILLLPVLILIVKKTCGNKSSVNSTVLVKNTKKTNPEIKEKPCHFERCEGEVNTRFSLKH

SEQ ID NO: 7355 - protein, 355 aa, Homo Sapiens
MGCVFQSTEDKCIFKIDWTLSPGEHAKDEYVLYYYSNLSVPIGRFQNRVHLMGDILCNDGSLLLQDVQEADQGTYICEIRLKGESQVFKKAVVLHVLPEEPKELMVHVGGLIQMGCVFQSTEVKHVTKVEWIFSGRRAKEEIVFRYYHKLRMSVEYSQSWGHFQNRVNLVGDIFRNDGSIMLQGVRESDGGNYTCSIHLGNLVFKKTIVLHVSPEEPRTLVTPAALRPLVLGGNQLVIIVGIVCATILLLPVLILIVKKTCGNKSSVNSTVLVKNTKKTNPEIKEKPCHFERCEGEKHIYSPIIVREVIEEEEPSEKSEATYMTMHPVWPSLRSDRNNSLEKKSGGGMPKTQQAF

SEQ ID NO: 7356 - protein, 384 aa, Homo Sapiens
MVSGDYSLGLNDLNVSPPELTVHVGDSALMGCVFQSTEDKCIFKIDWTLSPGEHAKDEYVLYYYSNLSVPIGRFQNRVHLMGDILCNDGSLLLQDVQEADQGTYICEIRLKGESQVFKKAVVLHVLPEEPKELMVHVGGLIQMGCVFQSTEVKHVTKVEWIFSGRRAKEEIVFRYYHKLRMSVEYSQSWGHFQNRVNLVGDIFRNDGSIMLQGVRESDGGNYTCSIHLGNLVFKKTIVLHVSPEEPRTLVTPAALRPLVLGGNQLVIIVGIVCATILLLPVLILIVKKTCGNKSSVNSTVLVKNTKKTNPEIKEKPCHFERCEGEKHIYSPIIVREVIEEEEPSEKSEATYMTMHPVWPSLRSDRNNSLEKKSGGGMPKTQQAF

SEQ ID NO: 7357 - protein, 70 aa, Homo Sapiens
MKNHLLFWGVLAVFIKAVHVKAQEDERIVLVDNKCKCARITSRIIRSSEDPNEDIVERNIRIIVPLNNRE

SEQ ID NO: 7358 - protein, 159 aa, Homo Sapiens
MKNHLLFWGVLAVFIKAVHVKAQEDERIVLVDNKCKCARITSRIIRSSEDPNEDIVERNIRIIVPLNNRENISDPTSPLRTRFVYHLSDLCKKCDPTEVELDNQIVTATQSNICDEDSATETCYTYDRNKCYTAVVPLVYGGETKMVETALTPDACYPD

SEQ ID NO: 7359 - protein, 159 aa, Homo Sapiens; identical to SEQ ID NO: 7358

SEQ ID NO: 7360 - protein, 159 aa, Homo Sapiens; identical to SEQ ID NO: 7358

SEQ ID NO: 7361 - protein, 158 aa, Homo Sapiens
MKNHLLFWGVLAVFIKAVHVKENGIHSEFRAQEDERIVLVDNKCKCARITSRIIRSSEDPNEDIVERNIRIIVPLNNRENISDPTSPLRTRFVYHLSDLCKKCDPTEVELDNQIVTATQSNICDEDSATETCYTYDRNKCYTAVVPLVYGGETKMVET

SEQ ID NO: 7362 - protein, 157 aa, Homo Sapiens
MKNHLLFWGVLAVFIKAVHVKGSRDSSASASRVAGITAQEDERIVLVDNKCKCARITSRIIRSSEDPNEDIVERNIRIIVPLNNRENISDPTSPLRTRFVYHLSDLCKKCDPTEVELDNQIVTATQSNICDEDSATETCYTYDRNKCYTAVVPLVYG

SEQ ID NO: 7363 - protein, 285 aa, Homo Sapiens
MAGGWAQGSRRAARLPEGGRLMAPASRLLALWALAAVALPGSGAEGDGGWRPGGPGAVAEEERCTVERRADLTYAEFVQQYAFVRPVILQGLTDNSRFRALCSRDRLLASFGDRVVRLSTANTYSYHKVDLPFQEYVEQLLHPQDPTSLGNDTLYFFGDNNFTEWASLFRHYSPPPFGLLGTAPAYSFGIAGAGSGVPFHWHGPGYSEVIYGRKRWFLYPPEKTPEFHPNKTTLAWLRDTYPALPPSARPLECTIRAGEVLYFPDRWWHATLNLDTSVFISTFLG

SEQ ID NO: 7364 - protein, 264 aa, Homo Sapiens
MAPASRLLALWALAAVALPGSGAEGDGGWRPGGPGAVAEEERCTVERRADLTYAEFVQQYAFVRPVILQGLTDNSRFRALCSRDRLLASFGDRVVRLSTANTYSYHKVDLPFQEYVEQLLHPQDPTSLGNDTLYFFGDNNFTEWASLFRHYSPPPFGLLGTAPAYSFGIAGAGSGVPFHWHGPGYSEVIYGRKRWFLYPPEKTPEFHPNKTTLAWLRDTYPALPPSARPLECTIRAGEVLYFPDRWWHATLNLDTSVFISTFLG

SEQ ID NO: 7365 - protein, 219 aa, Homo Sapiens
MAPASRLLALWALAAVALPGSGAEGDGGWRPGGPGAVAEEERCTVERRADLTYAEFVQQYAFVRPVILQGLTDNSRFRALCSRDRLLASFGDRVVRLSTANTYSYHKVDLPFQEYVEQLLHPQDPTSLGNDTLYFFGDNNFTEWASLFRHYSPPPFGLLGTAPAYSFGIAGAGSGVPFHWHGPGYSEVIYGRKVLYFPDRWWHATLNLDTSVFISTFLG

SEQ ID NO: 7366 - protein, 234 aa, Homo Sapiens
MAPASRLLALWALAAVALPGSGAEGDGGWYAFVRPVILQGLTDNSRFRALCSRDRLLASFGDRVVRLSTANTYSYHKVDLPFQEYVEQLLHPQDPTSLGNDTLYFFGDNNFTEWASLFRHYSPPPFGLLGTAPAYSFGIAGAGSGVPFHWHGPGYSEVIYGRKRWFLYPPEKTPEFHPNKTTLAWLRDTYPALPPSARPLECTIRAGEVLYFPDRWWHATLNLDTSVFISTFLG

SEQ ID NO: 7367 - protein, 81 aa, Homo Sapiens
  misc_feature (1)..(1): Xaa can be any naturally occurring amino acid
XWTCPSRSMWSSCCTPRTPPPWAMTPCTSSGTTTSPSGPLSFGTTPHPHLACWEPLQLTALESQELARGCPSTGMDPGTQK

SEQ ID NO: 7368 - protein, 331 aa, Homo Sapiens
MSMTTRAWEELDGGLGSCQALEDHSALAETQEDRASATPRLADSGSVPHDSQVAEGPSVDTRPKKMEKEPAARGTPGTGKERLKAGASPRSVPARKKAQTAPPLQPPPPPPALSEELPWGDLSLNKCLVLASLVALLGSAFQLCRDAVPGEAALQARVPEPWVPPSSAPREPSSPLPKFEAQAPPSAPPAPRAEAEVRPKIPGSREAAENDEEEPGEATGEAVREDRVTLADRGPKERPRREGKPRKEKPRKEERPKKERPRKEERPRAAREPREALPQRWESREGGHRPWARDSRDAEPRKKQAWVSPRRPDEEQRPGSRQKLRAGKGRD

SEQ ID NO: 7369 - protein, 206 aa, Homo Sapiens
ENLKRLKCLRRYRQRYGVEALLHRQLKERRMLATDGAAQQAHTTRSSQRCLAFVDDVRCSNQSLPMTRHCLTHICQDTNQVLFKCCQGSEEVPCNKPVPVSLSEDPCCPLHFQLPPQMYKPEQDLDVVGDGMQCPPSPLLFDPSLTLEDHLVKEIAEDPVDILGQMQMAGDGCRSQGSRNSEKASAPLSQSGLATANGKPEPTSIS

SEQ ID NO: 7370 - protein, 675 aa, Homo Sapiens
MAVLFPLSSCGWAAISLFLSAQSCYSASKQCQSQSPSCRLPGARISGDWSRRTKWRSHRLPRPGPVVRSEAGRDKGGVRGGGVAAAWGWCCRFPSCCSCASPEDTFSVVWFGVGPGMEGHAKGRQSHRCLWRLGEGGGDLRSVPYGDDFCMSFGNCPRDLCGAGIFGKGKGFLVFRLTPQVLVMNRIRIHVLPTNRGRITPVPRSQEPLSCAFTHRPCSHPRLEGQEFCIKHILEDKNAPFKQCSYISTKNGKRCPNAAPKPEKKDGVSFCAEHVRRNALALHAQMKKTNPGPVGETLLCQLSSYAKTELGSQTPESSRSEASRILDEDSWSDGEQEPITVDQTWRGDPDSEADSIDSDQEDPLKHAGVYTAEEVALIMREKLIRLQSLYIDQFKRLQHLLKEKKRRYLHNRKVEHEALGSSLLTGPEGLLAKERENLKRLKCLRRYRQRYGVEALLHRQLKERRMLATDGAAQQAHTTRSSQRCLAFVDDVRCSNQSLPMTRHCLTHICQDTNQVLFKCCQGSEEVPCNKPVPVSLSEDPCCPLHFQLPPQMYKPEQVLSVPDDLEAGPMDLYLSAAELQPTESLPLEFSDDLDVVGDGMQCPPSPLLFDPSLTLEDHLVKEIAEDPVDILGQMQMAGDGCRSQGSRNSEKASAPLSQSGLATANGKPEPTSIS

SEQ ID NO: 7371 - protein, 69 aa, Homo Sapiens
MNRIRIHVLPTNRGRITPVPRSQEPLSCAFTHRPCSHPRLEGQEFCIKHILEDKNAPFKQCSYISTKNG

SEQ ID NO: 7372 - protein, 108 aa, Homo Sapiens
MNRIRIHVLPTNRGRITPVPRSQEPLSCAFTHRPCSHPRLEGQEFCIKHILEDKNAPFKQCSYISTKNGKRCPNAAPKPEKKDGVSFCAEHVRRNALALHAQMKKTNP

SEQ ID NO: 7373 - protein, 492 aa, Homo Sapiens
MNRIRIHVLPTNRGRITPVPRSQEPLSCAFTHRPCSHPRLEGQEFCIKHILEDKNAPFKQCSYISTKNGKRCPNAAPKPEKKDGVSFCAEHVRRNALALHAQMKKTNPGPVGETLLCQLSSYAKTELGSQTPESSRSEASRILDEDSWSDGEQEPITVDQTWRGDPDSEADSIDSDQEDPLKHAGVYTAEEVALIMREKLIRLQSLYIDQFKRLQHLLKEKKRRYLHNRKVEHEALGSSLLTGPEGLLAKERENLKRLKCLRRYRQRYGVEALLHRQLKERRMLATDGAAQQAHTTRSSQRCLAFVDDVRCSNQSLPMTRHCLTHICQDTNQVLFKCCQGSEEVPCNKPVPVSLSEDPCCPLHFQLPPQMYKPEQVLSVPDDLEAGPMDLYLSAAELQPTESLPLEFSDDLDVVGDGMQCPPSPLLFDPSLTLEDHLVKEIAEDPVDILGQMQMAGDGCRSQGSRNSEKASAPLSQSGLATANGKPEPTSIS

SEQ ID NO: 7374 - protein, 454 aa, Homo Sapiens
MNRIRIHVLPTNRGRITPVPRSQEPLSCAFTHRPCSHPRLEGQEFCIKHILEDKNAPFKQCSYISTKNGKRCPNAAPKPEKKDGVSFCAEHVRRNALALHAQMKKTNPGPVGETLLCQLSSYAKTELGSQTPESSRSEASRILDEDSWSDGEQEPITVDQTWRGDPDSEADSIDSDQEDPLKHAGVYTAEEVALIMREKLIRLQSLYIDQFKRLQHLLKEKKRRYLHNRKVEHEALGSSLLTGPEGLLAKERENLKRLKCLRRYRQRYGVEALLHRQLKERRMLATDGAAQQAHTTRSSQRCLAFVDDVRCSNQSLPMTRHCLTHICQDTNQVLFKCCQGSEEVPCNKPVPVSLSEDPCCPLHFQLPPQMYKPEQDLDVVGDGMQCPPSPLLFDPSLTLEDHLVKEIAEDPGQMQMAGDGCRSQGSRNSEKASAPLSQSGLATANGKPEPTSIS

SEQ ID NO: 7375 - protein, 155 aa, Homo Sapiens
MNRIRIHVLPTNRGRITPVPRSQEPLSCAFTHRPCSHPRLEGQEFCIKHILEDKNAPFKQCSYISTKNGKRCPNAAPKPEKKDGVSFCAEHVRRNALALHAQMKKTNPGPVGETLLCQLSSYAKTELGSQTPESSRSEASRILDMLVSTQQKKWP

SEQ ID NO: 7376 - protein, 133 aa, Homo Sapiens
MNRIRIHVLPTNRGRITPVPRVSFCAEHVRRNALALHAQMKKTNPGPVGETLLCQLSSYAKTELGSQTPESSRSEASRILDEDSWSDGEQEPITVDQTWRGDPDSEADSIDSDQEDPLKHAGVYTAEEVALIM

SEQ ID NO: 7377 - protein, 74 aa, Homo Sapiens
PNAAPKPEKKDGVSFCAEHVRRNALALHAQMKKTNPGPVGETLLCQLSSYAKTELGSQTPESSRSEASRILGLG

SEQ ID NO: 7378 - protein, 340 aa, Homo Sapiens
  misc_feature (1)..(1): Xaa can be any naturally occurring amino acid
XLPTNRGRITPVPRSQEPLSCAFTHRPCSHPRLEGQEFCIKHILEDKNAPFKQCSYISTKNGKRCPNAAPKPEKKDGVSFCAEHVRRNALALHAQMKKTNPGPVGETLLCQLSSYAKTELGSQTPESSRSEASRILDEDSWSDGEQEPITVDQTWRGDPDSEADSIDSDQEDPLKHAGVYTAEEVALIMREKLIRLQSLYIDQFKRLQHLLKEKKRRYLHNRKVEHEALGSSLLTGPEGLLAKERENLKRLKCLRRYRQRYGVEALLHRQLKERRMLATDGAAQQAHTTRSSQRCLAFVDDVRCSNQSLPMTRHCLTQKDATAIGDLLTLYCGLMETALD

SEQ ID NO: 7379 - protein, 25 aa, Homo Sapiens
  misc_feature (1)..(1): Xaa can be any naturally occurring amino acid
XPESSRSEASRILDMLVSTQQKKWP

SEQ ID NO: 7380 - protein, 304 aa, Homo Sapiens
MLPPPRPAAALALPVLLLLLVVLTPPPTGARPSPGPDYLRRGWMRLLAEGEGCAPCRPEECAAPRGCLAGRVRDACGCCWECANLEGQLCDLDPSAHFYGHCGEQLECRLDTGGDLSRGEVPEPLCACRSQSPLCGSDGHTYSQICRLQEAARARPDANLTVAHPGPCESGPQIVSHPYDTWNVTGQDVIFGCEVFAYPMASIEWRKDGLDIQLPGDDPHISVQFRGGPQRFEVTGWLQIQAVRPSDEGTYRCLGRNALGQVEAPASLTVLTPDQLNSTGIPQLRSLNLVPEEEAESEENDDYY

SEQ ID NO: 7381 - protein, 230 aa, Homo Sapiens
MGIQGMELCAMAVVVLLFIAVLKQFGILEPISMEDSSDSELELSTVRHQPEGLDQLQAQTKFTKKELQSLYRGFKNECPTGLVDEDTFKLIYAQFFPQGDATTYAHFLFNAFDADGNGAIHFEDFVVGLSILLRGTVHEKLKWAFNLYDINKDGYITKEEMLAIMKSIYDMMGRHTYPILREDAPAEHVERFFEKMDRNQDGVVTIEEFLEACQKDENIMSSMQLFENVI

SEQ ID NO: 7382 - protein, 256 aa, Homo Sapiens
MQPAKEVTKASDGSLLGDLGHTPLSKKEGIKWQRPRLSRQALMRCCLVKWILSSTAPQGSDSSDSELELSTVRHQPEGLDQLQAQTKFTKKELQSLYRGFKNECPTGLVDEDTFKLIYAQFFPQGDATTYAHFLFNAFDADGNGAIHFEDFVVGLSILLRGTVHEKLKWAFNLYDINKDGYITKEEMLAIMKSIYDMMGRHTYPILREDAPAEHVERFFEKMDRNQDGVVTIEEFLEACQKDENIMSSMQLFENVI

SEQ ID NO: 7383 - protein, 256 aa, Homo Sapiens
MQPRKEVTKASDGSLLGDLGHTPLSKKEGIKWQRPRLSRQALMRCCLVKWILSSTAPQGSDSSDSELELSTVRHQPEGLDQLQAQTKFTKKELQSLYRGFKNECPTGLVDEDTFKLIYAQFFPQGDATTYAHFLFNAFDADGNGAIHFEDFVVGLSILLRGTVHEKLKWAFNLYDINKDGYITKEEMLAIMKSIYDMMGRHTYPILREDAPAEHVERFFEKMDRNQDGVVTIEEFLEACQKDENIMSSMQLFENVI

SEQ ID NO: 7384 - protein, 252 aa, Homo Sapiens
MGGLRPWSRYGLLVVAHLLALGLGAVVFQALEGPPACRLQAELRAELAAFQAEHRACLPPGALEELLGTALATQAHGVSTLGNSSEGRTWDLPSALLFAASILTTTGYGHMAPLSPGGKAFCMVYAALGLPASLALVATLRHCLLPVLSRPRAWVAVHWQLSPARAALLQAVALGLLVASSFVLLPALVLWGLQGDCSLLGAVYFCFSSLSTIGLEDLLPGRGRSLHPVIYHLGQLALLGGGTSLQGTAWEG

SEQ ID NO: 7385 - protein, 252 aa, Homo Sapiens; identical to SEQ ID NO: 7384

SEQ ID NO: 7386 - protein, 257 aa, Homo Sapiens
MGGLRPWSRYGLLVVAHLLALGLGAVVFQALEGPPACRLQAELRAELAAFQAEHRACLPPGALEELLGTALATQAHGVSTLGNSSEGRTWDLPSALLFAASILTTTGYGHMAPLSPGGKAFCMVYAALGLPASLALVATLRHCLLPVLSRPRAWVAVHWQLSPARAALLQAVALGLLVASSFVLLPALVLWGLQGDCSLLGAVYFCFSSLSTIGLEDLLPGRGRSLHPVIYHLGQLALLGKSSHLTACGGRGKRSLD

SEQ ID NO: 7387 - protein, 307 aa, Homo Sapiens
MGGLRPWSRYGLLVVAHLLALGLGAVVFQALEGPPACRLQAELRAELAAFQAEHRACLPPGALEELLGTALATQAHGVSTLGNSSEGRTWDLPSALLFAASILTTTGYGHMAPLSPGGKAFCMVYAALGLPASLALVATLRHCLLPVLSRPRAWVAVHWQLSPARAALLQAVALGLLVASSFVLLPALVLWGLQGDCSLLGAVYFCFSSLSTIGLEDLLPGRGRSLHPVIYHLGQLALLGYLLLGLLAMLLAVETFSELPQVRAMGKFFRPSGPVTAEDQGGILGQDELALSTLPPAAPASGQAPAC

SEQ ID NO: 7388 - protein, 72 aa, Homo Sapiens
  misc_feature (1)..(1): Xaa can be any naturally occurring amino acid
XHLGQLALLGLLAMLLAVETFSELPQVRAMGKFFRPSGPVTAEDQGGILGQDELALSTLPPAAPASGQAPAC

SEQ ID NO: 7389 - protein, 28 aa, Homo Sapiens
  misc_feature (1)..(1): Xaa can be any naturally occurring amino acid
XLHPVIYHLGQLALLGGGTSLQGTAWEG

SEQ ID NO: 7390 - protein, 57 aa, Homo Sapiens
MGGDLVLGLGALRRRKRLLEQEKSLAGWALVLAGTGIGLMVLHAEMLWFGGCSTHFG

SEQ ID NO: 7391 - protein, 427 aa, Homo Sapiens
MGGDLVLGLGALRRRKRLLEQEKSLAGWALVLAGTGIGLMVLHAEMLWFGGCSWALYLFLVKCTISISTFLLLCLIVAFHAKEVQLFMTDNGLRDWRVALTGRQAAQIVLELVVCGLHPAPVRGPPCVQDLGAPLTSPQPWPGFLGQGEALLSLAMLLRLYLVPRAVLLRSGVLLNASYRSIGALNQVRFRHWFVAKLYMNTHPGRLLLGLTLGLWLTTAWVLSVAERQAVNATGHLSDTLWLIPITFLTIGYGDVVPGTMWGKIVCLCTGVMGVCCTALLVAVVARKLEFNKAEKHVHNFMMDIQYTKEMKESAARVLQEAWMFYKHTRRKESHAARRHQRKLLAAINAFRQVRLKHRKLREQVNSMVDISKMHMILYDLQQNLSSSHRALEKQIDTLAGKLDALTELLSTALGPRQLPEPSQQSK

SEQ ID NO: 7392 - protein, 295 aa, Homo Sapiens
MHDQHFHLLTPLPHRGLSCQRGPAVHDRQRAAGLARGADRAAGNASYRSIGALNQVRFRHWFVAKLYMNTHPGRLLLGLTLGLWLTTAWVLSVAERQAVNATGHLSDTLWLIPITFLTIGYGDVVPGTMWGKIVCLCTGVMGVCCTALLVAVVARKLEFNKAEKHVHNFMMDIQYTKEMKESAARVLQEAWMFYKHTRRKESHAARRHQRKLLAAINAFRQVRLKHRKLREQVNSMVDISKMHMILYDLQQNLSSSHRALEKQIDTLAGKLDALTELLSTALGPRQLPEPSQQSK

SEQ ID NO: 7393 - protein, 113 aa, Homo Sapiens
SDTLWLIPITFLTIGYGDVVPGTMWGKIVCLCTGVMGVCCTALLVAVVARKLEFNKAEKHVHNFMMDIQYTKEMKESAARVLQEAWMFYKHTRRKESHAARRHQRKLLAAINA

SEQ ID NO: 7394 - protein, 59 aa, Homo Sapiens
VDISKMHMILYDLQQNLSSSHRALEKQIDTLAGKLDALTELLSTALGPRQLPEPSQQSK

SEQ ID NO: 7395 - protein, 165 aa, Homo Sapiens
  misc_feature (1)..(1): Xaa can be any naturally occurring amino acid
XVCCTALLVAVVARKLEFNKAEKHVHNFMMDIQYTKEEGVSCCPQASAQAAGRHQRVRAALYAHVSMCTHVQVTSLHGCVCACPCLSRFRQVRLKHRKLREQVNSMVDISKMHMILYDLQQNLSSSHRALEKQIDTLAGKLDALTELLSTALGPRQLPEPSQQSK

SEQ ID NO: 7396 - protein, 113 aa, Homo Sapiens
MFQTKLRNETWEDLPKMSCTTEIQAAFILSSFVTFFSGLIILLIFRLIWRSVKKWQIIKGTGIILELFTSGTIARSHVRSLHFQGQFRDHIEMLLSAQTFVGQVLPCWKLFII

SEQ ID NO: 7397 - protein, 1149 aa, Homo Sapiens
MFQTKLRNETWEDLPKMSCTTEIQAAFILSSFVTFFSGLIILLIFRLIWRSVKKWQIIKGTGIILELFTSGTIARSHVRSLHFQGQFRDHIEMLLSAQTFVGQVLVILVFVLSIGSLIIYFINSADPVGSCSSYEDKTIPIDLVFNAFFSFYFGLRFMAADDKIKFWLEMNSIVDIFTIPPTFISYYLKSNWLGLRFLRALRLLELPQILQILRAIKTSNSVKFSKLLSIILSTWFTAAGFIHLVENSGDPWLKGRNSQNISYFESIYLVMATTSTVGFGDVVAKTSLGRTFIMFFTLGSLILFANYIPEMVELFANKRKYTSSYEALKGKKFIVVCGNITVDSVTAFLRNFLRDKSGEINTEIVFLGETPPSLELETIFKCYLAYTTFISGSAMKWEDLRRVAVESAEACLIIANPLCSDSHAEDISNIMRVLSIKNYDSTTRIIIQILQSHNKVYLPKIPSWNWDTGDNIICFAELKLGFIAQGCLVPGLCTFLTSLFVEQNKKVMPKQTWKKHFLNSMKNKILTQRLSDDFAGMSFPEVARLCFLKMHLLLIAIEYKSLFTDGFCGLILNPPPQVRIRKNTLGFFIAETPKDVRRALFYCSVCHDDVFIPELITNCGCKSRSRQHITVPSVKRMKKCLKGISSRISGQDSPPRVSASTSSISNFTTRTLQHDVEQDSDQLDSSGMFHWCKPTSLDKVTLKRTGKSKYKFRNHIVACVFGDAHSAPMGLRNFVMPLRASNYTRKELKDIVFIGSLDYLQREWRFLWNFPQIYILPGCALYSGDLHAANIEQCSMCAVLSPPPQPSSNQTLVDTEAIMATLTIGSLQIDSSSDPSPSVSEETPGYTNGHNEKSNCRKVPILTELKNPSNIHFIEQLGGLEGSLQETNLHLSTAFSTGTVFSGSFLDSLLATAFYNYHVLELLQMLVTGGVSSQLEQHLDKDKVYGVADSCTSLLSGRNRCKLGLLSLHETILSDVNPRNTFGQLFCGSLDLFGILCVGLYRIIDEEELNPENKRFVITRPANEFKLLPSDLVFCAIPFSTACYKRNEEFSLQKSYEIVNKASQTTETHSDTNCPPTIDSVTETLYSPVYSYQPRTNSLSFPKQIAWNQSRTNSIISSQIPLGDNAKENERKTSDEVYDEDPFAYSEPL

SEQ ID NO: 7398 - protein, 308 aa, Homo Sapiens
MFQTKLRNETWEDLPKMSCTTEIQAAFILSSFVTFFSGLIILLIFRLIWRSVKKWQIIKGTGIILELFTSGTIARSHVRSLHFQGQFRDHIEMLLSAQTFVGQVLVILVFVLSIGSLIIYFINSADPVGSCSSYEDKTIPIDLVFNAFFSFYFGLRFMAADDKIKFWLEMNSIVDIFTIPPTFISYYLKSNWLGLRFLRALRLLELPQILQILRAIKTSNSVKFSKLLSIILSTWFTAAGFIHLVENSGDPWLKGRNSQNISYFESIYLVMATTSTVGFGDVVAKTSLGRTFIMFFTLGSLVKNIFNI

SEQ ID NO: 7399 - protein, 947 aa, Homo Sapiens
MFQTKLRNETWEDLPKMSCTTEIQAAFILSSFVTFFSGLIILLIFRLIWRSVKKWQIIKGTGIILELFTSGTIARSHVRSLHFQGQFRDHIEMLLSAQTFVGQVLVILVFVLSIGSLIIYFINSADPVGSCSSYEDKTIPIDLVFNAFFSFYFGLRFMAADDKIKFWLEMNSIVDIFTIPPTFISYYLKSNWLGLRFLRALRLLELPQILQILRAIKTSNSVKFSKLLSIILSTWFTAAGFIHLVENSGDPWLKGRNSQNISYFESIYLVMATTSTVGFGDVVAKTSLGRTFIMFFTLGSLILFANYIPEMVELFANKRKYTSSYEALKGKKFIVVCGNITVDSVTAFLRNFLRDKSGEINTEIVFLGETPPSLELETIFKCYLAYTTFISGSAMKWEDLRRVAVESAEACLIIANPLCSDSHAEDISNIMRVLSIKNYDSTTRIIIQILQSHNKVYLPKIPSWNWDTGDNIICFAELKLGFIAQGCLVPGLCTFLTSLFVEQNKKVMPKQTWKKHFLNSMKNKILTQRLSDDFAGMSFPEVARLCFLKMHLLLIAIEYKSLFTDGFCGLILNPPPQVRIRKNTLGFFIAETPKDVRRALFYCSVCHDDVFIPELITNCGCKSRSRQHITVPSVKRMKKCLKGISSRISGQDSPPRVSASTSSISNFTTRTLQHDVEQDSDQLDSSGMFHWCKPTSLDKVTLKRTGKSKYKFRNHIVACVFGDAHSAPMGLRNFVMPLRASNYTRKELKDIVFIGSLDYLQREWRFLWNFPQIYILPGCALYSGDLHAANIEQCSMCAVLSPPPQPSSNQTLVDTEAIMATLTIGSLQIDSSSDPSPSVSEETPGYTNGHNEKSNCRKVPILTELKNPSNIHFIEQLGGLEGSLQETNLHLSTAFSTGTVFSGSFLDSLLATLMWKLAIKGSQFQGRSSGLCWPSTIIMSWNCFRCW

SEQ ID NO: 7400 - protein, 51 aa, Homo Sapiens
MIKKTEFSNVCSIFYLILQAMLKGLLQLSCPGIASDAGDRRSKFSAGTTFR

SEQ ID NO: 7401 - protein, 1628 aa, Homo Sapiens
MAGVGAAALSLLLHLGALALAAGAEGGAVPREPPGQQTTAHSSVLAGNSQEQWHPLREWLGRLEAAVMELREQNKDLQTRVRQLESCECHPASPQCWGLGRAWPEGARWEPDACTACVCQDGAAHCGPQAHLPHCRGCSQNGQTYGNGETFSPDACTTCRCLEGTITCNQKPCPRGPCPEPGACCPHCKPGCDYEGQLYEEGVTFLSSSNPCLQCTCLRSRVRCMALKCPPSPCPEPVLRPGHCCPTCQGCTEGGSHWEHGQEWTTPGDPCRICRCLEGHIQCRQRECASLCPYPARPLPGTCCPVCDGCFLNGREHRSGEPVGSGDPCSHCRCANGSVQCEPLPCPPVPCRHPGKIPGQCCPVCDGCEYQGHQYQSQETFRLQERGLCVRCSCQAGEVSCEEQECPVTPCALPASGRQLCPACELDGEEFAEGVQWEPDGRPCTACVCQDGVPKCGAVLCPPAPCQHPTQPPGACCPSCDSCTYHSQVYANGQNFTDADSPCHACHCQDGTVTCSLVDCPPTTCARPQSGPGQCCPRCPDCILEEEVFVDGESFSHPRDPCQECRCQEGHAHCQPRPCPRAPCAHPLPGTCCPNDCSGCAFGGKEYPSGADFPHPSDPCRLCRCLSGNVQCLARRCVPLPCPEPVLLPGECCPQCPAAPAPAGCPRPGAAHARHQEYFSPPGDPCRRCLCLDGSVSCQRLPCPPAPCAHPRQGPCCPSCDGCLYQGKEFASGERFPSPTAACHLCLCWEGSVSCEPKACAPALCPFPARGDCCPDCDGCEYLGESYLSNQEFPDPREPCNLCTCLGGFVTCGRRPCEPPGCSHPLIPSGHCCPTCQGCRYHGVTTASGETLPDPLDPTCSLCTCQEGSMRCQKKPCPPALCPHPSPGPCFCPVCHSCLSQGREHQDGEEFEGPAGSCEWCRCQAGQVSCVRLQCPPLPCKLQVTERGSCCPRCRGCLAHGEEHPEGSRWVPPDSACSSCVCHEGVVTCARIQCISSCAQPRQGPHDCCPQCSDCEHEGRKYEPGESFQPGADPCEVCICEPQPEGPPSLRCHRRQCPSLVGCPPSQLLPPGPQHCCPTCAEALSNCSEGLLGSELAPPDPCYTCQCQDLTWLCIHQACPELSCPLSERHTPPGSCCPVCRECVVEAEGRRVADGESWRDPSNACIACTCHRGHVECHLEECQALSCPHGWAKVPQADSCCERCQAPTQSCVHQGREVASGERWTVDTCTSCSCMAGTVRCQSQRCSPLSCGPDKAPALSPGSCCPRCLPRPASCMAFGDPHYRTFDGRLLHFQGSCSYVLAKDCHSGDFSVHVTNDDRGRSGVAWTQEVAVLLGDMAVRLLQDGAVTVDGHPVALPFLQEPLLYVELRGHTVILHAQPGLQVLWDGQSQVEVSVPGSYQGRTCGLCGNFNGFAQDDLQGPEGLLLPSEAAFGNSWQVSEGLWPGRPCSAGREVDPCRAAGYRARREANARCGVLKSSPFSRCHAVVPPEPFFAACVYDLCACGPGSSADACLCDALEAYASHCRQAGVTPTWRGPTLCVVGCPLERGFVFDECGPPCPRTCFNQHIPLGELAAHCVRPCVPGCQCPAGLVEHEAHCIPPEACPQVLLTGDQPLGARPSPSREPQETP

SEQ ID NO: 7402 - protein, 1504 aa, Homo Sapiens
MAGVGAAALSLLLHLGALALAAGAEGGAVPREPPGQQTTAHSSVLAGNSQEQWHPLREWLGRLEAAVMELREQNKDLQTRVRQLESCECHPASPQCWGLGRAWPEGARWEPDACTACVCQDGAAHCGPQAHLPHCRGCSQNGQTYGNGETFSPDACTTCRCLTGAVQCQGPSCSELNCLESCTPPGECCPICRCTEGGSHWEHGQEWTTPGDPCRICRCLEGHIQCRQRECASLCPYPARPLPGTCCPVCDGCFLNGREHRSGEPVGSGDPCSHCRCANGSVQCEPLPCPPVPCRHPGKIPGQCCPVCDGCEYQGHQYQSQETFRLQERGLCVRCSCQAGEVSCEEQECPVTPCALPASGRQLCPACELDGEEFAEGVQWEPDGRPCTACVCQDGVPKCGAVLCPPAPCQHPTQPPGACCPSCDSCTYHSQVYANGQNFTDADSPCHACHCQDGTVTCSLVDCPPTTCARPQSGPGQCCPRCPDCILEEEVFVDGESFSHPRDPCQECRCQEGHAHCQPRPCPRAPCAHPLPGTCCPNDCSGCAFGGKEYPSGADFPHPSDPCRLCRCLSGNVQCLARRCVPLPCPEPVLLPGECCPQCPAPAGCPRPGAAHARHQEYFSPPGDPCRRCLCLDGSVSCQRLPCPPAPCAHPRQGPCCPSCDGCLYQGKEFASGERFPSPTAACHLCLCWEGSVSCEPKACAPALCPFPARGDCCPDCDGCEYLGESYLSNQEFPDPREPCNLCTCLGGFVTCGRRPCEPPGCSHPLIPSGHCCPTCQGCRYHGVTTASGETLPDPLDPTCSLCTCQEGSMRCQKKPCPPALCPHPSPGPCFCPVCHSCLSQGREHQDGEEFEGPAGSCEWCRCQAGQVSCVRLQCPPLPCKLQVTERGSCCPRCRGCLAHGEEHPEGSRWVPPDSACSSCVCHEGVVTCARIQCISSCAQPRQGPHDCCPQCSDCEHEGRKYEPGESFQPGADPCEVCICEPQPEGPPSLRCHRRQCPSLVGCPPSQLLPPGPQHCCPTCAEALSNCSEGLLGSELAPPDPCYTCQCQDLTWLCIHQACPELSCPLSERHTPPGSCCPVCRAPTQSCVHQGREVASGERWTVDTCTSCSCMAGTVRCQSQRCSPLSCGPDKAPALSPGSCCPRCLPRPASCMAFGDPHYRTFDGRLLHFQGSCSYVLAKDCHSGDFSVHVTNDDRGRSGVAWTQEVAVLLGDMAVRLLQDGAVTVDGHPVALPFLQEPLLYVELRGHTVILHAQPGLQVLWDGQSQVEVSVPGSYQGRTCGLCGNFNGFAQDDLQGPEGLLLPSEAAFGNSWQVSEGLWPGRPCSAGREVDPCRAAGYRARREANARCGVLKSSPFSRCHAVVPPEPFFAACVYDLCACGPGSSADACLCDALEAYASHCRQAGVTPTWRGPTLCVVGCPLERGFVFDECGPPCPRTCFNQHIPLGELAAHCVRPCVPGCQCPAGLVEHEAHCIPPEACPQVLLTGDQPLGARPSPSREPQETP

SEQ ID NO: 7403 - protein, 1568 aa, Homo Sapiens
MAGVGAAALSLLLHLGALALAAGAEGGAVPREPPGQQTTAHSSVLAGNSQEQWHPLREWLGRLEAAVMELREQNKDLQTRVRQLESCECHPASPQCWGLGRAWPEGARWEPDACTACVCQDGAAHCGPQAHLPHCRGCSQNGQTYGNGETFSPDACTTCRCLTGAVQCQGPSCSELNCLESCTPPGECCPICRPGCDYEGQLYEEGVTFLSSSNPCLQCTCLRSRVRCMALKCPPSPCPEPVLRPGHCCPTCQGCTEGGSHWEHGQEWTTPGDPCRICRCLEGHIQCRQRECASLCPYPARPLPGTCCPVCDGCFLNGREHRSGEPVGSGDPCSHCRCANGSVQCEPLPCPPVPCRHPGKIPGQCCPVCDGCEYQGHQYQSQETFRLQERGLCVRCSCQAGEVSCEEQECPVTPCALPASGRQLCPACELDGEEFAEGVQWEPDGRPCTACVCQDGVPKCGAVLCPPAPCQHPTQPPGACCPSCDSCTYHSQVYANGQNFTDADSPCHACHCQDGTVTCSLVDCPPTTCARPQSGPGQCCPRCPDCILEEEVFVDGESFSHPRDPCQECRCQEGHAHCQPRPCPRAPCAHPLPGTCCPNDCSGCAFGGKEYPSGADFPHPSDPCRLCRCLSGNVQCLARRCVPLPCPEPVLLPGECCPQCPAAPAPAGCPRPGAAHARHQEYFSPPGDPCRRCLCLDGSVSCQRLPCPPAPCAHPRQGPCCPSCDGCLYQGKEFASGERFPSPTAACHLCLCWEGSVSCEPKACAPALCPFPARGDCCPDCDGCEYLGESYLSNQEFPDPREPCNLCTCLGGFVTCGRRPCEPPGCSHPLIPSGHCCPTCQGCRYHGVTTASGETLPDPLDPTCSLCTCQEGSMRCQKKPCPPALCPHPSPGPCFCPVCHSCLSQGREHQDGEEFEGPAGSCEWCRCQAGQVSCVRLQCPPLPCKLQVTERGSCCPRCRGCLAHGEEHPEGSRWVPPDSACSSCVCHEGVVTCARIQCISSCAQPRQGPHDCCPQCSDCEHEGRKYEPGESFQPGADPCEVCICEPQPEGPPSLRCHRRQCPSLVGCPPSQLLPPGPQHCCPTCAEALSNCSEGLLGSELAPPDPCYTCQCQDLTWLCIHQACPELSCPLSERHTPPGSCCPVCRAPTQSCVHQGREVASGERWTVDTCTSCSCMAGTVRCQSQRCSPLSCGPDKAPALSPGSCCPRCLPRPASCMAFGDPHYRTFDGRLLHFQGSCSYVLAKDCHSGDFSVHVTNDDRGRSGVAWTQEVAVLLGDMAVRLLQDGAVTVDGHPVALPFLQEPLLYVELRGHTVILHAQPGLQVLWDGQSQVEVSVPGSYQGRTCGLCGNFNGFAQDDLQGPEGLLLPSEAAFGNSWQVSEGLWPGRPCSAGREVDPCRAAGYRARREANARCGVLKSSPFSRCHAVVPPEPFFAACVYDLCACGPGSSADACLCDALEAYASHCRQAGVTPTWRGPTLCVVGCPLERGFVFDECGPPCPRTCFNQHIPLGELAAHCVRPCVPGCQCPAGLVEHEAHCIPPEACPQVLLTGDQPLGARPSPSREPQETP

SEQ ID NO: 7404 - protein, 1275 aa, Homo Sapiens
MAGVGAAALSLLLHLGALALAAGAEGGAVPREPPGQQTTAHSSVLAGNSQEQWHPLREWLGRLEAAVMELREQNKDLQTRVRQLESCECHPASPQCWGLGRAWPEGARWEPDACTACVCQDGAAHCGPQAHLPHCRGCSQNGQTYGNGETFSPDACTTCRCLTGAVQCQGPSCSELNCLESCTPPGECCPICRPGCDYEGQLYEEGVTFLSSSNPCLQCTCLRSRVRCMALKCPPSPCPEPVLRPGHCCPTCQGCTEGGSHWEHGQEWTTPGDPCRICRCLEGHIQCRQRECASLCPYPARPLPGTCCPVCDGCFLNGREHRSGEPVGSGDPCSHCRCANGSVQCEPLPCPPVPCRHPGKIPGQCCPVCDGCEYQGHQYQSQETFRLQERGLCVRCSCQAGEVSCEEQECPVTPCALPASGRQLCPACELDGEEFAEGVQWEPDGRPCTACVCQDGVPKCGAVLCPPAPCQHPTQPPGACCPSCDSCTYHSQVYANGQNFTDADSPCHACHCQDGTVTCSLVDCPPTTCARPQSGPGQCCPRCPDCILEEEVFVDGESFSHPRDPCQECRCQEGHAHCQPRPCPRAPCAHPLPGTCCPNDCSGCAFGGKEYPSGADFPHPSDPCRLCRCLSGNVQCLARRCVPLPCPEPVLLPGECCPQCPAAPAPAGCPRPGAAHARHQEYFSPPGDPCRRCLCLDGSVSCQRLPCPPAPCAHPRQGPCCPSCDGCLYQGKEFASGERFPSPTAACHLCLCWEGSVSCEPKACAPALCPFPARGDCCPDCDGCEYLGESYLSNQEFPDPREPCNLCTCLGGFVTCGRRPCEPPGCSHPLIPSGHCCPTCQGCRYHGVTTASGETLPDPLDPTCSLCTCQEGSMRCQKKPCPPALCPHPSPGPCFCPVCHSCLSQGREHQDGEEFEGPAGSCEWCRCQAGQVSCVRLQCPPLPCKLQVTERGSCCPRCRGCLAHGEEHPEGSRWVPPDSACSSCVCHEGVVTCARIQCISSCAQPRQGPHDCCPQCSDCEHEGRKYEPGESFQPGADPCEVCICEPQPEGPPSLRCHRRQCPSLVGCPPSQLLPPGPQHCCPTCAEALSNCSEGLLGSELAPPDPCYTCQCQDLTWLCIHQACPELSCPLSERHTPPGSCCPVCRAPTQSCVHQGREVASGERWTVDTCTSCSCMAGTVRCQSQRCSPLSCGPDKAPALSPGSCCPRCLPRPASCMAFGDPHYRTFDGRLLHFQGSCSYVLAKDCHSGDFRWMGTRWPCPSCRSRCCMWSCEDTL

SEQ ID NO: 7405 - protein, 502 aa, Homo Sapiens
MFGTLLLYCFFLATVPALAETGGERQLSPEKSEIWGPGLKADVVLPARYFYIQAVDTSGNKFTSSPGEKVFQVKVSAPEEQFTRVGVQVLDRKDGSFIVRYRMYASYKNLKVEIKFQGQHVAKSPYILKGPVYHENCDCPLQDSAAWLREMNCPETIAQIQRDLAHFPAVDPEKIAVEIPKRFGQRQSLCHYTLKDNKVYIKTHGEHVGFRIFMDAILLSLTRKVKMPDVELFVNLGDWPLEKKKSNSNIHPIFSWCGSTDSKDIVMPTYDLTDSVLETMGRVSLDMMSVQANTGPPWESKNSTAVWRGRDSRKERLELVKLSRKHPELIDAAFTNFFFFKHDENLYGPIVKHISFFDFFKHKYQINIDGTVAAYRLPYLLVGDSVVLKQDSIYYEHFYNELQPWKHYIPVKSNLSDLLEKLKWAKDHDEEAKKIAKAGQEFARNNLMGDDIFCYYFKLFQEYANLQVSEPQIREGMKRVEPQTEDDLFPCTCHRKKTKDEL

SEQ ID NO: 7406 - protein, 507 aa, Homo Sapiens
MRRLPRALLLQLRLALLVAAGAPEVLVSAPRSLVWGPGLQAAVVLPVRYFYLQAVNSEGQNLTRSPAGETPFKVVVKSLSPKELVRIHVPKPLDRNDGTFLMRYRMYETVDEGLKIEVLYGDEHVAQSPYILKGPVYHEYCECPEDPQAWQKTLSCPTKEPQIAKDFASFPSINLQQMLKEVPKRFGDERGAIVHYTILNNHVYRRSLGKYTDFKMFSDEILLSLTRKVLLPDLEFYVNLGDWPLEHRKVNGTPSPIPIISWCGSLDSRDVVLPTYDITHSMLEAMRGVTNDLLSIQGNTGPSWINKTERAFFRGRDSREERLQLVQLSKENPQLLDAGITGYFFFQEKEKELGKAKLMGFFDFFKYKYQVNVDGTVAAYRYPYLMLGDSLVLKQDSPYYEHFYMALEPWKHYVPIKRNLSDLLEKVKWAKENDEEAKKIAKEGQLMARDLLQPHRLYCYYYQVLQKYAERQSSKPEVRDGMELVPQPEDSTAICQCHRKKPSREEL

SEQ ID NO: 7407 - protein, 451 aa, Homo Sapiens
MVELFIFLFLLGETPFKVVVKSLSPKELVRIHVPKPLDRNDGTFLMRYRMYETVDEGLKIEVLYGDEHVAQSPYILKGPVYHEYCECPEDPQAWQKTLSCPTKEPQIAKDFASFPSINLQQMLKEVPKRFGDERGAIVHYTILNNHVYRRSLGKYTDFKMFSDEILLSLTRKVLLPDLEFYVNLGDWPLEHRKVNGTPSPIPIISWCGSLDSRDVVLPTYDITHSMLEAMRGVTNDLLSIQGNTGPSWINKTERAFFRGRDSREERLQLVQLSKENPQLLDAGITGYFFFQEKEKELGKAKLMGFFDFFKYKYQVNVDGTVAAYRYPYLMLGDSLVLKQDSPYYEHFYMALEPWKHYVPIKRNLSDLLEKVKWAKENDEEAKKIAKEGQLMARDLLQPHRLYCYYYQVLQKYAERQSSKPEVRDGMELVPQPEDSTAICQCHRKKPSREEL

SEQ ID NO: 7408 - protein, 409 aa, Homo Sapiens
MVELFIFLFLLGETPFKVVVKSLSPKELVRIHVPKPLDRNDGTFLMRYRMYETVDEGLKIEVLYGDEHVAQSPYILKGPVYHEYCECPEDPQAWQKTLSCPTKEPQIAKDFASFPSINLQQMLKEVPKRFGDERGAIVHYTILNNHVYRRSLGKYTDFKMFSDEILLSLTRKVLLPDLEFYVNLGDWPLEHRKVNGTPSPIPIISWCGSLDSRDVVLPTYDITHSMLEAMRGVTNDLLSIQGNTGPSWINKTERAFFRGRDSREERLQLVQLSKENPQLLDAGITGYFFFQEKEKELGKAKLMGFFDFFKYKYQVNVDGTVAAYRYPYLMLGDSLVLKQDSPYYEHFYMALEPWKHYVPIKRNLSDLLEKVKWAKSFTLSPRLECSGTISTHCNLCLPGSRNFVPQPPE

SEQ ID NO: 7409 - protein, 160 aa, Homo Sapiens
  misc_feature (1)..(1): Xaa can be any naturally occurring amino acid
XEAMRGVTNDLLSIQGNTGPSWINKTERAFFRGRDSREERLQLVQLSKENPQLLDAGITGYFFFQEKEKELGKAKLMGFFDFFKENDEEAKKIAKEGQLMARDLLQPHRLYCYYYQVLQKYAERQSSKPEVRDGMELVPQPEDSTAICQCHRKKPSREEL

SEQ ID NO: 7410 - protein, 302 aa, Homo Sapiens [sequence omitted]

SEQ ID NO: 7411 - protein, 876 aa, Homo Sapiens
MLSGKKAAAAAAAAAAAATGTEAGPGTAGGSENGSEVAAQPAGLSGPAEVGPGAVGERTPRKKEPPRASPPGGLAEPPGSAGPQAGPTVVPGSATPMETGIAETPEGRRTSRRKRAKVEYREMDESLANLSEDEYYSEEERNAKAEKEKKLPPPPPQAPPEEENESEPEEPSGQAGGLQDDSSGGYGDGQASGVEGAAFQSRLPHDRMTSQEAACFPDIISGPQQTQKVFLFIRNRTLQLWLDNPKIQLTFEATLQQLEAPYNSDTVLVHRVHSYLERHGLINFGIYKRIKPLPTKKTGKVIIIGSGVSGLAAARQLQSFGMDVTLLEARDRVGGRVATFRKGNYVADLGAMVVTGLGGNPMAVVSKQVNMELAKIKQKCPLYEANGQADTVKVPKEKDEMVEQEFNRLLEATSYLSHQLDFNVLNNKPVSLGQALEVVIQLQEKHVKDEQIEHWKKIVKTQEELKELLNKMVNLKEKIKELHQQYKEASEVKPPRDITAEFLVKSKHRDLTALCKEYDELAETQGKLEEKLQELEANPPSDVYLSSRDRQILDWHFANLEFANATPLSTLSLKHWDQDDDFEFTGSHLTVRNGYSCVPVALAEGLDIKLNTAVRQVRYTASGCEVIAVNTRSTSQTFIYKCDAVLCTLPLGVLKQQPPAVQFVPPLPEWKTSAVQRMGFGNLNKVVLCFDRVFWDPSVNLFGHVGSTTASRGELFLFWNLYKAPILLALVAGEAAGIMENISDDVIVGRCLAILKGIFGSSAVPQPKETVVSRWRADPWARGSYSYVAAGSSGNDYDLMAQPITPGPSIPGAPQPIPRLFFAGEHTIRNYPATVHGALLSGLREAGRIADQFLGAMYTLPRQATPGVPAQQSPSM

SEQ ID NO: 7412 - protein, 852 aa, Homo Sapiens
MLSGKKAAAAAAAAAAAATGTEAGPGTAGGSENGSEVAAQPAGLSGPAEVGPGAVGERTPRKKEPPRASPPGGLAEPPGSAGPQAGPTVVPGSATPMETGIAETPEGRRTSRRKRAKVEYREMDESLANLSEDEYYSEEERNAKAEKEKKLPPPPPQAPPEEENESEPEEPSGVEGAAFQSRLPHDRMTSQEAACFPDIISGPQQTQKVFLFIRNRTLQLWLDNPKIQLTFEATLQQLEAPYNSDTVLVHRVHSYLERHGLINFGIYKRIKPLPTKKTGKVIIIGSGVSGLAAARQLQSFGMDVTLLEARDRVGGRVATFRKGNYVADLGAMVVTGLGGNPMAVVSKQVNMELAKIKQKCPLYEANGQAVPKEKDEMVEQEFNRLLEATSYLSHQLDFNVLNNKPVSLGQALEVVIQLQEKHVKDEQIEHWKKIVKTQEELKELLNKMVNLKEKIKELHQQYKEASEVKPPRDITAEFLVKSKHRDLTALCKEYDELAETQGKLEEKLQELEANPPSDVYLSSRDRQILDWHFANLEFANATPLSTLSLKHWDQDDDFEFTGSHLTVRNGYSCVPVALAEGLDIKLNTAVRQVRYTASGCEVIAVNTRSTSQTFIYKCDAVLCTLPLGVLKQQPPAVQFVPPLPEWKTSAVQRMGFGNLNKVVLCFDRVFWDPSVNLFGHVGSTTASRGELFLFWNLYKAPILLALVAGEAAGIMENISDDVIVGRCLAILKGIFGSSAVPQPKETVVSRWRADPWARGSYSYVAAGSSGNDYDLMAQPITPGPSIPGAPQPIPRLFFAGEHTIRNYPATVHGALLSGLREAGRIADQFLGAMYTLPRQATPGVPAQQSPSM

SEQ ID NO: 7413 - protein, 858 aa, Homo Sapiens
MLSGKKAAAAAAAAAAAATGTEAGPGTAGGSENGSEVAAQPAGLSGPAEVGPGAVGERTPRKKEPPRASPPGGLAEPPGSAGPQAGPTVVPGSATPMETGIAETPEGRRTSRRKRAKVEYREMDESLANLSEDEYYSEEERNAKAEKEKKLPPPPPQAPPEEENESEPEEPSGVEGAAFQSRLPHDRMTSQEAACFPDIISGPQQTQKVFLFIRNRTLQLWLDNPKIQLTFEATLQQLEAPYNSDTVLVHRVHSYLERHGLINFGIYKRIKPLPTKKTGKVIIIGSGVSGLAAARQLQSFGMDVTLLEARDRVGGRVATFRKGNYVADLGAMVVTGLGGNPMAVVSKQVNMELAKIKQKCPLYEANGQAVPKEKDEMVEQEFNRLLEATSYLSHQLDFNVLNNKPVSLGQALEVVIQLQEKHVKDEQIEHWKKIVKTQEELKELLNKMVNLKEKIKELHQQYKEASEVKPPRDITAEFLVKSKHRDLTALCKEYDELAETQGKLEEKLQELEANPPSPLFFCSDVYLSSRDRQILDWHFANLEFANATPLSTLSLKHWDQDDDFEFTGSHLTVRNGYSCVPVALAEGLDIKLNTAVRQVRYTASGCEVIAVNTRSTSQTFIYKCDAVLCTLPLGVLKQQPPAVQFVPPLPEWKTSAVQRMGFGNLNKVVLCFDRVFWDPSVNLFGHVGSTTASRGELFLFWNLYKAPILLALVAGEAAGIMENISDDVIVGRCLAILKGIFGSSAVPQPKETVVSRWRADPWARGSYSYVAAGSSGNDYDLMAQPITPGPSIPGAPQPIPRLFFAGEHTIRNYPATVHGALLSGLREAGRIADQFLGAMYTLPRQATPGVPAQQSPSM

SEQ ID NO: 7414 - protein, 274 aa, Homo Sapiens
IFVEFDGCNWKQHSWVKVHAEEVIVLLLEGSLVWAPREDPVLLQGIRVSIAQWPALTFTPLVDKLGLGSVVPVEYLLDRELRFLSDANGLHLFQMGTDSQNQILLEHAALRETVNALISDQKLQEIFSRGPYSVQGHRVKIYQPEGEEGWLYGVVSHQDSITRLMEVSVTESGEIKSVDPRLIHVMLMDNSAPQSEGGTLKAVKSSKGKKKRESIEGKDGRRRKSASDSGCDPASKKLKGDRGEVDSNGSDGDKPQHSLCHLHQRKRQDSGGAG

SEQ ID NO: 7415 - protein, 1761 aa, Homo Sapiens
MADAAASPVGKRLLLLFADTAASASASAPAAAAASGDPGPALRTRAWRAGTVRAMSGAVPQDLAIFVEFDGCNWKQHSWVKVHAEEVIVLLLEGSLVWAPREDPVLLQGIRVSIAQWPALTFTPLVDKLGLGSVVPVEYLLDRELRFLSDANGLHLFQMGTDSQNQILLEHAALRETVNALISDQKLQEIFSRGPYSVQGHRVKIYQPEGEEGWLYGVVSHQDSITRLMEVSVTESGEIKSVDPRLIHVMLMDNSAPQSEGGTLKAVKSSKGKKKRESIEGKDGRRRKSASDSGCDPASKKLKGDRGEVDSNGSDGGEASRGPWKGGNASGEPGLDQRAKQPPSTFVPQINRNIRFATYTKENGRTLVVQDEPVGGDTPASFTPYSTATGQTPLAPEVGGAENKEAGKTLEQVGQGIVASAAVVTTASSTPNTVRISDTGLAAGTVPEKQKGSRSQASGENSRNSILASSGFGAPLPSSSQPLTFGSGRSQSNGVLATENKPLGFSFGCSSAQEAQKDTDLSKNLFFQCMSQTLPTSNYFTTVSESLADDSSSRDSFKQSLESLSSGLCKGRSVLGTDTKPGSKAGSSVDRKVPAESMPTLTPAFPRSLLNARTPENHENLFLQPPKLSREEPSNPFLAFVEKVEHSPFSSFASQASGSSSSATTVTSKVAPSWPESHSSADSASLAKKKPLFITTDSSKLVSGVLGSALTSGGPSLSAMGNGRSSSPTSSLTQPIEMPTLSSSPTEERPTVGPGQQDNPLLKTFSNVFGRHSGGFLSSPADFSQENKAPFEAVKRFSLDERSLACRQDSDSSTNSDLSDLSDSEEQLQAKTGLKGIPEHLMGKLGPNGERSAELLLGKSKGKQAPKGRPRTAPLKVGQSVLKDVSKVKKLKQSGEPFLQDGSCINVAPHLHKCRECRLERYRKFKEQEQDDSTVACRFFHFRRLIFTRKGVLRVEGFLSPQQSDPDAMNLWIPSSSLAEGIDLETSKYILANVGDQFCQLVMSEKEAMMMVEPHQKVAWKRAVRGVREMCDVCETTLFNIHWVCRKCGFGVCLDCYRLRKSRPRSETEEMGDEEVFSWLKCAKGQSHEPENLMPTQIIPGTALYNIGDMVHAARGKWGIKANCPCISRQNKSVLRPAVTNGMSQLPSINPSASSGNETTFSGGGGPAPVTTPEPDHVPKADSTDIRSEEPLKTDSSASNSNSELKAIRPPCPDTAPPSSALHWLADLATQKAKEETKEAGSLRSVLNKESHSPFGLDSFNSTAKVSPLTPKLFNSLLLGPTASNNKTEGSSLRDLLHSGPGKLPQTPLDTGIPFPPVFSTSSAGVKSKASLPNFLDHIIASVVENKKTSDASKRACNLTDTQKEVKEMVMGLNVLDPHTSHSWLCDGRLLCLHDPSNKNNWKIFRECWKQGQPVLVSGVHKKLKSELWKPEAFSQEFGDQDVDLVNCRNCAIISDVKVRDFWDGFEIICKRLRSEDGQPMVLKLKDWPPGEDFRDMMPTRFEDLMENLPLPEYTKRDGRLNLASRLPSYFVRPDLGPKMYNAYGLITAEDRRVGTTNLHLDVSDAVNVMVYVGIPIGEGAHDEEVLKTIDEGDADEVTKQRIHDGKEKPGALWHIYAAKDAEKIRELLRKVGEEQGQENPPDHDPIHDQSWYLDQTLRKRLYEEYGVQGWAIVQFLGDAVFIPAGAPHQVHNLYSCIKVAEDFVSPEHVKHCFRLTQEFRHLSNTHTNHEDKLQVKNIIYHAVKDAVGTLKAHESKLARS

SEQ ID NO: 7416 - protein, 759 aa, Homo Sapiens
MSEKEAMMMVEPHQKVAWKRAVRGVREMCDVCETTLFNIHWVCRKCGFGVCLDCYRLRKSRPRSETEEMGDEEVFSWLKCAKGQSHEPENLMPTQIIPGTALYNIGDMVHAARGKWGIKANCPCISRQNKSVLRPAVTNGMSQLPSINPSASSGNETTFSGGGGPAPVTTPEPDHVPKADSTDIRSEEPLKTDSSASNSNSELKAIRPPCPDTAPPSSALHWLADLATQKAKEETKEAGSLRSVLNKESHSPFGLDSFNSTAKVSPLTPKLFNSLLLGPTASNNKTEGSSLRDLLHSGPGKLPQTPLDTGIPFPPVFSTSSAGVKSKASLPNFLDHIIASVVENKKTSDASKRACNLTDTQKEVKEMVMGLNVLDPHTSHSWLCDGRLLCLHDPSNKNNWKIFRECWKQGQPVLVSGVHKKLKSELWKPEAFSQEFGDQDVDLVNCRNCAIISDVKVRDFWDGFEIICKRLRSEDGQPMVLKLKDWPPGEDFRDMMPTRFEDLMENLPLPEYTKRDGRLNLASRLPSYFVRPDLGPKMYNAYGLITAEDRRVGTTNLHLDVSDAVNVMVYVGIPIGEGAHDEEVLKTIDEGDADEVTKQRIHDGKEKPGALWHIYAAKDAEKIRELLRKVGEEQGQENPPDHDPIHDQSWYLDQTLRKRLYEEYGVQGWAIVQFLGDAVFIPAGAPHQVHNLYSCIKVAEDFVSPEHVKHCFRLTQEFRHLSNTHTNHEDKLQVKNIIYHAVKDAVGTLKAHESKLARS

SEQ ID NO: 7417 - protein, 20 aa, Homo Sapiens
VPEKQKGSRSQASGELASQC

SEQ ID NO: 7418 - protein, 1384 aa, Homo Sapiens
MAAGKASGESEEASPSLTAEEREALGGLDSRLFGFVRFHEDGARTKALLGKAVRCYESLILKAEGKVESDFFCQLGHFNLLLEDYPKALSAYQRYYSLQSDYWKNAAFLYGLGLVYFHYNAFQWAIKAFQEVLYVDPSFCRAKEIHLRLGLMFKVNTDYESSLKHFQLALVDCNPCTLSNAEIQFHIAHLYETQRKYHSAKEAYEQLLQTENLSAQVKATVLQQLGWMHHTVDLLGDKATKESYAIQYLQKSLEADPNSGQSWYFLGRCYSSIGKVQDAFISYRQSIDKSEASADTWCSIGVLYQQQNQPMDALQAYICAVQLDHGHAAAWMDLGTLYESCNQPQDAIKCYLNATRSKSCSNTSALAARIKYLQACKPHHPNTEPVLGLSQTPISQQSLPLHMIPSSQVDDLSSPAKRKRTSSPTKNTSDNWSGGHAVSHPPVQQQAHSWCLTPQKLQHLEQLRANRNNLNPAQKLMLEQLESQFVLMQQHQMRPTGVAQVRSTGIPNGPTADSSLPTNSVSGQQPQLALTRVPSVSQPGVRPACPGQPLANGPFSAGHVPCSTSRTLGSTDTILIGNNHITGSGSNGNVPYLQRNALTLPHNRTNLTSSAEEPWKNQLSNSTQGLHKGQSSHSAGPNGERPLSSTGPSQHLQAAGSGIQNQNGHPTLPSNSVTQGAALNHLSSHTATSGGQQGITLTKESKPSGNILTVPETSRHTGETPNSTASVEGLPNHVHQMTADAVCSPSHGDSKSPGLLSSDNPQLSALLMGKANNNVGTGTCDKVNNIHPAVHTKTDNSVASSPSSAISTATPSPKSTEQTTTNSVTSLNSPHSGLHTINGEGMEESQSPMKTDLLLVNHKPSPQIIPSMSVSIYPSSAEVLKACRNLGKNGLSNSSILLDKCPPPRPPSSPYPPLPKDKLNPPTPSIYLENKRDAFFPPLHQFCTNPNNPVTVIRGLAGALKLDLGLFSTKTLVEANNEHMVEVRTQLLQPADENWDPTGTKKIWHCESNRSHTTIAKYAQYQASSFQESLREENEKRSHHKDHSDSESTSSDNSGRRRKGPFKTIKFGTNIDLSDDKKWKLQLHELTKLPAFVRVVSAGNLLSHVGHTILGMNTVQLYMKVPGSRTPGHQENNNFCSVNINIGPGDCEWFVVPEGYWGVLNDFCEKNNLNFLMGSWWPNLEDLYEANVPVYRFIQRPGDLVWINAGTVHWVQAIGWCNNIAWNVGPLTACQYKLAVERYEWNKLQSVKSIVPMVHLSWNMARNIKVSDPKLFEMIKYCLLRTLKQCQTLREALIAAGKEIIWHGRTKEEPAHYCSICEVEVFDLLFVTNESNSRKTYIVHCQDCARKTSGNLENFVVLEQYKMEDLMQVYDQFTLAPPLPSASS

SEQ ID NO: 7419 - protein, 1269 aa, Homo Sapiens
MAAGKASGESEEASPSLTAEEREALGGLDSRLFGFVRFHEDGARTKALLGKAVRCYESLILKAEGKVESDFFCQLGHFNLLLEDYPKALSAYQRYYSLQSDYWKNAAFLYGLGLVYFHYNAFQWAIKAFQEVLYVDPSFCRAKEIHLRLGLMFKVNTDYESSLKHFQLALVDCNPCTLSNAEIQFHIAHLYETQRKYHSAKEAYEQLLQTENLSAQVKATVLQQLGWMHHTVDLLGDKATKESYAIQYLQKSLEADPNSGQSWYFLGRCYSSIGKVQDAFISYRQSIDKSEASADTWCSIGVLYQQQNQPMDALQAYICAVQLDHGHAAAWMDLGTLYESCNQPQDAIKCYLNATRSKSCSNTSALAARIKYLQACKPHHPNTEPVLGLSQTPISQQSLPLHMIPSSQVDDLSSPAKRKRTSSPTKNTSDNWSGGHAVSHPPVQQQAHSWCLTPQKLQMRPTGVAQVRSTGIPNGPTADSSLPTNSVSGQQPQLALTRVPSVSQPGVRPACPGQPLANGPFSAGHVPCSTSRTLGSTDTILIGNNHITGSGSNGNVPYLQRNALTLPHNRTNLTSSAEEPWKNQLSNSTQGLHKGQSSHSAGPNGERPLSSTGPSQHLQAAGSGIQNQNGHPTLPSNSVTQGAALNHLSSHTATSGGQQGITLTKESKPSGNILTVPETSRHTGETPNSTASVEGLPNHVHQMTADAVCSPSHGDSKSPGLLSSDNPQLSALLMGKANNNVGTGTCDKVNNIHPAVHTKTDNSVASSPSSAISTATPSPKSTEQTTTNSVTSLNSPHSGLHTINGEGMEESQSPMKTDLLLVNHKPSPQIIPSMSVSIYPSSAEVLKACRNLGKNGLSNSSILLDKCPPPRPPSSPYPPLPKDKLNPPTPSIYLENKRDAFFPPLHQFCTNPNNPVTVIRGLAGALKLDLGLFSTKTLVEANNEHMVEVRTQLLQPADENWDPTGTKKIWHCESNRSHTTIAKYAQYQASSFQESLREENEKRSHHKDHSDSESTSSDNSGRRRKGPFKTIKFGTNIDLSDDKKWKLQLHELTKLPAFVRVVSAGNLLSHVGHTILGMNTVQLYMKVPGSRTPGHQENNNFCSVNINIGPGDCEWFVVPEGYWGVLNDFCEKNNLNFLMGSWWPNLEDLYEANVPVYRFIQRPGDLVWINAGTVHWVQAIGWCNNIAWNVGPLTACQYKLAVERYEWNKLQSVKSIVPMVHLSWNMARNIKVLSSKNSEAMSDIEGSSHCCRKRDYMAWADKRRTSSLL

SEQ ID NO: 7420 - protein, 1332 aa, Homo Sapiens
MAAGKASGESEEASPSLTAEEREALGGLDSRLFGFVRFHEDGARTKALLGKAVRCYESLILKAEGKVESDFFCQLGHFNLLLEDYPKALSAYQRYYSLQSDYWKNAAFLYGLGLVYFHYNAFQWAIKAFQEVLYVDPSFCRAKEIHLRLGLMFKVNTDYESSLKHFQLALVDCNPCTLSNAEIQFHIAHLYETQRKYHSAKEAYEQLLQTENLSAQVKATVLQQLGWMHHTVDLLGDKATKESYAIQYLQKSLEADPNSGQSWYFLGRCYSSIGKVQDAFISYRQSIDKSEASADTWCSIGVLYQQQNQPMDALQAYICAVQLDHGHAAAWMDLGTLYESCNQPQDAIKCYLNATRSKSCSNTSALAARIKYLQNTSDNWSGGHAVSHPPVQQQAHSWCLTPQKLQHLEQLRANRNNLNPAQKLMLEQLESQFVLMQQHQMRPTGVAQVRSTGIPNGPTADSSLPTNSVSGQQPQLALTRVPSVSQPGVRPACPGQPLANGPFSAGHVPCSTSRTLGSTDTILIGNNHITGSGSNGNVPYLQRNALTLPHNRTNLTSSAEEPWKNQLSNSTQGLHKGQSSHSAGPNGERPLSSTGPSQHLQAAGSGIQNQNGHPTLPSNSVTQGAALNHLSSHTATSGGQQGITLTKESKPSGNILTVPETSRHTGETPNSTASVEGLPNHVHQMTADAVCSPSHGDSKSPGLLSSDNPQLSALLMGKANNNVGTGTCDKVNNIHPAVHTKTDNSVASSPSSAISTATPSPKSTEQTTTNSVTSLNSPHSGLHTINGEGMEESQSPMKTDLLLVNHKPSPQIIPSMSVSIYPSSAEVLKACRNLGKNGLSNSSILLDKCPPPRPPSSPYPPLPKDKLNPPTPSIYLENKRDAFFPPLHQFCTNPNNPVTVIRGLAGALKLDLGLFSTKTLVEANNEHMVEVRTQLLQPADENWDPTGTKKIWHCESNRSHTTIAKYAQYQASSFQESLREENEKRSHHKDHSDSESTSSDNSGRRRKGPFKTIKFGTNIDLSDDKKWKLQLHELTKLPAFVRVVSAGNLLSHVGHTILGMNTVQLYMKVPGSRTPGHQENNNFCSVNINIGPGDCEWFVVPEGYWGVLNDFCEKNNLNFLMGSWWPNLEDLYEANVPVYRFIQRPGDLVWINAGTVHWVQAIGWCNNIAWNVGPLTACQYKLAVERYEWNKLQSVKSIVPMVHLSWNMARNIKVSDPKLFEMIKYCLLRTLKQCQTLREALIAAGKEIIWHGRTKEEPAHYCSICEVEVFDLLFVTNESNSRKTYIVHCQDCARKTSGNLENFVVLEQYKMEDLMQVYDQFTLAPPLPSASS

SEQ ID NO: 7421 - protein, 1429 aa, Homo Sapiens
MAAGKASGESEEASPSLTAEEREALGGLDSRLFGFVRFHEDGARTKALLGKAVRCYESLILKAEGKVESDFFCQLGHFNLLLEDYPKALSAYQRYYSLQSDYWKNAAFLYGLGLVYFHYNAFQWAIKAFQEVLYVDPSFCRAKEIHLRLGLMFKVNTDYESSLKHFQLALVDCNPCTLSNAEIQFHIAHLYETQRKYHSAKEAYEQLLQTENLSAQVKATVLQQLGWMHHTVDLLGDKATKESYAIQYLQKSLEADPNSGQSWYFLGRCYSSIGKVQDAFISYRQSIDKSEASADTWCSIGVLYQQQNQPMDALQAYICAVQLDHGHAAAWMDLGTLYESCNQPQDAIKCYLNATRSKSCSNTSALAARIKYLQAQLCNLPQGSLQNKTKLLPSIEEAWSLPIPAELTSRQGAMNTAQQACKPHHPNTEPVLGLSQTPISQQSLPLHMIPSSQVDDLSSPAKRKRTSSPTKNTSDNWSGGHAVSHPPVQQQAHSWCLTPQKLQHLEQLRANRNNLNPAQKLMLEQLESQFVLMQQHQMRPTGVAQVRSTGIPNGPTADSSLPTNSVSGQQPQLALTRVPSVSQPGVRPACPGQPLANGPFSAGHVPCSTSRTLGSTDTILIGNNHITGSGSNGNVPYLQRNALTLPHNRTNLTSSAEEPWKNQLSNSTQGLHKGQSSHSAGPNGERPLSSTGPSQHLQAAGSGIQNQNGHPTLPSNSVTQGAALNHLSSHTATSGGQQGITLTKESKPSGNILTVPETSRHTGETPNSTASVEGLPNHVHQMTADAVCSPSHGDSKSPGLLSSDNPQLSALLMGKANNNVGTGTCDKVNNIHPAVHTKTDNSVASSPSSAISTATPSPKSTEQTTTNSVTSLNSPHSGLHTINGEGMEESQSPMKTDLLLVNHKPSPQIIPSMSVSIYPSSAEVLKACRNLGKNGLSNSSILLDKCPPPRPPSSPYPPLPKDKLNPPTPSIYLENKRDAFFPPLHQFCTNPNNPVTVIRGLAGALKLDLGLFSTKTLVEANNEHMVEVRTQLLQPADENWDPTGTKKIWHCESNRSHTTIAKYAQYQASSFQESLREENEKRSHHKDHSDSESTSSDNSGRRRKGPFKTIKFGTNIDLSDDKKWKLQLHELTKLPAFVRVVSAGNLLSHVGHTILGMNTVQLYMKVPGSRTPGHQENNNFCSVNINIGPGDCEWFVVPEGYWGVLNDFCEKNNLNFLMGSWWPNLEDLYEANVPVYRFIQRPGDLVWINAGTVHWVQAIGWCNNIAWNVGPLTACQYKLAVERYEWNKLQSVKSIVPMVHLSWNMARNIKVSDPKLFEMIKYCLLRTLKQCQTLREALIAAGKEIIWHGRTKEEPAHYCSICEVEVFDLLFVTNESNSRKTYIVHCQDCARKTSGNLENFVVLEQYKMEDLMQVYDQFTLAPPLPSASS

SEQ ID NO: 7422 - protein, 1401 aa, Homo Sapiens
MKSCGVSLATAAAAAAAFGDEEKKMAAGKASGESEEASPSLTAEEREALGGLDSRLFGFVRFHEDGARTKALLGKAVRCYESLILKAEGKVESDFFCQLGHFNLLLEDYPKALSAYQRYYSLQSDYWKNAAFLYGLGLVYFHYNAFQWAIKAFQEVLYVDPSFCRAKEIHLRLGLMFKVNTDYESSLKHFQLALVDCNPCTLSNAEIQFHIAHLYETQRKYHSAKEAYEQLLQTENLSAQVKATVLQQLGWMHHTVDLLGDKATKESYAIQYLQKSLEADPNSGQSWYFLGRCYSSIGKVQDAFISYRQSIDKSEASADTWCSIGVLYQQQNQPMDALQAYICAVQLDHGHAAAWMDLGTLYESCNQPQDAIKCYLNATRSKSCSNTSALAARIKYLQAQLCNLPQGSLQNKTKLLPSIEEAWSLPIPAELTSRQGAMNTAQQNTSDNWSGGHAVSHPPVQQQAHSWCLTPQKLQHLEQLRANRNNLNPAQKLMLEQLESQFVLMQQHQMRPTGVAQVRSTGIPNGPTADSSLPTNSVSGQQPQLALTRVPSVSQPGVRPACPGQPLANGPFSAGHVPCSTSRTLGSTDTILIGNNHITGSGSNGNVPYLQRNALTLPHNRTNLTSSAEEPWKNQLSNSTQGLHKGQSSHSAGPNGERPLSSTGPSQHLQAAGSGIQNQNGHPTLPSNSVTQGAALNHLSSHTATSGGQQGITLTKESKPSGNILTVPETSRHTGETPNSTASVEGLPNHVHQMTADAVCSPSHGDSKSPGLLSSDNPQLSALLMGKANNNVGTGTCDKVNNIHPAVHTKTDNSVASSPSSAISTATPSPKSTEQTTTNSVTSLNSPHSGLHTINGEGMEESQSPMKTDLLLVNHKPSPQIIPSMSVSIYPSSAEVLKACRNLGKNGLSNSSILLDKCPPPRPPSSPYPPLPKDKLNPPTPSIYLENKRDAFFPPLHQFCTNPNNPVTVIRGLAGALKLDLGLFSTKTLVEANNEHMVEVRTQLLQPADENWDPTGTKKIWHCESNRSHTTIAKYAQYQASSFQESLREENEKRSHHKDHSDSESTSSDNSGRRRKGPFKTIKFGTNIDLSDDKKWKLQLHELTKLPAFVRVVSAGNLLSHVGHTILGMNTVQLYMKVPGSRTPGHQENNNFCSVNINIGPGDCEWFVVPEGYWGVLNDFCEKNNLNFLMGSWWPNLEDLYEANVPVYRFIQRPGDLVWINAGTVHWVQAIGWCNNIAWNVGPLTACQYKLAVERYEWNKLQSVKSIVPMVHLSWNMARNIKVSDPKLFEMIKYCLLRTLKQCQTLREALIAAGKEIIWHGRTKEEPAHYCSICEVEVFDLLFVTNESNSRKTYIVHCQDCARKTSGNLENFVVLEQYKMEDLMQVYDQFTLAPPLPSASS

SEQ ID NO: 7423 - protein, 224 aa, Homo Sapiens
MKSCGVSLATAAAAAAAFGDEEKKMAAGKASGESEEASPSLTAEEREALGGLDSRLFGFVRFHEDGARTKALLGKAVRCYESLILKAEGKVESDFFCQLGHFNLLLEDYPKALSAYQRYYSLQSDYWKNAAFLYGLGLVYFHYNAFQWAIKAFQEVLYVDPSFCRAKEIHLRLGLMFKVNTDYESSLKHFQLALVDCNPCTLSNAEIQFHIAHLYETQVGCITL

SEQ ID NO: 7424 - protein, 161 aa, Homo Sapiens
  misc_feature (1)..(1): Xaa can be any naturally occurring amino acid
XARNIKVSDPKLFEMIKIFSLSPNFRAEKCLRDHLVQPLRSNGEPEPLRFTGEYCLLRTLKQCQTLREALIAAGKEIIWHGRTKEEPAHYCSICEVEVFDLLFVTNESNSRKTYIVHCQDCARKTSGNLENFVVLEQYKMEDLMQVYDQFTLAPPLPSASS

SEQ ID NO: 7425 - protein, 999 aa, Homo Sapiens
  misc_feature (1)..(1): Xaa can be any naturally occurring amino acid
XGTLYESCNQPQDAIKCYLNATRSKSCSNTSALAARIKYLQNTSDNWSGGHAVSHPPVQQQAHSWCLTPQKLQHLEQLRANRNNLNPAQKLMLEQLESQFVLMQQHQMRPTGVAQVRSTGIPNGPTADSSLPTNSVSGQQPQLALTRVPSVSQPGVRPACPGQPLANGPFSAGHVPCSTSRTLGSTDTILIGNNHITGSGSNGNVPYLQRNALTLPHNRTNLTSSAEEPWKNQLSNSTQGLHKGQSSHSAGPNGERPLSSTGPSQHLQAAGSGIQNQNGHPTLPSNSVTQGAALNHLSSHTATSGGQQGITLTKESKPSGNILTVPETSRHTGETPNSTASVEGLPNHVHQMTADAVCSPSHGDSKSPGLLSSDNPQLSALLMGKANNNVGTGTCDKVNNIHPAVHTKTDNSVASSPSSAISTATPSPKSTEQTTTNSVTSLNSPHSGLHTINGEGMEESQSPMKTDLLLVNHKPSPQIIPSMSVSIYPSSAEVLKACRNLGKNGLSNSSILLDKCPPPRPPSSPYPPLPKDKLNPPTPSIYLENKRDAFFPPLHQFCTNPNNPVTVIRGLAGALKLDLGLFSTKTLVEANNEHMVEVRTQLLQPADENWDPTGTKKIWHCESNRSHTTIAKYAQYQASSFQESLREENEKRSHHKDHSDSESTSSDNSGRRRKGPFKTIKFGTNIDLSDDKKWKLQLHELTKLPAFVRVVSAGNLLSHVGHTILGMNTVQLYMKVPGSRTPGHQENNNFCSVNINIGPGDCEWFVVPEGYWGVLNDFCEKNNLNFLMGSWWPNLEDLYEANVPVYRFIQRPGDLVWINAGTVHWVQAIGWCNNIAWNVGPLTACQYKLAVERYEWNKLQSVKSIVPMVHLSWNMARNIKVSDPKLFEMIKYCLLRTLKQCQTLREALIAAGKEIIWHGRTKEEPAHYCSICEVEVFDLLFVTNESNSRKTYIVHCQDCARKTSGNLENFVVLEQYKMEDLMQVYDQFTLAPPLPSASS

SEQ ID NO: 7426 - protein, 224 aa, Homo Sapiens
  misc_feature (1)..(1): Xaa can be any naturally occurring amino acid
XLQAYICAVQLDHGHAAAWMDLGTLYESCNQPQDAIKCYLNATRSKSCSNTSALAARIKYLQAQLCNLPQGSLQNKTKLLPSIEEAWSLPIPAELTSRQGAMNTAQQNTSDNWSGGHAVSHPPVQQQAHSWCLTPQKLQMRPTGVAQVRSTGIPNGPTADSSLPTNSVSGQQPQLALTRVPSVSQPGVRPACPGQPLANGPFSAGHVPCSTSRTLGSTDTILIG

SEQ ID NO: 7427 - protein, 1044 aa, Homo Sapiens
  misc_feature (1)..(1): Xaa can be any naturally occurring amino acid
XNKTKLLPSIEEAWSLPIPAELTSRQGAMNTAQQACKPHHPNTEPVLGLSQTPISQQSLPLHMIPSSQVDDLSSPAKRKRTSSPTKNTSDNWSGGHAVSHPPVQQQAHSWCLTPQKLQHLEQLRANRNNLNPAQKLMLEQLESQFVLMQQHQMRPTGVAQVRSTGIPNGPTADSSLPTNSVSGQQPQLALTRVPSVSQPGVRPACPGQPLANGPFSAGHVPCSTSRTLGSTDTILIGNNHITGSGSNGNVPYLQRNALTLPHNRTNLTSSAEEPWKNQLSNSTQGLHKGQSSHSAGPNGERPLSSTGPSQHLQAAGSGIQNQNGHPTLPSNSVTQGAALNHLSSHTATSGGQQGITLTKESKPSGNILTVPETSRHTGETPNSTASVEGLPNHVHQMTADAVCSPSHGDSKSPGLLSSDNPQLSALLMGKANNNVGTGTCDKVNNIHPAVHTKTDNSVASSPSSAISTATPSPKSTEQTTTNSVTSLNSPHSGLHTINGEGMEESQSPMKTDLLLVNHKPSPQIIPSMSVSIYPSSAEVLKACRNLGKNGLSNSSILLDKCPPPRPPSSPYPPLPKDKLNPPTPSIYLENKRDAFFPPLHQFCTNPNNPVTVIRGLAGALKLDLGLFSTKTLVEANNEHMVEVRTQLLQPADENWDPTGTKKIWHCESNRSHTTIAKYAQYQASSFQESLREENEKRSHHKDHSDSESTSSDNSGRRRKGPFKTIKFGTNIDLSDDKKWKLQLHELTKLPAFVRVVSAGNLLSHVGHTILGMNTVQLYMKVPGSRTPGHQENNNFCSVNINIGPGDCEWFVVPEGYWGVLNDFCEKNNLNFLMGSWWPNLEDLYEANVPVYRFIQRPGDLVWINAGTVHWVQAIGWCNNIAWNVGPLTACQYKLAVERYEWNKLQSVKSIVPMVHLSWNMARNIKVSDPKLFEMIKYCLLRTLKQCQTLREALIAAGKEIIWHGRTKEEPAHYCSICEVEVFDLLFVTNESNSRKTYIVHCQDCARKTSGNLENFVVLEQYKMEDLMQVYDQFTLAPPLPSASS

SEQ ID NO: 7428 - protein, 941 aa, Homo Sapiens
MAGAAAAVAAGAAAGAAAAAVSVAAPGRASAPPPPPPVYCVCRQPYDVNRFMIECDICKDWFHGSCVGVEEHHAVDIDLYHCPNCAVLHGSSLMKKRRNWHRHDYTEIDDGSKPVQAGTRTFIKELRSRVFPSADEIIIKMHGSQLTQRYLEKHGFDVPIMVPKLDDLGLRLPSPTFSVMDVERYVGGDKVIDVIDVARQADSKMTLHNYVKYFMNPNRPKVLNVISLEFSDTKMSELVEVPDIAKKLSWVENYWPDDSVFPKPFVQKYCLMGVQDSYTDFHIDFGGTSVWYHVLWGEKIFYLIKPTDENLARYESWSSSVTQSEVFFGDKVDKCYKCVVKQGHTLFVPTGWIHAVLTSQDCMAFGGNFLHNLNIGMQLRCYEMEKRLKTPDLFKFPFFEAICWFVAKNLLETLKELREDGFQPQTYLVQGVKALHTALKLWMKKELVSEHAFEIPDNVRPGHLIKELSKVIRAIEEENGKPVKSQGIPIVCPVSRSSNEATSPYHSRRKMRKLRDHNVRTPSNLDILELHTREVLKRLEMCPWEEDILSSKLNGKFNKHLQPSSTVPEWRAKDNDLRLLLTNGRIIKDERQPFADQSLYTADSENEEDKRRTKKAKMKIEESSGVEGVEHEESQKPLNGFFTRVKSELRSRSSGYSDISESEDSGPECTALKSIFTTEESESSGDEKKQEITSNFKEESNVMRNFLQKSQKPSRSEIPIKRECPTSTSTEEEAIQGMLSMAGLHYSTCLQRQIQSTDCSGERNSLQDPSSCHGSNHEVRQLYRYDKPVECGYHVKTEDPDLRTSSWIKQFDTSRFHPQDLSRSQKCIRKEGSSEISQRVQSRNYVDSSGSSLQNGKYMQNSNLTSGACQISNGSLSPERPVGETSFSVPLHPTKRPASNPPPISNQATKGKRPKKGMATAKQRLGKILKLNRNGHARFFV

SEQ ID NO: 7429 - protein, 404 aa, Homo Sapiens
  misc_feature (1)..(1): Xaa can be any naturally occurring amino acid
XAKNLLETLKELREDGFQPQTYLVQGVKALHTALKLWMKKELVSEHAFEIPDNVRPGHLIKELSKVIRAIEEENGKPVKSQGIPIVCPVSRSSNEATSPYHSRRKMRKLRDHNVRTPSNLDILELHTREVLKRLEMCPWEEDILSSKLNGKFNKHLQPSSTVPEWRAKDNDLRLLLTNGRIIKDERQPFADQSLYTADSENEEDKRRTKKAKMKIEESSGVEGVEHEESQKPLNGFFTRVKSELRSRSSGYSDISESEDSGPECTALKSIFTTEESESSGDEKKQEITSNFKEESNVMRNFLQKSQKPSRSEIPIKRECPTSTSTEEEAIQGMLSMAGLHYSTCLQRQIQSTDCSGERNSLQDPSSCHGSNHEVRQLYRYDKPVECETRSHLCCPDWSPTPELK

SEQ ID NO: 7430 - protein, 39 aa, Homo Sapiens
MLLLAAAFLVAFVLLLYMVSPLISPKPLALPGAHVVFFR

SEQ ID NO: 7431 - protein, 155 aa, Homo Sapiens
MLLLAAAFLVAFVLLLYMVSPLISPKPLALPGAHVVVTGGSSGIGKCIAIECYKQGAFITLVARNEDKLLQAKKEIEMHSINDKQVVLCISVDVSQDYNQVENVIKQAQEKLGPVDMLVNCAGMAVSGKFEDLERLMSINYLGSVYPSRAVITTM

SEQ ID NO: 7432 - protein, 332 aa, Homo Sapiens
MLLLAAAFLVAFVLLLYMVSPLISPKPLALPGAHVVVTGGSSGIGKCIAIECYKQGAFITLVARNEDKLLQAKKEIEMHSINDKQVVLCISVDVSQDYNQVENVIKQAQEKLGPVDMLVNCAGMAVSGKFEDLEVSTFERLMSINYLGSVYPSRAVITTMKERRVGRIVFVSSQAGQLGLFGFTAYSASKFAIRGLAEALQMEVKPYNVYITVAYPPDTDTPGFAEENRTKPLETRLISETTSVCKPEQVAKQIVKDAIQGNFNSSLGSDGYMLSALTCGMAPVTSITEGLQQVVTMGLFRTIALFYLGSFDSIVRRCMMQREKSENADKTA

SEQ ID NO: 7433 - protein, 332 aa, Homo Sapiens; identical to SEQ ID NO: 7432

SEQ ID NO: 7434 - protein, 298 aa, Homo Sapiens
MLLLAAAFLVAFVLLLYMVSPLISPKPLALPGAHVVVTGGSSGIGKCIAIECYKQGAFITLVARNEDKLLQAKKEIEMHSINDKQVVLCISVDVSQDYNQVENVIKQAQEKLGPVDMLVNCAGMAVSGKFEDLEVSTFERLMSINYLGSVYPSRAVITTMKERRVGRIVFVSSQAGQLGLFGFTAYSASKFAIRGLAEALQMEVKPYNVYITVAYPPDTDTPGFAEENRTKPLETRLISETTSVCKPEQVAKQIVKDAIVVTMGLFRTIALFYLGSFDSIVRRCMMQREKSENADKTA

SEQ ID NO: 7435 - protein, 268 aa, Homo Sapiens
MLLLAAAFLVAFVLLLYMVSPLISPKPLALPGAHVVVTGGSSGIGKCIAIECYKQGAFITLVARNEDKLLQAKKEIEMHSINDKQVVLCISVDVSQDYNQVENVIKQAQEKLGPVDMLVNCAGMAVSGKFEDLEVSTFEVKPYNVYITVAYPPDTDTPGFAEENRTKPLETRLISETTSVCKPEQVAKQIVKDAIQGNFNSSLGSDGYMLSALTCGMAPVTSITEGLQQVVTMGLFRTIALFYLGSFDSIVRRCMMQREKSENADKTA

SEQ ID NO: 7436 - protein, 39 aa, Homo Sapiens
MLLLAAAFLVAFVLLLYMVSPLISPKPLALPGAHVVWEG

SEQ ID NO: 7437 - protein, 352 aa, Homo Sapiens
MAGTICFIMWVLFITDTVWSRSVRQVYEVHDSDDWTIHDFECPMECFCPPSFPTALYCENRGLKEIPAIPSRIWYLYLQNNLIETIPEKPFENATQLRWINLNKNKITNYGIEKGALSQLKKLLFLFLEDNELEEVPSPLPRSLEQLQLARNKVSRIPQGTFSNLENLTLLDLQNNKLVDNAFQRDTFKGLKNLMQLNMAKNALRNMPPRLPANTMQLFLDNNSIEGIPENYFNVIPKVAFLRLNHNKLSDEGLPSRGFDVSSILDLQLSHNQLTKVPRISAHLQHLHLDHNKIKSVNVSVICPSPSMLPAERDSFSYGPHLRYLRLDGNEIKPPIPMALMTCFRLLQAVII

SEQ ID NO: 7438 - protein, 287 aa, Homo Sapiens
DPSPPLPWWDKSRLLFHGDWHMDIEQANLHQLATEFVFKGDLDINVRTASKYDDCCFLHLPDLCMTLDLQWLCHGNPHDHHSVTLRAPEFLPEVPLGQLHDSYRAFRSENLNLSIKMDLTRHSGTISQPRILLYSSTLRWMQNFWATWTSVTRPICRGKLFNNLKPSKKKLGQHYKQLSYTALFPQLQVHYWASFAQQRGIQIECSQGHVFTRGTQRLIPQAGTVMRRLISDWSVTQMVSDLSQVTVHLMASPTEENADHCLDPLVTKTHLLSLSSLTYQRHSNRTA

SEQ ID NO: 7439 - protein, 2235 aa, Homo Sapiens
MPLFFSALLVLLLVALSALFLGRWLVVRLATKWCQRKLQAELKIGSFRFFWIQNVSLKFQQHQQTVEIDNLWISSKLLSHDLPHYVALCFGEVRIRTDLQKVSDLSAPFSQSAGVDQKELSFSPSLLKIFCQLFSIHVDAINIMVLKVDTSESLWHIQISRSRFLLDSDGKRLICEVSLCKINSKVLKSGQLEDTCLVELSLALDLCLKVGISSRHLTAITVDVWTLHAELHEGLFQSQLLCQGPSLASKPVPCSEVTENLVEPTLPGLFLLQQLPDQVKVKMENTSVVLSMNSQKRHLTWTLKLLQFLYHRDEDQLPLRSFTANSDMAQMSTELLLEDGLLLSQSRQRIVCLNSLKASVQVTTIDLSASLVLNTCIIHYRHQEFSHWLHLLALETQGSSSPVLKQRKKRTFPQILAPIIFSTSISNVNISIQLGDTPPFALGFNSISLDYQHLRPQSIHQRGVLTVDHLCWRVGSDSHIQRAPHPPNMHVWGEALVLDSFTLQGSYNQPLGLSSTQSDTLFLDCTIRGLQVEASDTCAQCLSRILSLMGPQSGKSAVSRHSSFGESVSLLWKVDLKVEDMNLFTLSALVGASEVRLDTLTILGSAETSTVGIQGLVLALVKSVTEKMQPCCKAPDIPTPVLSLSMLSITYHSSIRSLEVQCGAGLTLLWSPPDHMYLYQHVLATLQCRDLLRATVFPETVPSLALETSGTTSELEGRAPEPLPPKRLLNLTLEVSTAKLTAFVAEDKFITLAAESVSLSRHGGSLQAYCPELAAGFDGNSIFNFKEVEVQLLPELEEMILHRNPFPALQTLRNRVWLLSFGSVSVEFPYQYDFSRTLDEAVGVQKWLKGLHQGTRAWASPSPVPLPPDLLLKVEHFSWVFLDDVFEVKLHDNYELMKDESKESAKRLQLLDAKVAALRKQHGELLPARKIEELYASLERKNIEIYIQRSRRLYGNTPMRRALLTWSLAGLELVALADASFHGPEHVVEQVQELDPGSPFPPEGLDLVIQWCRMLKCNVKSFLVRIRDYPRYLFEIRDWRLMGRLVGTEQSGQPCSRRRQILHLGLPWGNVAVERNMPPLKFYHDFHSEIFQYTVVWGPCWDPAWTLIGQCVDLLTKPSADPSPPLPWWDKSRLLFHGDWHMDIEQANLHQLATEDPYNTTENMHWEWSHLSFHWKPGQFVFKGDLDINVRTASKYDDCCFLHLPDLCMTLDLQWLCHGNPHDHHSVTLRAPEFLPEVPLGQLHDSYRAFRSENLNLSIKMDLTRHSGTISQPRILLYSSTLRWMQNFWATWTSVTRPICRGKLFNNLKPSKKKLGQHYKQLSYTALFPQLQVHYWASFAQQRGIQIECSQGHVFTRGTQRLIPQAGTVMRRLISDWSVTQMVSDLSQVTVHLMASPTEENADHCLDPLVTKTHLLSLSSLTYQRHSNRTAEEELSARDGDPTFHTHQLHLVDLRISWTTTNRDIAFGLYDGYKKAAVLKRNLSTEALKGLKIDPQMPAKKPKRGVPTSASAPPRVNTPSFSGQPDKGSSGGAYMLQKLIEETDRFVVFTEEESGMSDQLCGIAACQTDDIYNRNCLIELVNCQMVLRGAETEGCVIVSAAKAQLLQCQHHPAWYGDTLKQKTSWTCLLDGMQYFATTESSPTEQDGRQLWLEVKNIEEHRQRSLDSVQELMESGQAVGGMVTTTTDWNQPAEAQQAQQVQRIISRCNCRMYYISYSHDIDPELATQIKPPEVLENQEKEDLLKKQEGAVDTFTLIHHELEISTNPAQYAMILDIVNNLLLHVEPKRKEHSEKKQRVRFQLEISSNPEEQRSSILHLQEAVRQHVAQIRQLEKQMYSIMKSLQDDSKNENLLDLNQKLQLQLNQEKANLQLESEELNILIRCFKDFQLQRANKMELRKQQEDVSVVRRTEFYFAQARWRLTEEDGQLGIAELELQRFLYSKVNKSDDTAEHLLELGWFTMNNLLPNAVYKVVLRPQSSCQSGRQLALRLFSKVRPPVGGISVKEHFEVNVVPLTIQLTHQFFHRMMGFFFPGRSVEDDEVGDEEDKSKLVTTGIPVVKPRQLIATDDAVPLGPGKGVAQGLTRSSGVRRSFRKSPEHPVDDIDKMKERAAMNNSFIYIKIPQVPLCVSYKGEKNSVDWGDLNLVLPCLEYHNNTWTWLDFAMAVKRDSRKALVAQVIKEKLRLKSATGSEVRGKLETKSDLNMQQQEEEEKARLLIGLSVGDKNPGKKSIFGRRK

SEQ ID NO: 7440 - protein, 86 aa, Homo Sapiens
MPLFFSALLVLLLVALSALFLGRWLVVRLATKWCQRKLQAELKIGSFRFFWIQNVSLKFQQHQQTVTLCGIVLWRSAYQNGPTESF

SEQ ID NO: 7441 - protein, 2092 aa, Homo Sapiens
MVLKVDTSESLWHIQISRSRFLLDSDGKRLICEVSLCKINSKVLKSGQLEDTCLVELSLALDLCLKVGISSRHLTAITVDVWTLHAELHEGLFQSQLLCQGPSLASKPVPCSEVTENLVEPTLPGLFLLQQLPDQVKVKMENTSVVLSMNSQKRHLTWTLKLLQFLYHRDEDQLPLRSFTANSDMAQMSTELLLEDGLLLSQSRQRIVCLNSLKASVQVTTIDLSASLVLNTCIIHYRHQEFSHWLHLLALETQGSSSPVLKQRKKRTFPQILAPIIFSTSISNVNISIQLGDTPPFALGFNSISLDYQHLRPQSIHQRGVLTVDHLCWRVGSDSHIQRAPHPPNMHVWGEALVLDSFTLQGSYNQPLGLSSTQSDTLFLDCTIRGLQVEASDTCAQCLSRILSLMGPQSGKSAVSRHSSFGESVSLLWKVDLKVEDMNLFTLSALVGASEVRLDTLTILGSAETSTVGIQGLVLALVKSVTEKMQPCCKAPDIPTPVLSLSMLSITYHSSIRSLEVQCGAGLTLLWSPPDHMYLYQHVLATLQCRDLLRATVFPETVPSLALETSGTTSELEGRAPEPLPPKRLLNLTLEVSTAKLTAFVAEDKFITLAAESVSLSRHGGSLQAYCPELAAGFDGNSIFNFKEVEVQLLPELEEMILHRNPFPALQTLRNRVWLLSFGSVSVEFPYQYDFSRTLDEAVGVQKWLKGLHQGTRAWASPSPVPLPPDLLLKVEHFSWVFLDDVFEVKLHDNYELMKDESKESAKRLQLLDAKVAALRKQHGELLPARKIEELYASLERKNIEIYIQRSRRLYGNTPMRRALLTWSLAGLELVALADASFHGPEHVVEQVQELDPGSPFPPEGLDLVIQWCRMLKCNVKSFLVRIRDYPRYLFEIRDWRLMGRLVGTEQSGQPCSRRRQILHLGLPWGNVAVERNMPPLKFYHDFHSEIFQYTVVWGPCWDPAWTLIGQCVDLLTKPSADPSPPLPWWDKSRLLFHGDWHMDIEQANLHQLATEDPYNTTENMHWEWSHLSFHWKPGQFVFKGDLDINVRTASKYDDCCFLHLPDLCMTLDLQWLCHGNPHDHHSVTLRAPEFLPEVPLGQLHDSYRAFRSENLNLSIKMDLTRHSGTISQPRILLYSSTLRWMQNFWATWTSVTRPICRGKLFNNLKPSKKKLGQHYKQLSYTALFPQLQVHYWASFAQQRGIQIECSQGHVFTRGTQRLIPQAGTVMRRLISDWSVTQMVSDLSQVTVHLMASPTEENADHCLDPLVTKTHLLSLSSLTYQRHSNRTAEEELSARDGDPTFHTHQLHLVDLRISWTTTNRDIAFGLYDGYKKAAVLKRNLSTEALKGLKIDPQMPAKKPKRGVPTSASAPPRVNTPSFSGQPDKGSSGGAYMLQKLIEETDRFVVFTEEESGMSDQLCGIAACQTDDIYNRNCLIELVNCQMVLRGAETEGCVIVSAAKAQLLQCQHHPAWYGDTLKQKTSWTCLLDGMQYFATTESSPTEQDGRQLWLEVKNIEEHRQRSLDSVQELMESGQAVGGMVTTTTDWNQPAEAQQAQQVQRIISRCNCRMYYISYSHDIDPELATQIKPPEVLENQEKEDLLKKQEGAVDTFTLIHHELEISTNPAQYAMILDIVNNLLLHVEPKRKEHSEKKQRVRFQLEISSNPEEQRSSILHLQEAVRQHVAQIRQLEKQMYSIMKSLQDDSKNENLLDLNQKLQLQLNQEKANLQLESEELNILIRCFKDFQLQRANKMELRKQQEDVSVVRRTEFYFAQARWRLTEEDGQLGIAELELQRFLYSKVNKSDDTAEHLLELGWFTMNNLLPNAVYKAILRPQSSCQSGRQLALRLFSKVRPPVGGISVKEHFEVNVVPLTIQLTHQFFHRMMGFFFPGRSVEDDEVGDEEDKSKLVTTGIPVVKPRQLIATDDAVPLGPGKGVAQGLTRSSGVRRSFRKSPEHPVDDIDKMKERAAMNNSFIYIKIPQVPLCVSYKGEKNSVDWGDLNLVLPCLEYHNNTWTWLDFAMAVKRDSRKALVAQVIKEKLRLKSATGSEVRGKLETKSDLNMQQQEEEEKARLLIGLSVGDKNPGKKSIFGRRK

SEQ ID NO: 7442 - protein, 2092 aa, Homo Sapiens
MVLKVDTSESLWHIQISRSRFLLDSDGKRLICEVSLCKINSKVLKSGQLEDTCLVELSLALDLCLKVGISSRHLTAITVDVWTLHAELHEGLFQSQLLCQGPSLASKPVPCSEVTENLVEPTLPGLFLLQQLPDQVKVKMENTSVVLSMNSQKRHLTWTLKLLQFLYHRDEDQLPLRSFTANSDMAQMSTELLLEDGLLLSQSRQRIVCLNSLKASVQVTTIDLSASLVLNTCIIHYRHQEFSHWLHLLALETQGSSSPVLKQRKKRTFPQILAPIIFSTSISNVNISIQLGDTPPFALGFNSISLDYQHLRPQSIHQRGVLTVDHLCWRVGSDSHIQRAPHPPNMHVWGEALVLDSFTLQGSYNQPLGLSSTQSDTLFLDCTIRGLQVEASDTCAQCLSRILSLMGPQSGKSAVSRHSSFGESVSLLWKVDLKVEDMNLFTLSALVGASEVRLDTLTILGSAETSTVGIQGLVLALVKSVTEKMQPCCKAPDIPTPVLSLSMLSITYHSSIRSLEVQCGAGLTLLWSPPDHMYLYQHVLATLQCRDLLRATVFPETVPSLALETSGTTSELEGRAPEPLPPKRLLNLTLEVSTAKLTAFVAEDKFITLAAESVSLSRHGGSLQAYCPELAAGFDGNSIFNFKEVEVQLLPELEEMILHRNPFPALQTLRNRVWLLSFGSVSVEFPYQYDFSRTLDEAVGVQKWLKGLHQGTRAWASPSPVPLPPDLLLKVEHFSWVFLDDVFEVKLHDNYELMKDESKESAKRLQLLDAKVAALRKQHGELLPARKIEELYASLERKNIEIYIQRSRRLYGNTPMRRALLTWSLAGLELVALADASFHGPEHVVEQVQELDPGSPFPPEGLDLVIQWCRMLKCNVKSFLVRIRDYPRYLFEIRDWRLMGRLVGTEQSGQPCSRRRQILHLGLPWGNVAVERNMPPLKFYHDFHSEIFQYTVVWGPCWDPAWTLIGQCVDLLTKPSADPSPPLPWWDKSRLLFHGDWHMDIEQANLHQLATEDPYNTTENMHWEWSHLSFHWKPGQFVFKGDLDINVRTASKYDDCCFLHLPDLCMTLDLQWLCHGNPHDHHSVTLRAPEFLPEVPLGQLHDSYRAFRSENLNLSIKMDLTRHSGTISQPRILLYSSTLRWMQNFWATWTSVTRPICRGKLFNNLKPSKKKLGQHYKQLSYTALFPQLQVHYWASFAQQRGIQIECSQGHVFTRGTQRLIPQAGTVMRRLISDWSVTQMVSDLSQVTVHLMASPTEENADHCLDPLVTKTHLLSLSSLTYQRHSNRTAEEELSARDGDPTFHTHQLHLVDLRISWTTTNRDIAFGLYDGYKKAAVLKRNLSTEALKGLKIDPQMPAKKPKRGVPTSASAPPRVNTPSFSGQPDKGSSGGAYMLQKLIEETDRFVVFTEEESGMSDQLCGIAACQTDDIYNRNCLIELVNCQMVLRGAETEGCVIVSAAKAQLLQCQHHPAWYGDTLKQKTSWTCLLDGMQYFATTESSPTEQDGRQLWLEVKNIEEHRQRSLDSVQELMESGQAVGGMVTTTTDWNQPAEAQQAQQVQRIISRCNCRMYYISYSHDIDPELATQIKPPEVLENQEKEDLLKKQEGAVDTFTLIHHELEISTNPAQYAMILDIVNNLLLHVEPKRKEHSEKKQRVRFQLEISSNPEEQRSSILHLQEAVRQHVAQIRQLEKQMYSIMKSLQDDSKNENLLDLNQKLQLQLNQEKANLQLESEELNILIRCFKDFQLQRANKMELRKQQEDVSVVRRTEFYFAQARWRLTEEDGQLGIAELELQRFLYSKVNKSDDTAEHLLELGWFTMNNLLPNAVYKVVLRPQSSCQSGRQLALRLFSKVRPPVGGISVKEHFEVNVVPLTIQLTHQFFHRMMGFFFPGRSVEDDEVGDEEDKSKLVTTGIPVVKPRQLIATDDAVPLGPGKGVAQGLTRSSGVRRSFRKSPEHPVDDIDKMKERAAMNNSFIYIKIPQVPLCVSYKGEKNSVDWGDLNLVLPCLEYHNNTWTWLDFAMAVKRDSRKALVAQVIKEKLRLKSATGSEVRGKLETKSDLNMQQQEEEEKARLLIGLSVGDKNPGKKSIFGRRK

SEQ ID NO: 7443 - protein, 21 aa, Homo Sapiens
  misc_feature (1)..(1): Xaa can be any naturally occurring amino acid
XQGPSLASKPVPCSAARPGQG

SEQ ID NO: 7444 - protein, 1072 aa, Homo Sapiens
MAPPTGVLSSLLLLVTIAGCARKQCSEGRTYSNAVISPNLETTRIMRVSHTFPVVDCTAACCDLSSCDLAWWFEGRCYLVSCPHKENCEPKKMGPIRSYLTFVLRPVQRPAQLLDYGDMMLNRGSPSGIWGDSPEDIRKDLTFLGKDWGLEEMSEYSDDYRELEKDLLQPSGKQEPRGSAEYTDWGLLPGSEGAFNSSVGDSPAVPAETQQDPELHYLNESASTPAPKLPERSVLLPLPTTPSSGEVLEKEKASQLQEQSSNSSGKEVLMPSHSLPPASLELSSVTVEKSPVLTVTPGSTEHSIPTPPTSAAPSESTPSELPISPTTAPRTVKELTVSAGDNLIITLPDNEVELKAFVAPAPPVETTYNYEWNLISHPTDYQGEIKQGHKQTLNLSQLSVGLYVFKVTVSSENAFGEGFVNVTVKPARRVNLPPVAVVSPQLQELTLPLTSALIDGSQSTDDTEIVSYHWEEINGPFIEEKTSVDSPVLRLSNLDPGNYSFRLTVTDSDGATNSTTAALIVNNAVDYPPVANAGPNHTITLPQNSITLNGNQSSDDHQIVLYEWSLGPGSEGKHVVMQGVQTPYLHLSAMQEGDYTFQLKVTDSSRQQSTAVVTVIVQPENNRPPVAVAGPDKELIFPVESATLDGSSSSDDHGIVFYHWEHVRGPSAVEMENIDKAIATVTGLQVGTYHFRLTVKDQQGLSSTSTLTVAVKKENNSPPRARAGGRHVLVLPNNSITLDGSRSTDDQRIVSYLWIRDGQSPAAGDVIDGSDHSVALQLTNLVEGVYTFHLRVTDSQGASDTDTATVEVQPDPRKSGLVELTLQVGVGQLTEQRKDTLVRQLAVLLNVLDSDIKVQKIRAHSDLSTVIVFYVQSRPPFKVLKAAEVARNLHMRLSKEKADFLLFKVLRVDTAGCLLKCSGHGHCDPLTKRCICSHLWMENLIQRYIWDGESNCEWSIFYVTVLAFTLIVLTGGFTWLCICCCKRQKRTKIRKKTKYTILDNMDEQERMELRPKYGIKHRSTEHNSSLMVSESEFDSDQDTIFSREKMERGNPKVSMNGSIRNGASFSYCSKDR

SEQ ID NO: 7445 - protein, 1011 aa, Homo Sapiens
MAPPTGVLSSLLLLVTIAGCARKQCSEGRTYSNAVISPNLETTRIMRVSHTFPVVDCTAACCDLSSCDLAWWFEGRCYLVSCPHKENCEPKKMGPIRSYLTFVLRPVQRPAQLLDYGDMMLNRGSPSGIWGDSPEDIRKDLTFLGKDWGLEEMSEYSDDYRELEKDLLQPSGKQEPRGSAEYTDWGLLPGSEGAFNSSVGDSPAVPAETQQDPELHYLNESASTPAPKLPERSVLLPLPTTPSSGEVLEKEKASQLQEQSSNSSGKEVLMPSHSLPPASLELSSVTVEKSPVLTVTPGSTEHSIPTPPTSAAPSESTPSELPISPTTAPRTVKELTVSAGDNLIITLPDNEVELKAFVAPAPPVETTYNYEWNLISHPTDYQGEIKQGHKQTLNLSQLSVGLYVFKVTVSSENAFGEGFVNVTVKPARRVNLPPVAVVSPQLQELTLPLTSALIDGSQSTDDTEIVSYHWEEINGPFIEEKTSVDSPVLRLSNLDPGNYSFRLTVTDSDGATNSTTAALIVNNAVDYPPVANAGPNHTITLPQNSITLNGNQSSDDHQIVLYEWSLGPGSEGKHVVMQGVQTPYLHLSAMQEGDYTFQLKVTDSSRQQSTAVVTVIVQPENNRPPVAVAGPDKELIFPVESATLDGSSSSDDHGIVFYHWEHVRGPSAVEMENIDKAIATVTGLQVGTYHFRLTVKDQQGLSSTSTLTVAVKKENNSPPRARAGGRHVLVLPNNSITLDGSRSTDDQRIVSYLWIRDGQSPAAGDVIDGSDHSVALQLTNLVEGVYTFHLRVTDSQGASDTDTATVEVQPDPRKSGLVELTLQVGVGQLTEQRKDTLVRQLAVLLNVLDSDIKVQKIRAHSDLSTVIVFYVQSRPPFKVLKAAEVARNLHMRLSKEKADFLLFKVLRVDTAGCLLKCSGHGHCDPLTKRCICSHLWMENLIQRYIWDGESNCGIKHRSTEHNSSLMVSESEFDSDQDTIFSREKMERGNPKVSMNGSIRNGASFSYCSKDR

SEQ ID NO: 7446 - protein, 1072 aa, Homo Sapiens; identical to SEQ ID NO: 7444

SEQ ID NO: 7447 - protein, 483 aa, Homo Sapiens
MQEGDYTFQLKVTDSSRQQSTAVVTVIVQPENNRPPVAVAGPDKELIFPVESATLDGSSSSDDHGIVFYHWEHVRGPSAVEMENIDKAIATVTGLQVGTYHFRLTVKDQQGLSSTSTLTVAVKKENNSPPRARAGGRHVLVLPNNSITLDGSRSTDDQRIVSYLWIRDGQSPAAGDVIDGSDHSVALQLTNLVEGVYTFHLRVTDSQGASDTDTATVEVQPDPRKSGLVELTLQVGVGQLTEQRKDTLVRQLAVLLNVLDSDIKVQKIRAHSDLSTVIVFYVQSRPPFKVLKAAEVARNLHMRLSKEKADFLLFKVLRVDTAGCLLKCSGHGHCDPLTKRCICSHLWMENLIQRYIWDGESNCEWSIFYVTVLAFTLIVLTGGFTWLCICCCKRQKRTKIRKKTKYTILDNMDEQERMELRPKYGIKHRSTEHNSSLMVSESEFDSDQDTIFSREKMERGNPKVSMNGSIRNGASFSYCSKDR

SEQ ID NO: 7448 - protein, 1027 aa, Homo Sapiens
MRVSHTFPVVDCTAACCDLSSCDLAWWFEGRCYLVSCPHKENCEPKKMGPIRSYLTFVLRPVQRPAQLLDYGDMMLNRGSPSGIWGDSPEDIRKDLTFLGKDWGLEEMSEYSDDYRELEKDLLQPSGKQEPRGSAEYTDWGLLPGSEGAFNSSVGDSPAVPAETQQDPELHYLNESASTPAPKLPERSVLLPLPTTPSSGEVLEKEKASQLQEQSSNSSGKEVLMPSHSLPPASLELSSVTVEKSPVLTVTPGSTEHSIPTPPTSAAPSESTPSELPISPTTAPRTVKELTVSAGDNLIITLPDNEVELKAFVAPAPPVETTYNYEWNLISHPTDYQGEIKQGHKQTLNLSQLSVGLYVFKVTVSSENAFGEGFVNVTVKPARRVNLPPVAVVSPQLQELTLPLTSALIDGSQSTDDTEIVSYHWEEINGPFIEEKTSVDSPVLRLSNLDPGNYSFRLTVTDSDGATNSTTAALIVNNAVDYPPVANAGPNHTITLPQNSITLNGNQSSDDHQIVLYEWSLGPGSEGKHVVMQGVQTPYLHLSAMQEGDYTFQLKVTDSSRQQSTAVVTVIVQPENNRPPVAVAGPDKELIFPVESATLDGSSSSDDHGIVFYHWEHVRGPSAVEMENIDKAIATVTGLQVGTYHFRLTVKDQQGLSSTSTLTVAVKKENNSPPRARAGGRHVLVLPNNSITLDGSRSTDDQRIVSYLWIRDGQSPAAGDVIDGSDHSVALQLTNLVEGVYTFHLRVTDSQGASDTDTATVEVQPDPRKSGLVELTLQVGVGQLTEQRKDTLVRQLAVLLNVLDSDIKVQKIRAHSDLSTVIVFYVQSRPPFKVLKAAEVARNLHMRLSKEKADFLLFKVLRVDTAGCLLKCSGHGHCDPLTKRCICSHLWMENLIQRYIWDGESNCEWSIFYVTVLAFTLIVLTGGFTWLCICCCKRQKRTKIRKKTKYTILDNMDEQERMELRPKYGIKHRSTEHNSSLMVSESEFDSDQDTIFSREKMERGNPKVSMNGSIRNGASFSYCSKDR

SEQ ID NO: 7449 - protein, 1063 aa, Homo Sapiens
MTRLGWPSPCCARKQCSEGRTYSNAVISPNLETTRIMRVSHTFPVVDCTAACCDLSSCDLAWWFEGRCYLVSCPHKENCEPKKMGPIRSYLTFVLRPVQRPAQLLDYGDMMLNRGSPSGIWGDSPEDIRKDLTFLGKDWGLEEMSEYSDDYRELEKDLLQPSGKQEPRGSAEYTDWGLLPGSEGAFNSSVGDSPAVPAETQQDPELHYLNESASTPAPKLPERSVLLPLPTTPSSGEVLEKEKASQLQEQSSNSSGKEVLMPSHSLPPASLELSSVTVEKSPVLTVTPGSTEHSIPTPPTSAAPSESTPSELPISPTTAPRTVKELTVSAGDNLIITLPDNEVELKAFVAPAPPVETTYNYEWNLISHPTDYQGEIKQGHKQTLNLSQLSVGLYVFKVTVSSENAFGEGFVNVTVKPARRVNLPPVAVVSPQLQELTLPLTSALIDGSQSTDDTEIVSYHWEEINGPFIEEKTSVDSPVLRLSNLDPGNYSFRLTVTDSDGATNSTTAALIVNNAVDYPPVANAGPNHTITLPQNSITLNGNQSSDDHQIVLYEWSLGPGSEGKHVVMQGVQTPYLHLSAMQEGDYTFQLKVTDSSRQQSTAVVTVIVQPENNRPPVAVAGPDKELIFPVESATLDGSSSSDDHGIVFYHWEHVRGPSAVEMENIDKAIATVTGLQVGTYHFRLTVKDQQGLSSTSTLTVAVKKENNSPPRARAGGRHVLVLPNNSITLDGSRSTDDQRIVSYLWIRDGQSPAAGDVIDGSDHSVALQLTNLVEGVYTFHLRVTDSQGASDTDTATVEVQPDPRKSGLVELTLQVGVGQLTEQRKDTLVRQLAVLLNVLDSDIKVQKIRAHSDLSTVIVFYVQSRPPFKVLKAAEVARNLHMRLSKEKADFLLFKVLRVDTAGCLLKCSGHGHCDPLTKRCICSHLWMENLIQRYIWDGESNCEWSIFYVTVLAFTLIVLTGGFTWLCICCCKRQKRTKIRKKTKYTILDNMDEQERMELRPKYGIKHRSTEHNSSLMVSESEFDSDQDTIFSREKMERGNPKVSMNGSIRNGASFSYCSKDR

SEQ ID NO: 7450 - protein, 82 aa, Homo Sapiens
ILLTVLTCYFWKKNQKLEYKYSKLVMNATLKDCDLPAADSCAIMEGEDVEDDLIFTSKKSLFGKIKSFTSKVSGSSPLGAES

SEQ ID NO: 7451 - protein, 62 aa, Homo Sapiens
MAEPGHSHHLSARVRGRTERRIPRLWRLLLWAGTAFQVTQGTGPELHACKEPSPATPGSFWI

SEQ ID NO: 7452 - protein, 91 aa, Homo Sapiens
MAEPGHSHHLSARVRGRTERRIPRLWRLLLWAGTAFQVTQGTGPELHACKESEYHYEYTACDSTGSRWRVAVPHTPGLCTSLPDPIKGTEC

SEQ ID NO: 7453 - protein, 152 aa, Homo Sapiens
MAEPGHSHHLSARVRGRTERRIPRLWRLLLWAGTAFQVTQGTGPELHACKESEYHYEYTACDSTGSRWRVAVPHTPGLCTSLPDPIKGTECSFSCNAGEFLDMKDQSCKPCAEGRYSLGTGIRFDEWDELPHGFASLSANMELDDSAAESTG

SEQ ID NO: 7454 - protein, 156 aa, Homo Sapiens
MAEPGHSHHLSARVRGRTERRIPRLWRLLLWAGTAFQVTQGTGPELHACKESEYHYEYTACDSTGSRWRVAVPHTPGLCTSLPDPIKGTECSFSCNAGEFLDMKDQSCKPCAEGRYSLGTGIRFDEWDELPHGFASLSANMELDDSAAESTGNCTS

SEQ ID NO: 7455 - protein, 205 aa, Homo Sapiens
MAEPGHSHHLSARVRGRTERRIPRLWRLLLWAGTAFQVTQGTGPELHACKESEYHYEYTACDSTGSRWRVAVPHTPGLCTSLPDPIKGTECSFSCNAGEFLDMKDQSCKPCAEGRYSLGTGIRFDEWDELPHGFASLSANMELDDSAAESTGNCTSSKWVPRGDYIASNTDECTATLMYAVNLKQSGTVNFEYYYPDSSIIFEFF

SEQ ID NO: 7456 - protein, 1013 aa, Homo Sapiens
MAEPGHSHHLSARVRGRTERRIPRLWRLLLWAGTAFQVTQGTGPELHACKESEYHYEYTACDSTGSRWRVAVPHTPGLCTSLPDPIKGTECSFSCNAGEFLDMKDQSCKPCAEGRYSLGTGIRFDEWDELPHGFASLSANMELDDSAAESTGNCTSSKWVPRGDYIASNTDECTATLMYAVNLKQSGTVNFEYYYPDSSIIFEFFVQNDQCQPNADDSRWMKTTEKGWEFHSVELNRGNNVLYWRTTAFSVWTKVPKPVLVRNIAITGVAYTSECFPCKPGTYADKQGSSFCKLCPANSYSNKGETSCHQCDPDKYSEKGSSSCNVRPACTDKDYFYTHTACDANGETQLMYKWAKPKICSEDLEGAVKLPASGVKTHCPPCNPGFFKTNNSTCQPCPYGSYSNGSDCTRCPAGTEPAVGFEYKWWNTLPTNMETTVLSGINFEYKGMTGWEVAGDHIYTAAGASDNDFMILTLVVPGFRPPQSVMADTENKEVARITFVFETLCSVNCELYFMVGVNSRTNTPVETWKGSKGKQSYTYIIEENTTTSFTWAFQRTTFHEASRKYTNDVAKIYSINVTNVMNGVASYCRPCALEASDVGSSCTSCPAGYYIDRDSGTCHSCPTNTILKAHQPYGVQACVPCGPGTKNNKIHSLCYNDCTFSRNTPTRTFNYNFSALANTVTLAGGPSFTSKGLKYFHHFTLSLCGNQGRKMSVCTDNVTDLRIPEGESGFSKSITAYVCQAVIIPPEVTGYKAGVSSQPVSLADRLIGVTTDMTLDGITSPAELFHLESLGIPDVIFFYRSNDVTQSCSSGRSTTIRVRCSPQKTVPGSLLLPGTCSDGTCDGCNFHFLWESAAACPLCSVADYHAIVSSCVAGIQKTTYVWREPKLCSGGISLPEQRVTICKTIDFWLKVGISAGTCTAILLTVLTCYFWKKNQKLEYKYSKLVMNATLKDCDLPAADSCAIMEGEDVEDDLIFTSKKSLFGKIKSFTSKRTPDGFDSVPLKTSSGGLDMDL

SEQ ID NO: 7457 - protein, 901 aa, Homo Sapiens
MAEPGHSHHLSARVRGRTERRIPRLWRLLLWAGTAFQVTQGTGPELHACKESEYHYEYTACDSTGSRWRVAVPHTPGLCTSLPDPIKGTECSFSCNAGEFLDMKDQSCKPCAEGRYSLGTGIRFDEWDELPHGFASLSANMELDDSAAESTGNCTSSKWVPRGDYIASNTDECTATLMYAVNLKQSGTVNFEYYYPDSSIIFEFFVQNDQCQPNADDSRWMKTTEKGWEFHSVELNRGNNVLYWRTTAFSVWTKVPKPVLVRNIAITEKGSSSCNVRPACTDKDYFYTHTACDANGETQLMYKWAKPKICSEDLEGAVKLPASGVKTHCPPCNPGFFKTNNSTCQPCPYGSYSNGSDCTRCPAGTEPAVGFEYKWWNTLPTNMETTVLSGINFEYKGMTGWEVAGDHIYTAAGASDNDFMILTLVVPGFRPPQSVMADTENKEVARITFVFETLCSVNCELYFMVGVNSRTNTPVETWKGSKGKQSYTYIIEENTTTSFTWAFQRTTFHEASRKYTNDVAKIYSINVTNVMNGVASYCRPCALEASDVGSSCTSCPAGYYIDRDSGTCHSCPTNTILKAHQPYGVQACVPCGPGTKNNKIHSLCYNDCTFSRNTPTRTFNYNFSALANTVTLAGGPSFTSKGLKYFHHFTLSLCGNQGRKMSVCTDNVTDLRIPEGESGFSKSITAYVCQAVIIPPEVTGYKAGVSSQPVSLADRLIGVTTDMTLDGITSPAELFHLESLGIPDVIFFYRSNDVTQSCSSGRSTTIRVRCSPQKTVPGSLLLPGTCSDGTCDGCNFHFLWESAAACPLCSVADYHAIVSSCVAGIQKTTYVWREPKLCSGGISLPEQRVTICKTIDFWLKVGISAGTCTAILLTVLTCYFWKKNQKLEYKYSKLVMNATLK

SEQ ID NO: 7458 - protein, 926 aa, Homo Sapiens
MAEPGHSHHLSARVRGRTERRIPRLWRLLLWAGTAFQVTQGTGPELHACKESEYHYEYTACDSTGSRWRVAVPHTPGLCTSLPDPIKGTECSFSCNAGEFLDMKDQSCKPCAEGRYSLGTGIRFDEWDELPHGFASLSANMELDDSAAESTGNCTSSKWVPRGDYIASNTDECTATLMYAVNLKQSGTVNFEYYYPDSSIIFEFFVQNDQCQPNADDSRWMKTTEKGWEFHSVELNRGNNVLYWRTTAFSVWTKVPKPVLTQLMYKWAKPKICSEDLEGAVKLPASGVKTHCPPCNPGFFKTNNSTCQPCPYGSYSNGSDCTRCPAGTEPAVGFEYKWWNTLPTNMETTVLSGINFEYKGMTGWEVAGDHIYTAAGASDNDFMILTLVVPGFRPPQSVMADTENKEVARITFVFETLCSVNCELYFMVGVNSRTNTPVETWKGSKGKQSYTYIIEENTTTSFTWAFQRTTFHEASRKYTNDVAKIYSINVTNVMNGVASYCRPCALEASDVGSSCTSCPAGYYIDRDSGTCHSCPTNTILKAHQPYGVQACVPCGPGTKNNKIHSLCYNDCTFSRNTPTRTFNYNFSALANTVTLAGGPSFTSKGLKYFHHFTLSLCGNQGRKMSVCTDNVTDLRIPEGESGFSKSITAYVCQAVIIPPEVTGYKAGVSSQPVSLADRLIGVTTDMTLDGITSPAELFHLESLGIPDVIFFYRSNDVTQSCSSGRSTTIRVRCSPQKTVPGSLLLPGTCSDGTCDGCNFHFLWESAAACPLCSVADYHAIVSSCVAGIQKTTYVWREPKLCSGGISLPEQRVTICKTIDFWLKVGISAGTCTAILLTVLTCYFWKKNQKLEYKYSKLVMNATLKDCDLPAADSCAIMEGEDVEDDLIFTSKKSLFGKIKSFTSKRTPDGFDSVPLKTSSGGLDMDL

SEQ ID NO: 7459 - protein, 838 aa, Homo Sapiens
MYAFYSLLIYIFYSLFRRDGGAAAAAEPGDPAQRARKPRGRRRPDLPAPELWTELTGLAASSEPEDGSEGAAEGRAAAVSLEEALLRLAEFLSVQLGAEESCGGPADLGQSGEVPSLLTVTSQLLALLAWLRSPRGRQALLQGTQPAPRVRPPSPDGSTSQEESPSHFTAVPGEPLGDETQGQQPLQLEEDQRAWQRLEQLILGQLEELKQQLEQQEEELGRLRLGVGATDSEKRVQHLTLENEALKQSLSLMRDLLLHWGPGPPIRAPQEEAEALLELQGRLQEAQDTTEALRAQLGVQEVQLQGLQGALQQLQQETEQNCRRELQQMHGQLAGLRARMASLRQGCGDLRGLVSTFTQSCQGSLSEARGQVSWALGALSSGGPGTQLPEGQQGPPAGCPGRLPELKGNIRVLCRLRPGTSSSLVSVEPGPGGTVTTCYRGRHRRFRLDWVFPPDASQEEVFRELEPAVLSCLRGYSVCIFTYGQTGTGKTYSMEGPPEDPGIVPRALQSLFREMGAGRQHRVTLSMVEIYNEAVRDLLAPGPPERLAVRQGPEGQGGIQVAGLTHWDVPNLETLHQMLKLGRSNRATAATAMNQRSSRSHALVTLTLRAASPPRAPGTAGTLHLVDLAGSERARKAGAAGPPRGDPDGARRLREAQTINRSLLALGGVMAALRAHRPHVPFRDSQLTRLLQPALGPGTTAVLLLQVGAGAGQVCACRSPPTRARPPAPLARRSPRGRRISGRQSAPSSSPTEWVKWSWGQPGAAGSRAPPGRLLPSAPTLRSPGPPAPLRRPLAVLHAPVPTTARARLSRPQRACPSSPGSRPCPWGLRPGLCWQRR

SEQ ID NO: 7460 - protein, 744 aa, Homo Sapiens
MYAFYSLLIYIFYSLFRRDGGAAAAAEPGDPAQRARKPRGRRRPDLPAPELWTELTGLAASSEPEDGSEGAAEGRAAAVSLEEALLRLAEFLSVQLGAEESCGGPADLGQSGEVPSLLTVTSQLLALLAWLRSPRGRQALLQGTQPAPRVRPPSPDGSTSQEESPSHFTAVPGEPLGDETQGQQPLQLEEDQRAWQRLEQLILGQLEELKQQLEQQEEELGRLRLGVGATDSEKRVQHLTLENEALKQSLSLMRDLLLHWGPGPPIRAPQEEAEALLELQGRLQEAQDTTEALRAQLQQETEQNCRRELQQMHGQLAGLRARMASLRQGCGDLRGLVSTFTQSCQGSLSEARGQVSWALGALSSGGPGTQLPEGQQGPPAGCPGRLPELKGNIRVLCRLRPGTSSSLVSVEPGPGGTVTTCYRGRHRRFRLDWVFPPDASQEEVFRELEPAVLSCLRGYSVCIFTYGQTGTGKTYSMEGPPEDPGIVPRALQSLFREMGAGRQHRVTLSMVEIYNEAVRDLLAPGPPERLAVRQGPEGQGGIQVAGLTHWDVPNLETLHQMLKLGRSNRATAATAMNQRSSRSHALVTLTLRAASPPRAPGTAGTLHLVDLAGSERARKAGAAGPPRGDPDGARRLREAQTINRSLLALGGVMAALRAHRPHVPFRDSQLTRLLQPALGPGTTAVLLLQISTRPEDLGETVCSLKFADRVGQVELGPARRRRVPRSSGTPSSLSTDTPLTGTPC

SEQ ID NO: 7461 - protein, 791 aa, Homo Sapiens
MYAFYSLLIYIFYSLFRRDGGAAAAAEPGDPAQRARKPRGRRRPDLPAPELWTELTGLAASSEPEDGSEGAAEGRAAAVSLEEALLRLAEFLSVQLGAEESCGGPADLGQSGEVPSLLTVTSQLLALLAWLRSPRGRQALLQGTQPAPRVRPPSPDGSTSQEESPSHFTAVPGEPLGDETQGQQPLQLEEDQRAWQRLEQLILGQLEELKQQLEQQEEELGRLRLGVGATDSEKRVQHLTLENEALKQSLSLMRDLLLHWGPGPPIRAPQEEAEALLELQGRLQEAQDTTEALRAQLGVQEVQLQGLQGALQQLQQETEQNCRRELQQMHGQLAGLRARMASLRQGCGDLRGLVSTFTQSCQGSLSEARGQVSWALGALSSGGPGTQLPEGQQGPPAGCPGRLPELKGNIRVLCRLRPGTSSSLVSVEPGPGGTVTTCYRGRHRRFRLDWVFPPDASQEEVFRELEPAVLSCLRGYSVCIFTYGQTGTGKTYSMEGPPEDPGIVPRALQSLFREMGAGRQHRVTLSMVEIYNEAVRDLLAPGPPERLAVRQGPEGQGGIQVAGLTHWDVPNLETLHQMLKLGRSNRATAATAMNQRSSRSHALVTLTLRAASPPRAPGTAGTLHLVDLAGSERARKAGAAGPPRGDPDGARRLREAQTINRSLLALGGVMAALRAHRPHVPFRDSQLTRLLQPALGPGTTAVLLLQISTRPEDLGETVCSLKFADRVGQVELGPARRRRVPRSSGTPSSLSTDTPLTGTPCTPTPSPGSPPCPSPDNGSGSALAPAEGLPL

SEQ ID NO: 7462 - protein, 325 aa, Homo Sapiens
MSMSPTVIILACLGFFLDQSVWAHVGGQDKPFCSAWPSAVVPQGGHVTLRCHYRRGFNIFTLYKKDGVPVPELYNRIFWNSFLISPVTPAHAGTYRCRGFHPHSPTEWSAPSNPLVIMVTGLYEKPSLTARPGPTVRAGENVTLSCSSQSSFDIYHLSREGEAHELRLPAVPSINGTFQADFPLGPATHGETYRCFGSFHGSPYEWSDPSDPLPVSVTDAAVMNQEPAGHRTVNREDSDEQDPQEVTYAQLDHCIFTQRKITGPSQRSKRPSTDTSVCIELPNAEPRALSPAHEHHSQALMGSSRETTALSQTQLASSNVPAAGI

SEQ ID NO: 7463 - protein, 342 aa, Homo Sapiens
MSMSPTVIILACLGFFLDQSVWAHVGGQDKPFCSAWPSAVVPQGGHVTLRCHYRRGFNIFTLYKKDGVPVPELYNRIFWNSFLISPVTPAHAGTYRCRGFHPHSPTEWSAPSNPLVIMVTGLYEKPSLTARPGPTVRAGENVTLSCSSQSSFDIYHLSREGEAHELRLPAVPSINGTFQADFPLGPATHGETYRCFGSFHGSPYEWSDPSDPLPVSVTGNPSSSWPSPTEPSFKTDAAVMNQEPAGHRTVNREDSDEQDPQEVTYAQLDHCIFTQRKITGPSQRSKRPSTDTSVCIELPNAEPRALSPAHEHHSQALMGSSRETTALSQTQLASSNVPAAGI

SEQ ID NO: 7464 - protein, 273 aa, Homo Sapiens
MSMSPTVIILACLGFFLDQSVWAHVGGQDKPFCSAWPSAVVPQGGHVTLRCHYRRGFNIFTLYKKDGVPVPELYNRIFWNSFLISPVTPAHAGTYRCRGFHPHSPTEWSAPSNPLVIMVTGLYEKPSLTARPGPTVRAGENVTLSCSSQSSFDIYHLSREGEAHELRLPAVPSINGTFQADFPLGPATHGETYRCFGSFHGSPYEWSDPSDPLPVSVTGNPSSSWPSPTEPSFKTGIARHLHAVIRYSVAIILFTILPFFLLHRWCSKKKMLL

SEQ ID NO: 7465 - protein, 230 aa, Homo Sapiens
MSMSPTVIILACLGFFLDQSVWAHVGLYEKPSLTARPGPTVRAGENVTLSCSSQSSFDIYHLSREGEAHELRLPAVPSINGTFQADFPLGPATHGETYRCFGSFHGSPYEWSDPSDPLPVSVTDAAVMNQEPAGHRTVNREDSDEQDPQEVTYAQLDHCIFTQRKITGPSQRSKRPSTDTSVCIELPNAEPRALSPAHEHHSQALMGSSRETTALSQTQLASSNVPAAGI

SEQ ID NO: 7466 - protein, 247 aa, Homo Sapiens
MSMSPTVIILACLGFFLDQSVWAHVGLYEKPSLTARPGPTVRAGENVTLSCSSQSSFDIYHLSREGEAHELRLPAVPSINGTFQADFPLGPATHGETYRCFGSFHGSPYEWSDPSDPLPVSVTGNPSSSWPSPTEPSFKTDAAVMNQEPAGHRTVNREDSDEQDPQEVTYAQLDHCIFTQRKITGPSQRSKRPSTDTSVCIELPNAEPRALSPAHEHHSQALMGSSRETTALSQTQLASSNVPAAGI

SEQ ID NO: 7467 - protein, 416 aa, Homo Sapiens
MSPSHVVVNVSTARSGPLTTSSAPVSRAESLRPGSRSCTMSMSPTVIILACLGFFLDQSVWAHVGGQDKPFCSAWPSAVVPQGGHVTLRCHYRRGFNIFTLYKKDGVPVPELYNRIFWNSFLISPVTPAHAGTYRCRGFHPHSPTEWSAPSNPLVIMVTGLYEKPSLTARPGPTVRAGENVTLSCSSQSSFDIYHLSREGEAHELRLPAVPSINGTFQADFPLGPATHGETYRCFGSFHGSPYEWSDPSDPLPVSVTGNPSSSWPSPTEPSFKTGIARHLHAVIRYSVAIILFTILPFFLLHRWCSKKKDAAVMNQEPAGHRTVNREDSDEQDPQEVTYAQLDHCIFTQRKITGPSQRSKRPSTDTSVCIELPNAEPRALSPAHEHHSQALMGSSRETTALSQTQLASSNVPAAGI

SEQ ID NO: 7468 - protein, 398 aa, Homo Sapiens
  misc_feature (1)..(1): Xaa can be any naturally occurring amino acid
XMSPTVIILACLGFFLDQSVWAHVGGQDKPFCSAWPSAVVPQGGHVTLRCHYRRGFNIFTLYKKDGVPVPELYNRIFWNSFLISPVTPAHAGTYRCRGFHPHSPTEWSAPSNPLVIMVTGLYEKPSLTARPGPTVRAGENVTLSCSSQSSFDIYHLSREGEAHELRLPAVPSINGTFQADFPLGPATHGETYRCFGSFHGSPYEWSDPSDPLPVSVTGNPSSSWPSPTEPSFKTGIARHLHAVIRYSVAIILFTILPFFLLHRWCSKKKVSLTKQRPENSGPCAEAGWEHADAAVMNQEPAGHRTVNREDSDEQDPQEVTYAQLDHCIFTQRKITGPSQRSKRPSTDTSVCIELPNAEPRALSPAHEHHSQALMGSSRETTALSQTQLASSNVPAAGI

SEQ ID NO: 7469 - protein, 139 aa, Homo Sapiens
MAPKLITVLCLGFCLNQKICPHAGAQDKFSLSAWPSPVVPLGGRVTLSCHSHLRFVIWTIFQTTGTRSHELHTGLSNNITISPVTPEHAGTYRCVGIYKHASKWSAESNSLKIIVTAFSLHPGGPHDEAGREVDPLLQL

SEQ ID NO: 7470 - protein, 133 aa, Homo Sapiens
MAPKLITVLCLGFCLNQKICPHAGAQDKFSLSAWPSPVVPLGGRVTLSCHSHLRFVIWTIFQTTGTRSHELHTGLSNNITISPVTPEHAGTYRCVGIYKHASKWSAESNSLKIIVTGGPHDEAGREVDPLLQL

SEQ ID NO: 7471 - protein, 133 aa, Homo Sapiens; identical to SEQ ID NO: 7470

SEQ ID NO: 7472 - protein, 352 aa, Homo Sapiens
MAPKLITVLCLGFCLNQKICPHAGAQDKFSLSAWPSPVVPLGGRVTLSCHSHLRFVIWTIFQTTGTRSHELHTGLSNNITISPVTPEHAGTYRCVGIYKHASKWSAESNSLKIIVTGLFTKPSISAHPSSLVHAGARVSLRCHSELAFDEFILYKEGHIQHSQQLDQGMEAGIHYVEAVFSMGPVTPAHAGAYRCCGCFSHSRYEWSAPSDPLDIVITGKYKKPSLSTQVDPMMRLGEKLTLFCSSEISFDQYHLFRHGVAHGQWLSGGQRHREAFQANFSVGRATPVPGGTYRCYGSFNDSPYKPPVTRCNFTPQETLRVLLCHSQNPPLNLTHLALKDSPATCICSLDSQ

SEQ ID NO: 7473 - protein, 365 aa, Homo Sapiens
MAPKLITVLCLGFCLNQKICPHAGAQDKFSLSAWPSPVVPLGGRVTLSCHSHLRFVIWTIFQTTGTRSHELHTGLSNNITISPVTPEHAGTYRCVGIYKHASKWSAESNSLKIIVTGLFTKPSISAHPSSLVHAGARVSLRCHSELAFDEFILYKEGHIQHSQQLDQGMEAGIHYVEAVFSMGPVTPAHAGAYRCCGCFSHSRYEWSAPSDPLDIVITGKYKKPSLSTQVDPMMRLGEKLTLFCSSEISFDQYHLFRHGVAHGQWLSGGQRHREAFQANFSVGRATPVPGGTYRCYGSFNDSPYKPPVTRCNFTPQETLRVLLCHSQNPPLNLTPPWQTQSPRKANGRMKRSLQQKRHRRSYMPS

SEQ ID NO: 7474 - protein, 191 aa, Homo Sapiens
MLRMRVPALLVLLFCFRGRAGPSPHFLQQPEDLVVLLGEEARLPCALGAYWGLVQWTKSGLALGGQRDLPGWSRYWISGNAANGQHDLHIRPVELEDEASYECQATQAGLRSRPAQLHVLVPPEAPQVLGGPSVSLVAGVPANLTCRSRGDARPTPELLWFRDGVLLDGATFHQTLLKEGTPGSVESTLTL

SEQ ID NO: 7475 - protein, 633 aa, Homo Sapiens
MLRMRVPALLVLLFCFRGRAGPSPHFLQQPEDLVVLLGEEARLPCALGAYWGLVQWTKSGLALGGQRDLPGWSRYWISGNAANGQHDLHIRPVELEDEASYECQATQAGLRSRPAQLHVLVPPEAPQVLGGPSVSLVAGVPANLTCRSRGDARPTPELLWFRDGVLLDGATFHQTLLKEGTPGSVESTLTLTPFSHDDGATFVCRARSQALPTGRDTAITLSLQYPPEVTLSASPHTVQEGEKVIFLCQATAQPPVTGYRWAKGGSPVLGARGPRLEVVADASFLTEPVSCEVSNAVGSANRSTALDVLFGPILQAKPEPVSVDVGEDASFSCAWRGNPLPRVTWTRRGGAQVLGSGATLRLPSVGPEDAGDYVCRAEAGLSGLRGGAAEARLTVNAPPVVTALHSAPAFLRGPARLQCLVFASPAPDAVVWSWDEGFLEAGSQGRFLVETFPAPESRGGLGPGLISVLHISGTQESDFSRSFNCSARNRLGEGGAQASLGRRDLLPTVRIVAGVAAATTTLLMVITGVALCCWRHSKASASFSEQKNLMRIPGSSDGSSSRGPEEEETGSREDRGPIVHTDHSDLVLEEEGTLETKDPTNGYYKVRGVSPPASPDSRVTSFQWKSPGISNLP

SEQ ID NO: 7476 - protein, 708 aa, Homo Sapiens
MLRMRVPALLVLLFCFRGRAGPSPHFLQQPEDLVVLLGEEARLPCALGAYWGLVQWTKSGLALGGQRDLPGWSRYWISGNAANGQHDLHIRPVELEDEASYECQATQAGLRSRPAQLHVLVPPEAPQVLGGPSVSLVAGVPANLTCRSRGDARPTPELLWFRDGVLLDGATFHQTLLKEGTPGSVESTLTLTPFSHDDGATFVCRARSQALPTGRDTAITLSLQYPPEVTLSASPHTVQEGEKVIFLCQATAQPPVTGYRWAKGGSPVLGARGPRLEVVADASFLTEPVSCEVSNAVGSANRSTALDVLFGPILQAKPEPVSVDVGEDASFSCAWRGNPLPRVTWTRRGGAQVLGSGATLRLPSVGPEDAGDYVCRAEAGLSGLRGGAAEARLTVNAPPVVTALHSAPAFLRGPARLQCLVFASPAPDAVVWSWDEGFLEAGSQGRFLVETFPAPESRGGLGPGLISVLHISGTQESDFSRSFNCSARNRLGEGGAQASLGRRDLLPTVRIVAGVAAATTTLLMVITGVALCCWRHSKASASFSEQKNLMRIPGSSDGSSSRGPEEEETGSREDRGPIVHTDHSDLVLEEEGTLETKDPTNGYYKVRGVSVSLSLGEAPGGGLFLPPPSPLGPPGTPTFYDFNPHLGMVPPCRLYRARAGYLTTPHPRAFTSYIKPTSFGPPDLAPGTPPFPYAAFPTPSHPRLQTHV

SEQ ID NO: 7477 - protein, 673 aa, Homo Sapiens
MLRMRVPALLVLLFCFRGRAGPSPHFLQQPEDLVVLLGEEARLPCALGAYWGLVQWTKSGLALGGQRDLPGWSRYWISGNAANGQHDLHIRPVELEDEASYECQATQAGLRSRPAQLHVLVPPEAPQVLGGPSVSLVAGVPANLTCRSRGDARPTPELLWFRDGVLLDGATFHQTLLKEGTPGSVESTLTLTPFSHDDGATFVCRARSQALPTGRDTAITLSLQYPPEVTLSASPHTVQEGEKVIFLCQATAQPPVTGYRWAKGGSPVLGARGPRLEVVADASFLTEPVSCEVSNAVGSANRSTALDVLFGPILQAKPEPVSVDVGEDASFSCAWRGNPLPRVTWTRRGGAQVLGSGATLRLPSVGPEDAGDYVCRAEAGLSGLRGGAAEARLTVNAPPVVTALHSAPAFLRGPARLQCLVFASPAPDAVVWSWDEGFLEAGSQGRFLVETFPAPESRGGLGPGLISVLHISGTQESDFSRSFNCSARNRLGEGGAQASLGRRASASFSEQKNLMRIPGSSDGSSSRGPEEEETGSREDRGPIVHTDHSDLVLEEEGTLETKDPTNGYYKVRGVSVSLSLGEAPGGGLFLPPPSPLGPPGTPTFYDFNPHLGMVPPCRLYRARAGYLTTPHPRAFTSYIKPTSFGPPDLAPGTPPFPYAAFPTPSHPRLQTHV

SEQ ID NO: 7478 - protein, 583 aa, Homo Sapiens
MLRMRVPALLVLLFCFRGRAGWSRYWISGNAANGQHDLHIRPVELEDEASYECQATQAGLRSRPAQLHVLVPPEAPQVLGGPSVSLVAGVPANLTCRSRGDARPTPELLWFRDGVLLDGATFHQTLLKEGTPGSVESTLTLTPFSHDDGATFVCRARSQALPTGRDTAITLSLQYPPEVTLSASPHTVQEGEKVIFLCQATAQPPVTGYRWAKGGSPVLGARGPRLEVVADASFLTEPVSCEVSNAVGSANRSTALDVLFGPILQAKPEPVSVDVGEDASFSCAWRGNPLPRVTWTRRGGAQVLGSGATLRLPSVGPEDAGDYVCRAEAGLSGLRGGAAEARLTVNAPPVVTALHSAPAFLRGPARLQCLVFASPAPDAVVWSWDEGFLEAGSQGRFLVETFPAPESRGGLGPGLISVLHISGTQESDFSRSFNCSARNRLGEGGAQASLGRRDLLPTVRIVAGVAAATTTLLMVITGVALCCWRHSKASASFSEQKNLMRIPGSSDGSSSRGPEEEETGSREDRGPIVHTDHSDLVLEEEGTLETKDPTNGYYKVRGVSPPASPDSRVTSFQWKSPGISNLP

SEQ ID NO: 7479 - protein, 138 aa, Homo Sapiens
MNSLVSWQLLLFLCATHFGEPLEKVASVGNSRPTGQQLESLGLLAPGEQSLPCTERKPAATARLSRRGTSLSPPPESSGSPQQPGLSAPHSRQIPAPQGAVLVQREKDLPNYNWNSFGLRFGKREAAPGNHGRSAGRG

SEQ ID NO: 7480 - protein, 144 aa, Homo Sapiens [sequence omitted]

SEQ ID NO: 7481 - protein, 708 aa, Homo Sapiens
MAAAAVAAAAAAAAAASLQVLEMESMETAAAGSAGLAAEVRGSGTVDFGPGPGISAMEASGGDPGPEAEDFECSSHCSELSWRQNEQRRQGLFCDITLCFGGAGGREFRAHRSVLAAATEYFTPLLSGQFSESRSGRVEMRKWSSEPGPEPDTVEAVIEYMYTGRIRVSTGSVHEVLELADRFLLIRLKEFCGEFLKKKLHLSNCVAIHSLAHMYTLSQLALKAADMIRRNFHKVIQDEEFYTLPFHLIRDWLSDLEITVDSEEVLFETVLKWVQRNAEERERYFEELFKLLRLSQMKPTYLTRHVKPERLVANNEVCVKLVADAVERHALRAENIQSGTCQHPTSHVSLLPRYGQNMDVIMVIGGVSEGGDYLSECVGYFVDEDRWVNLPHIHNHLDGHAVAVTESYVYVAGSMEPGFAKTVERYNPNLNTWEHVCSLMTRKHSFGLTEVKGKLYSIGGHGNFSPGFKDVTVYNPELDKWHNLESAPKILRDVKALAIEDRFVYIAARTPVDRDTEDGLKAVITCYDTETRQWQDVESLPLIDNYCFFQMSVVNSNFYQTASCCPKSYCLENEEAVRKIASQVSDEILESLPPEVLSIEGAAICYYKDDVFIIGGWKNSDDIDKQYRKEAYRYCAERKRWMLLPPMPQPRCRATACHVRIPYRYLHGTQRYPMPQNLMWQKDRIRQMQEIHRHALNMRRVPSSQIEC

SEQ ID NO: 7482 - protein, 235 aa, Homo Sapiens
MAEEQEFTQLCKLPAQPSHPHCVNNTYRSAQHSQALLRGLLALRDSGILFDVVLVVEGRHIEAHRILLAASCDYFRGMFAGGLKEMEQEEVLIHGVSYNAMCQILHFIYTSELELSLSNVQETLVAACQLQIPEIIHFCCDFLMSWVDEENILDVYRLAELFDLSRLTEQLDTYILKNFVAFSRTDKYRQLPLEKVYSLLSSNRLEVSCETEVYEGALLYHYSLEQVQADQISLH

SEQ ID NO: 7483 - protein, 634 aa, Homo Sapiens
MAEEQEFTQLCKLPAQPSHPHCVNNTYRSAQHSQALLRGLLALRDSGILFDVVLVVEGRHIEAHRILLAASCDYFRGMFAGGLKEMEQEEVLIHGVSYNAMCQILHFIYTSELELSLSNVQETLVAACQLQIPEIIHFCCDFLMSWVDEENILDVYRLAELFDLSRLTEQLDTYILKNFVAFSRTDKYRQLPLEKVYSLLSSNRLEVSCETEVYEGALLYHYSLEQVQADQISLHEPPKLLETVRFPLMEAEVLQRLHDKLDPSPLRDTVASALMYHRNESLQPSLQSPQTELRSDFQCVVGFGGIHSTPSTVLSDQAKYLNPLLGEWKHFTASLAPRMSNQGIAVLNNFVYLIGGDNNVQGFRAESRCWRYDPRHNRWFQIQSLQQEHADLSVCVVGRYIYAVAGRDYHNDLNAVERYDPATNSWAYVAPLKREVYAHAGATLEGKMYITCGRRGEDYLKETHCYDPGSNTWHTLADGPVRRAWHGMATLLNKLYVIGGSNNDAGYRRDVHQVACYSCTSGQWSSVCPLPAGHGEPGIAVLDNRIYVLGGRSHNRGSRTGYVHIYDVEKDCWEEGPQLDNSISGLAACVLTLPRSLLLEPPRGTPDRSQADPDFASEVMSVSDWEEFDNSSED

SEQ ID NO: 7484 - protein, 158 aa, Homo Sapiens
MAEEQEFTQLCKLPAQPSHPHCVNNTYRSAQHSQALLRGLLALRDSGILFDVVLVVEGRHIEAHRILLAASCDYFRGMFAGGLKEMEQEEVLIHGVSYNAMCQILHFIYTSELELSLSNVQETLVAACQLQMLFTSPGLNGCHSLCRSQKLSISAVIS

SEQ ID NO: 7485 - protein, 225 aa, Homo Sapiens
MFAGGLKEMEQEEVLIHGVSYNAMCQILHFIYTSELELSLSNVQETLVAACQLQIPEIIHFCCDFLMSWVDEENILDVYRLAELFDLSRLTEQLDTYILKNFVAFSRTDKYRQLPLEKVYSLLSSNRLEVSCETEVYEGALLYHYSLEQVQADQISLHEPPKLLETVRFPLMEAEVLQRLHDKLDPSPLRDTVASALMYHRNESLQPSLQSPQTELRSDFQCVVG

SEQ ID NO: 7486 - protein, 252 aa, Homo Sapiens
MGLGSSCHLSLPKRAEALLCSRKATVVRDLVAVRMAEEQEFTQLCKLPAQPSHPHCVNNTYRSAQHSQALLRGLLALRDSGILFDVVLVVEGRHIEAHRILLAASCDYFRGMFAGGLKEMEQEEVLIHGVSYNAMCQILHFIYTSELELSLSNVQETLVAACQLQIPEIIHFCCDFLMSWVDEENILDVYRLAELFDLSRLTEQLDTYILKNFVAFSRTDKYRQLPLEKVYSLLSSNRLEVSCETEVYEGAL

SEQ ID NO: 7487 - protein, 107 aa, Homo Sapiens
MPPPWHPPPRLLAVCLLTTTQATVVRDLVAVRMAEEQEFTQLCKLPAQPSHPHCVNNTYRSAQHSQALLRGLLALRDSGILFDVVLVVEGRHIEAHRILLAASCDYF

SEQ ID NO: 7488 - protein, 295 aa, Homo Sapiens
MPPPWHPPPRLLAVCLLTTTQATVVRDLVAVRMAEEQEFTQLCKLPAQPSHPHCVNNTYRSAQHSQALLRGLLALRDSGILFDVVLVVEGRHIEAHRILLAASCDYFRGMFAGGLKEMEQEEVLIHGVSYNAMCQILHFIYTSELELSLSNVQETLVAACQLQIPEIIHFCCDFLMSWVDEENILDVYRLAELFDLSRLTEQLDTYILKNFVAFSRTDKYRQLPLEKVYSLLSSNRLEVSCETEVYEGALLYHYSLEQVQADQISLHEPPKLLETVRFPLMEAEVLQRLHDKLDP

SEQ ID NO: 7489 - protein, 56 aa, Homo Sapiens
MWFLVLCLALSLGGTALVFWNPTPRILNAFSASASALASPKIASKRTPYPSSTLRP

SEQ ID NO: 7490 - protein, 262 aa, Homo Sapiens
MWFLVLCLALSLGGTGAAPPIQSRIVGGWECEQHSQPWQAALYHFSTFQCGGILVHRQWVLTAAHCISDNYQLWLGRHNLFDDENTAQFVHVSESFPHPGFNMSLLENHTRQADEDYSHDLMLLRLTEPADTITDAVKVVELPTEEPEVGSTCLASGWGSIEPENFSFPDDLQCVDLKILPNDECKKAHVQKVTDFMLCVGHLEGGKDTCVGDSGGPLMCDGVLQGVTSWGYVPCGTPNKPSVAVRVLSYVKWIEDTIAENS

SEQ ID NO: 7491 - protein, 143 aa, Homo Sapiens
MRAPHLHLSAASGARALAKLLPLLMAQLWAAEAALLPQNDTRLDPEAYGSPCARGSQPWQVSLFNGLSFHCAGVLVDQSWVLTAAHCGNKPLWARVGDDHLLLLQGEQLRRTTRSVVHPKYHQGSGPILPRRTDEHDLMLLKL

SEQ ID NO: 7492 - protein, 276 aa, Homo Sapiens
MRAPHLHLSAASGARALAKLLPLLMAQLWAAEAALLPQNDTRLDPEAYGSPCARGSQPWQVSLFNGLSFHCAGVLVDQSWVLTAAHCGNKPLWARVGDDHLLLLQGEQLRRTTRSVVHPKYHQGSGPILPRRTDEHDLMLLKLARPVVLGPRVRALQLPYRCAQPGDQCQVAGWGTTAARRVKYNKGLTCSSITILSPKECEVFYPGVVTNNMICAGLDRGQDPCQSDSGGPLVCDETLQGILSWGVYPCGSAQHPAVYTQICKYMSWINKVIRSN

SEQ ID NO: 7493 - protein, 276 aa, Homo Sapiens; identical to SEQ ID NO: 7492

SEQ ID NO: 7494 - protein, 276 aa, Homo Sapiens; identical to SEQ ID NO: 7492

SEQ ID NO: 7495 - protein, 43 aa, Homo Sapiens
MTTCCFFRESSSAGPLALLSIPSTTRAQAPSCQGERMSTISCC

SEQ ID NO: 7496 - protein, 282 aa, Homo Sapiens
MQRLRWLRDWKSSGRGLTAAKEPGARSSPLQAMRILQLILLALATGLVGGETRIIKGFECKPHSQPWQAALFEKTRLLCGATLIAPRWLLTAAHCLKPRYIVHLGQHNLQKEEGCEQTRTATESFPHPGFNNSLPNKDHRNDIMLVKMASPVSITWAVRPLTLSSRCVTAGTSCLISGWGSTSSPQLRLPHTLRCANITIIEHQKCENAYPGNITDTMVCASVQEGGKDSCQGDSGGPLVCNQSLQGIISWGQDPCAITRKPGVYTKVCKYVDWIQETMKNN

SEQ ID NO: 7497 - protein, 116 aa, Homo Sapiens
MQRLRWLRDWKSSGRGLTAAKEPGARSSPLQAMRILQLILLALATGLVGGETRIIKGFECKPHSQPWQAALFEKTRLLCGATLIAPRWLLTAAHCLKPWPLHSSPGAAQPPEGGGL

SEQ ID NO: 7498 - protein, 68 aa, Homo Sapiens
MRILQLILLALATGLVGGETRIIKGFECKPHSQPWQAALFEKTRLLCGATLIAPRWLLTAAHCLKPRY

SEQ ID NO: 7499 - protein, 170 aa, Homo Sapiens
MRILQLILLALATGLVGGETRIIKGFECKPHSQPWQAALFEKTRLLCGATLIAPRWLLTAAHCLKPRYIVHLGQHNLQKEEGCEQTRTATESFPHPGFNNSLPNKDHRNDIMLVKMASPVSITWAVRPLTLSSRCVTAGTSCLISGWGSTSSPQLRLPHTLRCANITIIE

SEQ ID NO: 7500 - protein, 250 aa, Homo Sapiens
MRILQLILLALATGLVGGETRIIKGFECKPHSQPWQAALFEKTRLLCGATLIAPRWLLTAAHCLKPRYIVHLGQHNLQKEEGCEQTRTATESFPHPGFNNSLPNKDHRNDIMLVKMASPVSITWAVRPLTLSSRCVTAGTSCLISGWGSTSSPQLRLPHTLRCANITIIEHQKCENAYPGNITDTMVCASVQEGGKDSCQGDSGGPLVCNQSLQGIISWGQDPCAITRKPGVYTKVCKYVDWIQETMKNN

SEQ ID NO: 7501 - protein, 250 aa, Homo Sapiens; identical to SEQ ID NO: 7500

SEQ ID NO: 7502 - protein, 275 aa, Homo Sapiens
MRILQLILLALATGLVGGETRIIKGFECKPHSQPWQAALFEKTRLLCGATLIAPRWLLTAAHCLKPWVSLTSPTHVSPDLSSSNYCLSHLSRYIVHLGQHNLQKEEGCEQTRTATESFPHPGFNNSLPNKDHRNDIMLVKMASPVSITWAVRPLTLSSRCVTAGTSCLISGWGSTSSPQLRLPHTLRCANITIIEHQKCENAYPGNITDTMVCASVQEGGKDSCQGDSGGPLVCNQSLQGIISWGQDPCAITRKPGVYTKVCKYVDWIQETMKNN

SEQ ID NO: 7503 - protein, 109 aa, Homo Sapiens
MRILQLILLALATVRLPHTLRCANITIIEHQKCENAYPGNITDTMVCASVQEGGKDSCQGDSGGPLVCNQSLQGIISWGQDPCAITRKPGVYTKVCKYVDWIQETMKNN

SEQ ID NO: 7504 - protein, 141 aa, Homo Sapiens
  misc_feature (1)..(1): Xaa can be any naturally occurring amino acid
XNSLPNKDHRNDIMLVKMASPVSITWAVRPLTLSSRCVTAGTSCLISGWGSTSSPQLRLPHTLRCANITIIEHQKCENAYPGNITDTMVCASVQEGGKDSCQSLQGIISWGQDPCAITRKPGVYTKVCKYVDWIQETMKNN

SEQ ID NO: 7505 - protein, 79 aa, Homo Sapiens
MGLSIFLLLCVLGEFSRSRERAGLRLDPFTPMRRPHHPPHLSSGPQPGGEEERGFLCASIYLQLSGAQPGSHTEDFQWH

SEQ ID NO: 7506 - protein, 79 aa, Homo Sapiens; identical to SEQ ID NO: 7505

SEQ ID NO: 7507 - protein, 111 aa, Homo Sapiens
MGLSIFLLLCVLGLSQAATPKIFNGTECGRNSQPWQVGLFEGTSLRCGGVLIDHRWVLTAAHCSGRPIPGSAPVPQPLHRLPCHLPWCVSRENHEQHGVCRRRPGAGCLPG

SEQ ID NO: 7508 - protein, 248 aa, Homo Sapiens
MGLSIFLLLCVLGLSQAATPKIFNGTECGRNSQPWQVGLFEGTSLRCGGVLIDHRWVLTAAHCSGSRYWVRLGEHSLSQLDWTEQIRHSGFSVTHPGYLGASTSHEHDLRLLRLRLPVRVTSSVQPLPLPNDCATAGTECHVSGWGITNHPRNPFPDLLQCLNLSIVSHATCHGVYPGRITSNMVCAGGVPGQDACQGDSGGPLVCGGVLQGLVSWGSVGPCGQDGIPGVYTYICKYVDWIRMIMRNN

SEQ ID NO: 7509 - protein, 248 aa, Homo Sapiens; identical to SEQ ID NO: 7508

SEQ ID NO: 7510 - protein, 254 aa, Homo Sapiens
MGLSIFLLLCVLGLSQAATPKIFNGTECGRNSQPWQVGLFEGTSLRCGGVLIDHRWVLTAAHCSGSRYWVRLGEHSLSQLDWTEQIRHSGFSVTHPGYLGASTSHEHDLRLLRLRLPVRVTSSVQPLPLPNDCATAGTECHVSGWGITNHPRNPFPDLLQCLNLSIVSHATCHGVYPGRITSNMVCAGGVPGQDACQGDSGGPLVCGGVLQGLVSWGSVGPCGQDGIPGVYTYICNSTLVGLGTSWNFNSCQPF

SEQ ID NO: 7511 - protein, 177 aa, Homo Sapiens
MGLSIFLLLCVLGLSQAATPKIFNGTECGRNSQPWQVGLFEGTSLRCGGVLIDHRWVLTAAHCSGSRYWVRLGEHSLSQLDWTEQIRHSGFSVTHPGYLGASTSHEHDLRLLRLRLPVRVTSSVQPLPLPNDCATAGTECHVSGWGITNHPRSKGPRARGQGSGWVQVWDAGREVES

SEQ ID NO: 7512 - protein, 98 aa, Homo Sapiens
MGLIYKCLPEKVTVNIETRCLPGVFQGSQHQWDQWVSPRWLHLLPPLSALAGCPTSARAATLWGSPGPPQMGPHCRTLSKGGAQSLPRQARPRACGSW

SEQ ID NO: 7513 - protein, 98 aa, Homo Sapiens; identical to SEQ ID NO: 7512

SEQ ID NO: 7514 - protein, 93 aa, Homo Sapiens
MWPLALVIASLTLALSGGEDFKEPSQGPRDVMAASRPEAFPKGLTLEPRPEKGGICGCLAPGTILGLKVGWLFSSGDTPWIHARATPECHTLG

SEQ ID NO: 7515 - protein, 93 aa, Homo Sapiens; identical to SEQ ID NO: 7514

SEQ ID NO: 7516 - protein, 99 aa, Homo Sapiens
MWPLALVIASLTLALSGGVSQESSKVLNTNGTSGFLPGGYTCFPHSQPWQAALLVQGRLLCGGVLVHPKWVLTAAHCLKEGLKVYLGKHALGRVEAGEQ

SEQ ID NO: 7517 - protein, 180 aa, Homo Sapiens
MWPLALVIASLTLALSGGVSQESSKVLNTNGTSGFLPGGYTCFPHSQPWQAALLVQGRLLCGGVLVHPKWVLTAAHCLKEGLKVYLGKHALGRVEAGEQVREVVHSIPHPEYRRSPTHLNHDHDIMLLELQSPVQLTGYIQTLPLSHNNRLTPGTTCRVSGWGTTTSPQGMHPHRWPEAP

SEQ ID NO: 7518 - protein, 277 aa, Homo Sapiens
MWPLALVIASLTLALSGGVSQESSKVLNTNGTSGFLPGGYTCFPHSQPWQAALLVQGRLLCGGVLVHPKWVLTAAHCLKEGLKVYLGKHALGRVEAGEQVREVVHSIPHPEYRRSPTHLNHDHDIMLLELQSPVQLTGYIQTLPLSHNNRLTPGTTCRVSGWGTTTSPQVNYPKTLQCANIQLRSDEECRQVYPGKITDNMLCAGTKEGGKDSCEGDSGGPLVCNRTLYGIVSWGDFPCGQPDRPGVYTRVSRYVLWIRETIRKYETQQQKWLKGPQ

SEQ ID NO: 7519 - protein, 204 aa, Homo Sapiens
MWPLALVIASLTLALSGGVSQESSKVLNTNGTSGFLPGGYTCFPHSQPWQAALLVQGRLLCGGVLVHPKWVLTAAHCLKEGLKVYLGKHALGRVEAVNYPKTLQCANIQLRSDEECRQVYPGKITDNMLCAGTKEGGKDSCEGDSGGPLVCNRTLYGIVSWGDFPCGQPDRPGVYTRVSRYVLWIRETIRKYETQQQKWLKGPQ

SEQ ID NO: 7520 - protein, 125 aa, Homo Sapiens
MWPLALVIASLTLALSGVNYPKTLQCANIQLRSDEECRQVYPGKITDNMLCAGTKEGGKDSCEGDSGGPLVCNRTLYGIVSWGDFPCGQPDRPGVYTRVSRYVLWIRETIRKYETQQQKWLKGPQ

SEQ ID NO: 7521 - protein, 267 aa, Homo Sapiens
MSLRVLGSGTWPSAPKMFLLLTALQVLAIAMTQSQEDENKIIGGHTCTRSSQPWQAALLAGPRRRFLCGGALLSGQWVITAAHCGRPILQVALGKHNLRRWEATQQVLRVVRQVTHPNYNSRTHDNDLMLLQLQQPARIGRAVRPIEVTQACASPGTSCRVSGWGTISSPIARYPASLQCVNINISPDEVCQKAYPRTITPGMVCAGVPQGGKDSCQGDSGGPLVCRGQLQGLVSWGMERCALPGYPGVYTNLCKYRSWIEETMRDK

SEQ ID NO: 7522 - protein, 267 aa, Homo Sapiens; identical to SEQ ID NO: 7521

SEQ ID NO: 7523 - protein, 43 aa, Homo Sapiens
MRVRLGEHNLRKRDGPEQLRTTSRVIPHPRYEARSHRNDIMLL

SEQ ID NO: 7524 - protein, 256 aa, Homo Sapiens
MWLLLTLSFLLASTAAQDGDKLLEGDECAPHSQPWQVALYERGRFNCGASLISPHWVLSAAHCQSRFMRVRLGEHNLRKRDGPEQLRTTSRVIPHPRYEARSHRNDIMLLRLVQPARLNPQVRPAVLPTRCPHPGEACVVSGWGLVSHNEPGTAGSPRSQVSLPDTLHCANISIISDTSCDKSYPGRLTNTMVCAGAEGRGAESCEGDSGGPLVCGGILQGIVSWGDVPCDNTTKPGVYTKVCHYLEWIRETMKRN

SEQ ID NO: 7525 - protein, 120 aa, Homo Sapiens
MWLLLTLSFLLASTAQDGDKLLEGDECAPHSQPWQVALYERGRFNCGASLISPHWVLSAAHCQSRFMRVRLGEHNLRKRDGPEQLRTTSRVIPHPRYEARSHRNDIMLLRLVQPARLNPQ

SEQ ID NO: 7526 - protein, 160 aa, Homo Sapiens
MWLLLTLSFLLASTAQDGDKLLEGDECAPHSQPWQVALYERGRFNCGASLISPHWVLSAAHCQSRFMRVRLGEHNLRKRDGPEQLRTTSRVIPHPRYEARSHRNDIMLLRLVQPARLNPQVRPAVLPTRCPHPGEACVVSGWGLVSHNEPGTAGSPRSQG

SEQ ID NO: 7527 - protein, 255 aa, Homo Sapiens
MWLLLTLSFLLASTAQDGDKLLEGDECAPHSQPWQVALYERGRFNCGASLISPHWVLSAAHCQSRFMRVRLGEHNLRKRDGPEQLRTTSRVIPHPRYEARSHRNDIMLLRLVQPARLNPQVRPAVLPTRCPHPGEACVVSGWGLVSHNEPGTAGSPRSQVSLPDTLHCANISIISDTSCDKSYPGRLTNTMVCAGAEGRGAESCEGDSGGPLVCGGILQGIVSWGDVPCDNTTKPGVYTKVCHYLEWIRETMKRN

SEQ ID NO: 7528 - protein, 23 aa, Homo Sapiens
MSLLKHQSLRPDEDSSHDLMLLR

SEQ ID NO: 7529 - protein, 44 aa, Homo Sapiens
MSLLKHQSLRPDEDSSHDLMLLRLSEPAKITDVVKVLGLPTQEP

SEQ ID NO: 7530 - protein, 159 aa, Homo Sapiens
MSLLKHQSLRPDEDSSHDLMLLRLSEPAKITDVVKVLGLPTQEPALGTTCYASGWGSIEPEEFLRPRSLQCVSLHLLSNDMCARAYSEKVTEFMLCAGLWTGGKDTCGGDSGGPLVCNGVLQGITSWGPEPCALPEKPAVYTKVVHYRKWIKDTIAANP

SEQ ID NO: 7531 - protein, 69 aa, Homo Sapiens
MWDLVLSIALSVGCTGAVPLIQSRIVGGWECEKHSQPWQVAVYSHGWAHCGGVLVHPQWVLTAAHCLKK

SEQ ID NO: 7532 - protein, 122 aa, Homo Sapiens
MWDLVLSIALSVGCTGAVPLIQSRIVGGWECEKHSQPWQVAVYSHGWAHCGGVLVHPQWVLTAAHCLKKACQDHRCCEGPGPAHPGASTGDHLLRLRLGQHRTRGVLAPQESSVCEPPSPVQ

SEQ ID NO: 7533 - protein, 164 aa, Homo Sapiens
MWDLVLSIALSVGCTGAVPLIQSRIVGGWECEKHSQPWQVAVYSHGWAHCGGVLVHPQWVLTAAHCLKKNSQVWLGRHNLFEPEDTGQRVPVSHSFPHPLYNMSLLKHQSLRPDEDSSHDLMLLRLSEPAKITDVVKVLGLPTQEPALGTTCYASGWGSIEPEE

SEQ ID NO: 7534 - protein, 261 aa, Homo Sapiens
MWDLVLSIALSVGCTGAVPLIQSRIVGGWECEKHSQPWQVAVYSHGWAHCGGVLVHPQWVLTAAHCLKKNSQVWLGRHNLFEPEDTGQRVPVSHSFPHPLYNMSLLKHQSLRPDEDSSHDLMLLRLSEPAKITDVVKVLGLPTQEPALGTTCYASGWGSIEPEEFLRPRSLQCVSLHLLSNDMCARAYSEKVTEFMLCAGLWTGGKDTCGGDSGGPLVCNGVLQGITSWGPEPCALPEKPAVYTKVVHYRKWIKDTIAANP

SEQ ID NO: 7535 - protein, 223 aa, Homo Sapiens
MWDLVLSIALSVGCTGAVPLIQSRIVGGWECEKHSQPWQVAVYSHGWAHCGGVLVHPQWVLTAAHCLKKNSQVWLGRHNLFEPEDTGQRVPVSHSFPHPLYNMSLLKHQSLRPDEDSSHDLMLLRLSEPAKITDVVKVLGLPTQEPALGTTCYASGWGSIEPEEFLRPRSLQCVSLHLLSNDMCARAYSEKVTEFMLCAGLWTGGKDTCGVSHPYSQHLEGKG

SEQ ID NO: 7536 - protein, 49 aa, Homo Sapiens
MWDLVLSIALSVGCTGIARSGWVGTTCLSLKTQARGSLSATASHTRSTI

SEQ ID NO: 7537 - protein, 49 aa, Homo Sapiens; identical to SEQ ID NO: 7536

SEQ ID NO: 7538 - protein, 49 aa, Homo Sapiens; identical to SEQ ID NO: 7536

SEQ ID NO: 7539 - protein, 51 aa, Homo Sapiens
  misc_feature (1)..(1): Xaa can be any naturally occurring amino acid
XEKVTEFMLCAGLWTGGKDTCGHNSPIPVLSTCLLGTCYVTSIAVDPGKQQ

SEQ ID NO: 7540 - protein, 184 aa, Homo Sapiens
  misc_feature (1)..(1): Xaa can be any naturally occurring amino acid
XPDEDSSHDLMLLRLSEPAKITDVVKVLGLPTQEPALGTTCYASGWGSIEPEEFLRPRSLQCVSLHLLSNDMCARAYSEKVTEFMLCAGLWTGGKDTCGESGAVDGAGQKKDRAWLRVILGVHLSVMVCFKVSHHGALSHVPCLKSLLCTPRWCITGSGSRTPSQPTPECPCPTPTSSKFKSTS

SEQ ID NO: 7541 - protein, 172 aa, Homo Sapiens
MWVPVVFLTLAVCGGVLVHPQWVLTAAHCIRNKSVILLGRHSLFHPEDTGQVFQVSHSFPHPLYDMSLLKNRFLRPGDDSSHDLMLLRLSEPAELTDAVKVMDLPTQEPALGTTCYASGWGSIEPEEFLTPKKLQCVDLHVISNDVCAQVHPQKVTKFMLCAGRWTGGKSTC

SEQ ID NO: 7542 - protein, 173 aa, Homo Sapiens [sequence omitted]

SEQ ID NO: 7543 - protein, 218 aa, Homo Sapiens
MWVPVVFLTLSVTWIGAAPLILSRIVGGWECEKHSQPWQVLVASRGRAVCGGVLVHPQWVLTAAHCIRKPGDDSSHDLMLLRLSEPAELTDAVKVMDLPTQEPALGTTCYASGWGSIEPEEFLTPKKLQCVDLHVISNDVCAQVHPQKVTKFMLCAGRWTGGKSTCSGDSGGPLVCNGVLQGITSWGSEPCALPERPSLYTKVVHYRKWIKDTIVANP

SEQ ID NO: 7544 - protein, 195 aa, Homo Sapiens
MWVPVVFLTLSVTWIGAAPLILSRIVGGWECEKHSQPWQVLVASRGRAVCGGVLVHPQWVLTAAHCIRKPGDDSSHDLMLLRLSEPAELTDAVKVMDLPTQEPALGTTCYASGWGSIEPEEFLTPKKLQCVDLHVISNDVCAQVHPQKVTKFMLCAGRWTGGKSTCSWVILITELTMPALPMVLHGSLVPWRGGV

SEQ ID NO: 7545 - protein, 90 aa, Homo Sapiens
MWVPVVFLTLSVTWIGAAPLILSRIVGGWECEKHSQPWQVLVASRGRAVCGGVLVHPQWVLTAAHCIRNKSVILLGRHSLFHPEDTGQAR

SEQ ID NO: 7546 - protein, 261 aa, Homo Sapiens
MWVPVVFLTLSVTWIGAAPLILSRIVGGWECEKHSQPWQVLVASRGRAVCGGVLVHPQWVLTAAHCIRNKSVILLGRHSLFHPEDTGQVFQVSHSFPHPLYDMSLLKNRFLRPGDDSSHDLMLLRLSEPAELTDAVKVMDLPTQEPALGTTCYASGWGSIEPEEFLTPKKLQCVDLHVISNDVCAQVHPQKVTKFMLCAGRWTGGKSTCSGDSGGPLVCNGVLQGITSWGSEPCALPERPSLYTKVVHYRKWIKDTIVANP

SEQ ID NO: 7547 - protein, 227 aa, Homo Sapiens
MWVPVVFLTLSVTWIGAAPLILSRIVGGWECEKHSQPWQVLVASRGRAVCGGVLVHPQWVLTAAHCIRNKSVILLGRHSLFHPEDTGQVFQVSHSFPHPLYDMSLLKNRFLRPGDDSSHDLMLLRLSEPAELTDAVKVMDLPTQEPALGTTCYASGWGSIEPEEFLTPKKLQCVDLHVISNDVCAQVHPQKVTKFMLCAGRWTGGKSTCSVSHPYSQDLEGKGEWGP

SEQ ID NO: 7548 - protein, 238 aa, Homo Sapiens
MWVPVVFLTLSVTWIGAAPLILSRIVGGWECEKHSQPWQVLVASRGRAVCGGVLVHPQWVLTAAHCIRNKSVILLGRHSLFHPEDTGQVFQVSHSFPHPLYDMSLLKNRFLRPGDDSSHDLMLLRLSEPAELTDAVKVMDLPTQEPALGTTCYASGWGSIEPEEFLTPKKLQCVDLHVISNDVCAQVHPQKVTKFMLCAGRWTGGKSTCSWVILITELTMPALPMVLHGSLVPWRGGV

SEQ ID NO: 7549 - protein, 220 aa, Homo Sapiens
MWVPVVFLTLSVTWIGAAPLILSRIVGGWECEKHSQPWQVLVASRGRAVCGGVLVHPQWVLTAAHCIRNKSVILLGRHSLFHPEDTGQVFQVSHSFPHPLYDMSLLKNRFLRPGDDSSIEPEEFLTPKKLQCVDLHVISNDVCAQVHPQKVTKFMLCAGRWTGGKSTCSGDSGGPLVCNGVLQGITSWGSEPCALPERPSLYTKVVHYRKWIKDTIVANP

SEQ ID NO: 7550 - protein, 124 aa, Homo Sapiens
MWVPVVFLTLSVTWIGAAPLILSRIVGGWECEKHSQPWQVLVASRGRAVCGGVLVHPQWVLTAAHCIRNKSVILLGRHSLFHPEDTGQVFQVSHSFPHPLYDMSLLKNRFLRPGDDSTLNQRSS

SEQ ID NO: 7551 - protein, 104 aa, Homo Sapiens
MWVPVVFLTLSVTWIGERGHGWGDAGEGASPDCQAEALSPPTQHPSPDRELGSFLSLPAPLQAHTPSPSILQQSSLPHQVPAPSHLPQNFLPIAQPAPCSQLLY

SEQ ID NO: 7552 - protein, 262 aa, Homo Sapiens
  misc_feature (1)..(1): Xaa can be any naturally occurring amino acid
XFLTLSVTWIGAAPLILSRIVGGWECEKHSQPWQVLVASRGRAVCGGVLVHPQWVLTAAHCIRNKSVILLGRHSLFHPEDTGQVFQVSHSFPHPLYDMSLLKNRFLRPGDDSSHDLMLLRLSEPAELTDAVKVMDLPTQEPALGTTCYASGWGSIEPEECTPGPDVLTPKKLQCVDLHVISNDVCAQVHPQKVTKFMLCAGRWTGGKSTCSGDSGGPLVCNGVLQGITSWGSEPCALPERPSLYTKVVHYRKWIKDTIVANP

SEQ ID NO: 7553 - protein, 75 aa, Homo Sapiens
MATAGNPWGWFLGYLILGVAGSLVSGSCSQIINGEDCSPHSQPWQAALVMENELFCSGVLVHPQWVLSAAHCFQK

SEQ ID NO: 7554 - protein, 254 aa, Homo Sapiens
MATAGNPWGWFLGYLILGVAGSLVSGSCSQIINGEDCSPHSQPWQAALVMENELFCSGVLVHPQWVLSAAHCFQNSYTIGLGLHSLEADQEPGSQMVEASLSVRHPEYNRPLLANDLMLIKLDESVSESDTIRSISIASQCPTAGNSCLVSGWGLLANGRMPTVLQCVNVSVVSEEVCSKLYDPLYHPSMFCAGGGQDQKDSCNGDSGGPLICNGYLQGLVSFGKAPCGQVGVPGVYTNLCKFTEWIEKTVQAS

SEQ ID NO: 7555 - protein, 110 aa, Homo Sapiens
MENELFCSGVLVHPQWVLSAAHCFQNSYTIGLGLHSLEADQEPGSQMVEASLSVRHPEYNRPLLANDLMLIKLDESVSESDTIRSISIASQCPTAGNSCLVSGWGLLANG

SEQ ID NO: 7556 - protein, 71 aa, Homo Sapiens
MVEASLSVRHPEYNRPLLANDLMLIKLDESVSESDTIRSISIASQCPTAGNSCLVSGWGLLANECLPCCSA

SEQ ID NO: 7557 - protein, 71 aa, Homo Sapiens; identical to SEQ ID NO: 7556

SEQ ID NO: 7558 - protein, 205 aa, Homo Sapiens
MATARPPWMWVLCALITALLLGVTEHVLANNDVSCDHPSNTVPSGSNQDLGAGAGEDARSDDSSSRIINGSDCDMHTQPWQAALLLRPNQLYCGAVLVHPQWLLTAAHCRKKVFRVRLGHYSLSPVYESGQQMFQGVKSIPHPGYSHPGHSNDLMLIKLNRRIRPTKDVRPINVSSHCPSAGTKCLVSGWGTTKSPQVHFPKVLQ

SEQ ID NO: 7559 - protein, 293 aa, Homo Sapiens
MATARPPWMWVLCALITALLLGVTEHVLANNDVSCDHPSNTVPSGSNQDLGAGAGEDARSDDSSSRIINGSDCDMHTQPWQAALLLRPNQLYCGAVLVHPQWLLTAAHCRKKVFRVRLGHYSLSPVYESGQQMFQGVKSIPHPGYSHPGHSNDLMLIKLNRRIRPTKDVRPINVSSHCPSAGTKCLVSGWGTTKSPQVHFPKVLQCLNISVLSQKRCEDAYPRQIDDTMFCAGDKAGRDSCQGDSGGPVVCNGSLQGLVSWGDYPCARPNRPGVYTNLCKFTKWIQETIQANS

SEQ ID NO: 7560 - protein, 293 aa, Homo Sapiens; identical to SEQ ID NO: 7559

SEQ ID NO: 7561 - protein, 293 aa, Homo Sapiens; identical to SEQ ID NO: 7559

SEQ ID NO: 7562 - protein, 69 aa, Homo Sapiens
MADPATRHLTPTKLPSTPRATCSVVGSLSIHCGSSQLPTAKNRIFRSSWGSITFGKGRVPRSRVLLSGL

SEQ ID NO: 7563 - protein, 244 aa, Homo Sapiens
MKKLMVVLSLIAAAWAEEQNKLVHGGPCDKTSHPYQAALYTSGHLLCGGVLIHPLWVLTAAHCKKPNLQVFLGKHNLRQRESSQEQSSVVRAVIHPDYDAASHDQDIMLLRLARPAKLSELIQPLPLERDCSANTTSCHILGWGKTADGDFPDTIQCAYIHLVSREECEHAYPGQITQNMLCAGDEKYGKDSCQGDSGGPLVCGDHLRGLVSWGNIPCGSKEKPGVYTNVCRYTNWIQKTIQAK

SEQ ID NO: 7564 - protein, 244 aa, Homo Sapiens; identical to SEQ ID NO: 7563

SEQ ID NO: 7565 - protein, 244 aa, Homo Sapiens; identical to SEQ ID NO: 7563

SEQ ID NO: 7566 - protein, 40 aa, Homo Sapiens
MKKLMVVLSLIAAGIFRSSWGSITFGKGRVPRSRVLLSGL

SEQ ID NO: 7567 - protein, 40 aa, Homo Sapiens; identical to SEQ ID NO: 7566

SEQ ID NO: 7568 - protein, 137 aa, Homo Sapiens
MLLRLARPAKLSELIQPLPLERDCSANTTSCHILGWGKTADGDFPDTIQCAYIHLVSREECEHAYPGQITQNMLCAGDEKYGKDSCQGDSGGPLVCGDHLRGLVSWGNIPCGSKEKPGVYTNVCRYTNWIQKTIQAK

SEQ ID NO: 7569 - protein, 253 aa, Homo Sapiens
MARSLLLPLQILLLSLALETAGEEAQGDKIIDGAPCARGSHPWQVALLSGNQLHCGGVLVNERWVLTAAHCKMNEYTVHLGSDTLGDRRAQRIKASKSFRHPGYSTQTHVNDLMLVKLNSQARLSSMVKKVRLPSRCEPPGTTCTVSGWGTTTSPDVTFPSDLMCVDVKLISPQDCTKVYKDLLENSMLCAGIPDSKKNACNGDSGGPLVCRGTLQGLVSWGTFPCGQPNDPGVYTQVCKFTKWINDTMKKHR

SEQ ID NO: 7570 - protein, 253 aa, Homo Sapiens; identical to SEQ ID NO: 7569

SEQ ID NO: 7571 - protein, 66 aa, Homo Sapiens
MARSLLLPLQILLLSLALETAGEEVSTPCTWAVIRWATGELRGSRPRSHSATPATPHRPMLMTSCS

SEQ ID NO: 7572 - protein, 69 aa, Homo Sapiens
MNEYTVHLGSDTLGDRRAQRIKASKSFRHPGYSTQTHVNDLMLVKLNSQARLSSMVKKVRLPSRCEPPG

SEQ ID NO: 7573 - protein, 181 aa, Homo Sapiens
MNEYTVHLGSDTLGDRRAQRIKASKSFRHPGYSTQTHVNDLMLVKLNSQARLSSMVKKVRLPSRCEPPGTTCTVSGWGTTTSPDVTFPSDLMCVDVKLISPQDCTKVYKDLLENSMLCAGIPDSKKNACNGDSGGPLVCRGTLQGLVSWGTFPCGQPNDPGVYTQVCKFTKWINDTMKKHR

SEQ ID NO: 7574 - protein, 305 aa, Homo Sapiens
MGRPRPRAAKTWMFLLLLGGAWAACGSLDLLTKLYAENLPCVHLNPQWPSQPSHCPRGWRSNPLPPAAGHSRAQEDKVLGGHECQPHSQPWQAALFQGQQLLCGGVLVGGNWVLTAAHCKKPKYTVRLGDHSLQNKDGPEQEIPVVQSIPHPCYNSSDVEDHNHDLMLLQLRDQASLGSKVKPISLADHCTQPGQKCTVSGWGTVTSPRENFPDTLNCAEVKIFPQKKCEDAYPGQITDGMVCAGSSKGADTCQGDSGGPLVCDGALQGITSWGSDPCGRSDKPGVYTNICRYLDWIKKIIGSKG

SEQ ID NO: 7575 - protein, 119 aa, Homo Sapiens
MGRPRPRAAKTWMFLLLLGGAWAENFPDTLNCAEVKIFPQKKCEDAYPGQITDGMVCAGSSKGADTCQGDSGGPLVCDGALQGITSWGSDPCGRSDKPGVYTNICRYLDWIKKIIGSKG

SEQ ID NO: 7576 - protein, 97 aa, Homo Sapiens
MGRPRPRAAKTWMFLLLLGGAWAGHSRAQEDKVLGGHECQPHSQPWQAALFQGQQLLCGGVLVGGNWVLTAAHCKKPKYTVRLGDHSLQNKDGPEQE

SEQ ID NO: 7577 - protein, 260 aa, Homo Sapiens
MGRPRPRAAKTWMFLLLLGGAWAGHSRAQEDKVLGGHECQPHSQPWQAALFQGQQLLCGGVLVGGNWVLTAAHCKKPKYTVRLGDHSLQNKDGPEQEIPVVQSIPHPCYNSSDVEDHNHDLMLLQLRDQASLGSKVKPISLADHCTQPGQKCTVSGWGTVTSPRENFPDTLNCAEVKIFPQKKCEDAYPGQITDGMVCAGSSKGADTCQGDSGGPLVCDGALQGITSWGSDPCGRSDKPGVYTNICRYLDWIKKIIGSKG

SEQ ID NO: 7578 - protein, 32 aa, Homo Sapiens
MGRPRPRAAKTWMFLLLLGGAWAGRFWRPPGV

SEQ ID NO: 7579 - protein, 32 aa, Homo Sapiens; identical to SEQ ID NO: 7578

SEQ ID NO: 7580 - protein, 139 aa, Homo Sapiens
MLLQLRDQASLGSKVKPISLADHCTQPGQKCTVSGWGTVTSPRENFPDTLNCAEVKIFPQKKCEDAYPGQITDGMVCAGSSKGADTCQGDSGGPLVCDGALQGITSWGSDPCGRSDKPGVYTNICRYLDWIKKIIGSKG

SEQ ID NO: 7581 - protein, 54 aa, Homo Sapiens
  misc_feature (1)..(1): Xaa can be any naturally occurring amino acid
XLLLLGGAWAGNTQYAWETTAYRIKMAQSKKYLWFSPSHTPATTAAMWRTTTMI

SEQ ID NO: 7582 - protein, 250 aa, Homo Sapiens
MKLGLLCALLSLLAGHGWADTRAIGAEECRPNSQPWQAGLFHLTRLFCGATLISDRWLLTAAHCRKPYLWVRLGEHHLWKWEGPEQLFRVTDFFPHPGFNKDLSANDHNDDIMLIRLPRQARLSPAVQPLNLSQTCVSPGMQCLISGWGAVSSPKALFPVTLQCANISILENKLCHWAYPGHISDSMLCAGLWEGGRGSCQGDSGGPLVCNGTLAGVVSGGAEPCSRPRRPAVYTSVCHYLDWIQEIMEN

SEQ ID NO: 7583 - protein, 61 aa, Homo Sapiens
MKLGLLCALLSLLAGICGSALESTTSGNGRVRSSCSGLRTSSPTLASTRTSAPMTTMMTSC

SEQ ID NO: 7584 - protein, 148 aa, Homo Sapiens
MILFKQATYFISLFATVSCGCLTQLYENAFFRGGDVASMYTPNAQYCQMRCTFHPRCLLFSFLPASSINDMEKRFGCFLKDSVTGTLPKVHRTGAVSGHSLKQCGHQISACHRDIYKGVDMRGVNFNVSKVSSVEECQKRCTSNIRCQ

SEQ ID NO: 7585 - protein, 638 aa, Homo Sapiens
MILFKQATYFISLFATVSCGCLTQLYENAFFRGGDVASMYTPNAQYCQMRCTFHPRCLLFSFLPASSINDMEKRFGCFLKDSVTGTLPKVHRTGAVSGHSLKQCGHQISACHRDIYKGVDMRGVNFNVSKVSSVEECQKRCTSNIRCQFFSYATQTFHKAEYRNNCLLKYSPGGTPTAIKVLSNVESGFSLKPCALSEIGCHMNIFQHLAFSDVDVARVLTPDAFVCRTICTYHPNCLFFTFYTNVWKIESQRNVCLLKTSESGTPSSSTPQENTISGYSLLTCKRTLPEPCHSKIYPGVDFGGEELNVTFVKGVNVCQETCTKMIRCQFFTYSLLPEDCKEEKCKCFLRLSMDGSPTRIAYGTQGSSGYSLRLCNTGDNSVCTTKTSTRIVGGTNSSWGEWPWQVSLQVKLTAQRHLCGGSLIGHQWVLTAAHCFDGLPLQDVWRIYSGILNLSDITKDTPFSQIKEIIIHQNYKVSEGNHDIALIKLQAPLNYTEFQKPICLPSKGDTSTIYTNCWVTGWGFSKEKGEIQNILQKVNIPLVTNEECQKRYQDYKITQRMVCAGYKEGGKDACKGDSGGPLVCKHNGMWRLVGITSWGEGCARREQPGVYTKVAEYMDWILEKTQSSDGKAQMQSPA

SEQ ID NO: 7586 - protein, 141 aa, Homo Sapiens
MYTPNAQYCQMRCTFHPRCLLFSFLPASSINDMEKRFGCFLKDSVTGTLPKVHRTGAVSGHSLKQCGHQISACHRDIYKGVDMRGVNFNVSKVSSVEECQKRCTSNIRCQFFSYATQTFHKAEYRNNCLLKYSPGGTPTAI

SEQ ID NO: 7587 - protein, 514 aa, Homo Sapiens
MYTPNAQYCQMRCTFHPRCLLFSFLPASSINDMEKRFGCFLKDSVTGTLPKVHRTGAVSGHSLKQCGHQISACHRDIYKGVDMRGVNFNVSKVSSVEECQKRCTSNIRCQFFSYATQTFHKAEYRNNCLLKYSPGGTPTAIKVLSNVESGFSLKPCALSEIGCHMNIFQHLAFSDVDVARVLTPDAFVCRTICTYHPNCLFFTFYTNVWKIESQRNVCLLKTSESGTPSSSTPQENTISGYSLLTCKRTLPEPCHSKIYPGVDFGGEELNVTFVKGVNVCQETCTKMIRCQFFTYSLLPEDCKEEKCKCFLRLSMDGSPTRIAYGTQGSSGYSLRLCNTGDNSVCTTKTSTRIVGGTNSSWGEWPWQVSLQVKLTAQRHLCGGSLIGHQWVLTAAHCFDGLPLQDVWRIYSGILNLSDITKDTPFSQIKEIIIHQNYKVSEGNHDIALIKLQAPLNYTEFQKPICLPSKGDTSTIYTNCWVTGWGFSKEKGRFRWSLSLQTQWNVAFGGHHQLG

SEQ ID NO: 7588 - protein, 686 aa, Homo Sapiens
  misc_feature (1)..(1): Xaa can be any naturally occurring amino acid
XSEDCEVAGYRVLKGTEAVIIPYALHRDPRYFPNPEEFQPERFFPENAQGRHPYAYVPFSAGPRNCIGCLTQLYENAFFRGGDVASMYTPNAQYCQMRCTFHPRCLLFSFLPASSINDMEKRFGCFLKDSVTGTLPKVHRTGAVSGHSLKQCGHQISACHRDIYKGVDMRGVNFNVSKVSSVEECQKRCTSNIRCQFFSYATQTFHKAEYRNNCLLKYSPGGTPTAIKVLSNVESGFSLKPCALSEIGCHMNIFQHLAFSDVDVARVLTPDAFVCRTICTYHPNCLFFTFYTNVWKIESQRNVCLLKTSESGTPSSSTPQENTISGYSLLTCKRTLPEPCHSKIYPGVDFGGEELNVTFVKGVNVCQETCTKMIRCQFFTYSLLPEDCKEEKCKCFLRLSMDGSPTRIAYGTQGSSGYSLRLCNTGDNSVCTTKTSTRIVGGTNSSWGEWPWQVSLQVKLTAQRHLCGGSLIGHQWVLTAAHCFDGLPLQDVWRIYSGILNLSDITKDTPFSQIKEIIIHQNYKVSEGNHDIALIKLQAPLNYTEFQKPICLPSKGDTSTIYTNCWVTGWGFSKEKGEIQNILQKVNIPLVTNEECQKRYQDYKITQRMVCAGYKEGGKDACKGDSGGPLVCKHNGMWRLVGITSWGEGCARREQPGVYTKVAEYMDWILEKTQSSDGKAQMQSPA

SEQ ID NO: 7589 - protein, 91 aa, Homo Sapiens
MARGERIYRAVKDLFLHEPEQMLWNAFPPSGRELSYTSRSQMPGETISRNLQETRREKKCWERSTERHEVRGTEDQRRQERSPGTFSKPKI

SEQ ID NO: 7590 - protein, 352 aa, Homo Sapiens
MARGRKMSKPRAVEAAAAAAAVAATAPGPEMVERRGPGRPRTDGENVFTGQSKIYSYMSPNKCSGMRFPLQEENSVTHHEVKCQGKPLAGIYRKREEKRNAGNAVRSAMKSEEQKIKDARKGPLVPFPNQKSEAAEPPKTPPSSCDSTNAAIAKQALKKPIKGKQAPRKKAQGKTQQNRKLTDFYPVRRSSRKSKAELQSEERKRIDELIESGKEEGMKIDLIDGKGRGVIATKQFSRGDFVVEYHGDLIEITDAKKREALYAQDPSTGCYMYYFQYLSKTYCVDATRETNRLGRLINHSKCGNCQTKLHDIDGVPHLILIASRDIAAGEELLYDYGDRSKASIEAHPWLKH

SEQ ID NO: 7591 - protein, 299 aa, Homo Sapiens
MRWLWLLLFPDSPVTLREVLPSQPWRLRGCSDLRGENVFTGQSKIYSYMSPNKCSGMRFPLQEENSVTHHEVKCQGKPLAGIYRKREEKRNAGNAVRSAMKSEEQKIKDARKGPLVPFPNQKSEAAEPPKTPPSSCDSTNAAIAKQALKKPIKGKQAPRKKAQGKTQQNRKLTDFYPVRRSSRKSKAELQSEERKRIDELIESGKEEGMKIDLIDGKGRGVIATKQFSRGDFVVEYHGDLIEITDAKKREALYAQDPSTGCYMYYFQYLSKTYCVDATRETNRLGRLINHSKCGNCQTK

SEQ ID NO: 7592 - protein, 322 aa, Homo Sapiens
MVERRGPGRPRTDGENVFTGQSKIYSYMSPNKCSGMRFPLQEENSVTHHEVKCQGKPLAGIYRKREEKRNAGNAVRSAMKSEEQKIKDARKGPLVPFPNQKSEAAEPPKTPPSSCDSTNAAIAKQALKKPIKGKQAPRKKAQGKTQQNRKLTDFYPVRRSSRKSKAELQSEERKRIDELIESGKEEGMKIDLIDGKGRGVIATKQFSRGDFVVEYHGDLIEITDAKKREALYAQDPSTGCYMYYFQYLSKTYCVDATRETNRLGRLINHSKCGNCQTKLHDIDGVPHLILIASRDIAAGEELLYDYGDRSKASIEAHPWLKH

SEQ ID NO: 7593 - protein, 1749 aa, Homo Sapiens
MQAMDPAAADLYEEDGKDLDFYDFEPLPTLPEDEENVSLADILSLRDRGLSEQEAWAVCLECSLSMRSVAHAAIFQSLCITPDTLAFNTSGNVCFMEQLSDDPEGAFVPPEFDVTGNTFEAHIYSLGATLKAALEYVAEPTLEPRLSQDLEALLSRMQAEDPGDRPDLESIIALCEEKLQLTSSCRVCRSLSAVGRRVLSIESFGALQDVSESSWRERPAPGNAGPRRPPGDPSTDPEVLPTPEGPESETSRGPRASPTKALLSTPVRNGESHSREGLAGLVLDAERTLGELDRDALRRSRLRKVQTFPRLLSDSPEATLCLPLTRGKSQLPISELFSPDPRKAFLDRKNGLSSFQAQPKCRLWPEQEPEHQLGRVPCAGRSTDRGPGVPGSPGQPETSHPSQGPAEAPADPRDASGEAQTPRDDERIPEGARQLESAAAEQWVSLQDLLSQLGRPFREYELWALCLACLRALQTRPEHPAYLCLDSVLVAEDGAVLFQPPPANGSYDSFFLAPELAEERLVTEKASVYCVAAVLWTAAKFSVPRNHKLALPRRLKTLLLDMARRSAPERPSAAEAIKVCGSYLLQRGMDSRKILAHLRASICQVYQEEETISLQNAFSVVELKPSVAPAPEPSPGFLPVNSDTGLVAVPGPVPGQHPCGEEATQLPAAFTSEATHFKPIVLAQNASVARDQPALAQEESEERGGQREGEGEEKLSLEAHAGSPSLKTPDGPVPGPGPQGAAPEPLGASVQRDSAQGRPCPPPQAPANQPEGASSAAPGSPVPAPPTKASALPVEQGPAEPIPPGVASGGLRPDALGPTTAHHGPRHPPKPPRSKATERPGQEPEGPGATPAGERDDQSPDSVPERPRPADRRLCLPCVDASPLPGRTACPSLQEATRLIQEEFAFDGYLDNGLEALIMGEYIFALKDLTFATFCGAISEKFCDLYWDEKLLQNLFKVVNGQASPSPSTAEEAGSQLEGSQSPRSPSSKRPSLHRLGKEKPAMARTSSRAPCSPTSVSDVDSDALSRGNFEVGFRPQRSVKAERAQQPEAGEDRRPAGGASDVEAVTRLARSKGVGPALSPGPAGFQSCSPGWCSAFYEADCFGADVHNYVKDLGRQQADGALPDAQSPELEQQLMMEKRNYRKTLKFYQKLLQKEKRNKGSDVKTMLSKLKGQLEEMKSRVQFLSLVKKYLQVMYAERWGLEPCTLPVIVNIAAAPCDTLDFSPLDESSSLIFYNVNKHPGGRQKARILQAGTPLGLMAYLYSSDAFLEGYVQQFLYTFRYFCTPHDFLHFLLDRINSTLTRAHQDPTSTFTKIYRRSLCVLQAWVEDCYAVDFPRNSGLLGKLEDFISSKILPLDGSAKHLLGLLEVGMDRRAEGNPRGTDLENPREAEEDARPFNALCKRLSEDGISRKSFPWRLPRGNGLVLPPHKERPYTIAAALPKPCFLEDFYGPCAKTSEKGPYFLTEYSTHQLFSQLTLLQQELFQKCHPVHFLNSRALGVMDKSTAIPKASSSESLSAKTCSLFLPNYVQDKYLLQLLRNADDVSTWVAAEIVTSHTSKLQVNLLSKFLLIAKSCYEQRNFATAMQILSGLEHLAVRQSPAWRILPAKIAEVMEELKAVEVFLKSDSLCLMEGRRFRAQPTLPSAHLLAMHIQQLETGGFTMTNGAHRWSKLRNIAKVVSQVHAFQENPYTFSPDPKLQSYLKQRIARFSGADISTLAADSRANFHQVSSEKHSRKIQDKLRRMKATFQ

SEQ ID NO: 7594 - protein, 1141 aa, Homo Sapiens
MRSVAHAAIFQSLCITPDTLAFNTSGNVCFMEQLSDDPEGAFVPPEFDVTGNTFEAHIYSLGATLKAALEYVAEPTLEPRLSQDLEALLSRMQAEDPGDRPDLESIIALCEEKLQLTSSCRVCRSLSAVGRRVLSIESFGALQDVSESSWRERPAPGNAGPRRPPGDPSTDPEVLPTPEGPESETSRGPRASPTKALLSTPVRNGESHSREGLAGLVLDAERTLGELDRDALRRSRLRKVQTFPRLLSDSPEATLCLPLTRGKSQLPISELFSPDPRKAFLDRKNGLSSFQAQPKCRLWPEQEPEHQLGRVPCAGRSTDRGPGVPGSPGQPETSHPSQGPAEAPADPRDASGEAQTPRDDERIPEGARQLESAAAEQWVSLQDLLSQLGRPFREYELWALCLACLRALQTRPEHPAYLCLDSVLVAEDGAVLFQPPPANGSYDSFFLAPELAEERLVTEKASVYCVAAVLWTAAKFSVPRNHKLALPRRLKTLLLDMARRSAPERPSAAEAIKVCGSYLLQRGMDSRKILAHLRASICQVYQEEETISLQNAFSVVELKPSVAPAPEPSPGFLPVNSDTGLVAVPGPVPGQHPCGEEATQLPAAFTSEATHFKPIVLAQNASVARDQPALAQEESEERGGQREGEGEEKLSLEAHAGSPSLKTPDGPVPGPGPQGAAPEPLGASVQRDSAQGRPCPPPQAPANQPEGASSAAPGSPVPAPPTKASALPVEQGPAEPIPPGVASGGLRPDALGPTTAHHGPRHPPKPPRSKATERPGQEPEGPGATPAGERDDQSPDSVPERPRPADRRLCLPCVDASPLPGRTACPSLQEATRLIQEEFAFDGYLDNGLEALIMGEYIFALKDLTFATFCGAISEKFCDLYWDEKLLQNLFKVVNGQASPSPSTAEEAGSQLEGSQSPRSPSSKRPSLHRLGKEKPAMARTSSRAPCSPTSVSDVDSDALSRGNFEVGFRPQRSVKAERAQQPEAGEDRRPAGGASDVEAVTRLARSKGVGPALSPGPAGFQSCSPGWCSAFYEADCFGADVHNYVKDLGRQQADGALPDAQSPELEQQLMMEKRNYRKTLKFYQKLLQKEKRNKGSDVKTMLSKLKGQLEEMKSRVQFLSLVKKYLQASGLRAPLCPVRQ

SEQ ID NO: 7595 - protein, 391 aa, Homo Sapiens
MKLITILFLCSRLLLSLTQESQSEEIDCNDKDLFKAVDAALKKYNSQNQSNNQFVLYRITEATKTVGSDTFYSFKYEIKEGDCPVQSGKTWQDCEYKDAAKAATGECTATVGKRSSTKFSVATQTCQITPAEGPVVTAQYDCLGCVHPISTQSPDLEPILRHGIQYFNNNTQHSSLFMLNEVKRAQRQDTGECTDNAYIDIQLRIASFSQNCDIYPGKDFVQPPTKICVGCPRDIPTNSPELEETLTHTITKLNAENNATFYFKIDNVKKARVQVVAGKKYFIDFVARETTCSKESNEELTESCETKKLGQSLDCNAEVYVVPWEKKIYPTVNCQPLGMISLMKRPPGFSPFRSSRIGEIKEETTSHLRSCEYKGRPPKAGAEPASEREVS

SEQ ID NO: 7596 - protein, 427 aa, Homo Sapiens
MKLITILFLCSRLLLSLTQESQSEEIDCNDKDLFKAVDAALKKYNSQNQSNNQFVLYRITEATKTVGSDTFYSFKYEIKEGDCPVQSGKTWQDCEYKDAAKAATGECTATVGKRSSTKFSVATQTCQITPAEGPVVTAQYDCLGCVHPISTQSPDLEPILRHGIQYFNNNTQHSSLFMLNEVKRAQRQVVAGLNFRITYSIVQTNCSKENFLFLTPDCKSLWNGDTGECTDNAYIDIQLRIASFSQNCDIYPGKDFVQPPTKICVGCPRDIPTNSPELEETLTHTITKLNAENNATFYFKIDNVKKARVQVVAGKKYFIDFVARETTCSKESNEELTESCETKKLGQSLDCNAEVYVVPWEKKIYPTVNCQPLGMISLMKRPPGFSPFRSSRIGEIKEETTSHLRSCEYKGRPPKAGAEPASEREVS

SEQ ID NO: 7597 - protein, 644 aa, Homo Sapiens
MKLITILFLCSRLLLSLTQESQSEEIDCNDKDLFKAVDAALKKYNSQNQSNNQFVLYRITEATKTVGSDTFYSFKYEIKEGDCPVQSGKTWQDCEYKDAAKAATGECTATVGKRSSTKFSVATQTCQITPAEGPVVTAQYDCLGCVHPISTQSPDLEPILRHGIQYFNNNTQHSSLFMLNEVKRAQRQVVAGLNFRITYSIVQTNCSKENFLFLTPDCKSLWNGDTGECTDNAYIDIQLRIASFSQNCDIYPGKDFVQPPTKICVGCPRDIPTNSPELEETLTHTITKLNAENNATFYFKIDNVKKARVQVVAGKKYFIDFVARETTCSKESNEELTESCETKKLGQSLDCNAEVYVVPWEKKIYPTVNCQPLGMISLMKRPPGFSPFRSSRIGEIKEETTVSPPHTSMAPAQDEERDSGKEQGHTRRHDWGHEKQRKHNLGHGHKHERDQGHGHQRGHGLGHGHEQQHGLGHGHKFKLDDDLEHQGGHVLDHGHKHKHGHGHGKHKNKGKKNGKHNGWKTEHLASSSEDSTTPSAQTQEKTEGPTPIPSLAKPGVTVTFSDFQDSDLIATMMPPISPAPIQSDDDWIPDIQIDPNGLSFNPISDFPDTTSPKCPGRPWKSVSEINPTTQMKESYYFDLTDGLS

SEQ ID NO: 7598 - protein, 427 aa, Homo Sapiens; identical to SEQ ID NO: 7596

SEQ ID NO: 7599 - protein, 644 aa, Homo Sapiens; identical to SEQ ID NO: 7597

SEQ ID NO: 7600 - protein, 458 aa, Homo Sapiens
MLFQEATAFENMTKDWNYLEGSQKDCYRDTMLDSYENTVPQGSFLQLSMMPQRAGNDPPGVSNASEMEMEISNMREKFLMSVTKLVESKSYNSKVFSKEKYFQTIKEVKEAKEKGKKSSRDYRRAAKYDVISVQGTEKLIEATHGERDRIRYYVHKEELFDILHDTHLSIGHGGRTRMLKELQGKYGNVTKEVIVLYLTLCKQCHQKNPVPKRGLAPKPMTFKDIDSTCQVEILDMQSSADGEFKFILYYQDHSTKFIILRPLRTKQAHEVVSVLLDIFTILGTPSVLDSDSGVEFTNQVVHELNELWPDLKIVSGKYHPGQSQGSLEGASRDVKNMISTWMQSNHSCHWAKGLRFMQMVRNQAFDVSLQQSPFEAMFGYKAKFGLYSSNLPRETVATLQTEEELEIAEEQLENSLWIRQEERAEIGADRSDMDDDMDPTPEASEPSTSQGTSGLLCW

SEQ ID NO: 7601 - protein, 410 aa, Homo Sapiens
MMPQRAGNDPPGVSNASEMEMEISNMREKFLMSVTKLVESKSYNSKVFSKEKYFQTIKEVKEAKEKGKKSSRDYRRAAKYDVISVQGTEKLIEATHGERDRIRYYVHKEELFDILHDTHLSIGHGGRTRMLKELQGKYGNVTKEVIVLYLTLCKQCHQKNPVPKRGLAPKPMTFKDIDSTCQVEILDMQSSADGEFKFILYYQDHSTKFIILRPLRTKQAHEVVSVLLDIFTILGTPSVLDSDSGVEFTNQVVHELNELWPDLKIVSGKYHPGQSQGSLEGASRDVKNMISTWMQSNHSCHWAKGLRFMQMVRNQAFDVSLQQSPFEAMFGYKAKFGLYSSNLPRETVATLQTEEELEIAEEQLENSLWIRQEERAEIGADRSDMDDDMDPTPEASEPSTSQGTSGLLCW

SEQ ID NO: 7602 - protein, 492 aa, Homo Sapiens
MPSFLVPSLVSSPVLLKLLFSPGPKTIWSLWQQPMLFQEATAFENMTKDWNYLEGSQKDCYRDTMLDSYENTVPQGSFLQLSMMPQRAGNDPPGVSNASEMEMEISNMREKFLMSVTKLVESKSYNSKVFSKEKYFQTIKEVKEAKEKGKKSSRDYRRAAKYDVISVQGTEKLIEATHGERDRIRYYVHKEELFDILHDTHLSIGHGGRTRMLKELQGKYGNVTKEVIVLYLTLCKQCHQKNPVPKRGLAPKPMTFKDIDSTCQVEILDMQSSADGEFKFILYYQDHSTKFIILRPLRTKQAHEVVSVLLDIFTILGTPSVLDSDSGVEFTNQVVHELNELWPDLKIVSGKYHPGQSQGSLEGASRDVKNMISTWMQSNHSCHWAKGLRFMQMVRNQAFDVSLQQSPFEAMFGYKAKFGLYSSNLPRETVATLQTEEELEIAEEQLENSLWIRQEERAEIGADRSDMDDDMDPTPEASEPSTSQGTSGLLCW

SEQ ID NO: 7603 - protein, 492 aa, Homo Sapiens; identical to SEQ ID NO: 7602

SEQ ID NO: 7604 - protein, 462 aa, Homo Sapiens
MGTQALQGFLFLLFLPLLQPRGASAGSLHSPGLSECFQVNGADYRGHQNRTGPRGAGRPCLFWDQTQQHSYSSASDPHGRWGLGAHNFCRNPDGDVQPWCYVAETEEGIYWRYCDIPSCHMPGYLGCFVDSGAPPALSGPSGTSTKLTVQVCLRFCRMKGYQLAGVEAGYACFCGSESDLARGRLAPATDCDQICFGHPGQLCGGDGRLGVYEVSVGSCQGNWTAPQGVIYSPDFPDEYGPDRNCSWALGPPGAALELTFRLFELADPRDRLELRDAASGSLLRAFDGARPPPSGPLRLGTAALLLTFRSDARGHAQGFALTYRGLQDAAEDPEAPEGSAQTPAAPLDGANVSCSPRPGAPPAAIGARVFSTVTAVSVLLLLLLGLLRPLRRRSCLLAPGKGPPALGASRGPRRSWAVWYQQPRGVALPCSPGDPQAEGSAAGYRPLSASSQSSLRSLISAL

SEQ ID NO: 7605 - protein, 420 aa, Homo Sapiens
MGTQALQGFLFLLFLPLLQPRGASAGSLHSPGLSECFQVNGADYRGHQNRTGPRGAGRPCLFWDQTQQHSYSSASDPHGRWGLGAHNFCRNPDGDVQPWCYVAETEEGIYWRYCDIPSCHMPGYLGCFVDSGAPPALSGPSGTSTKLTVQVCLRFCRMKGYQLAGVEAGYACFCGSESDLARGRLAPATDCDQICFGHPGQLCGGDGRLGVYEVSVGSCQGNWTAPQGVIYSPDFPDEYGPDRNCSWALGPPGAALELTFRLFELADPRDRLELRDAASGSLLRAFDGARPPPSGPLRLGTAALLLTFRSDARGHAQGFALTYRGLQDAAEDPEAPEGSAQTPAAPLDGANVSCSPRPGAPPAAIGGAVCWLREKGPRRWGLPGAPGEAGLCGTNSPEGWPCPAPPGTPRLRVLPRATGL

SEQ ID NO: 7606 - protein, 399 aa, Homo Sapiens
MGTQALQGFLFLLFLPLLQPRGASAGSLHSPGLSECFQVNGADYRGHQNRTGPRGAGRPCLFWDQTQQHSYSSASDPHGRWGLGAHNFCRNPDGDVQPWCYVAETEEGIYWRYCDIPSCHMPGYLGCFVDSGAPPALSGPSGTSTKLTVQVCLRFCRMKGYQLAGVEAGYACFCGSESDLARGRLAPATDCDQICFGHPGQLCGGDGRLGVYEVSVGSCQGNWTAPQGVIYSPDFPDEYGPDRNCSWALGPPGAALELTFRLFELADPRDRLELRDAASGSLLRAFDGARPPPSGPLRLGTAALLLTFRSDARGHAQGFALTYRGLQDAAEDPEAPEGSAQTPAAPLDGANVSCSPRPGAPPAAIGGEAGARDGSESGSRPLAPILTAAVCPQPGSSRR

SEQ ID NO: 7607 - protein, 424 aa, Homo Sapiens
MGTQALQGFLFLLFLPLLQPRGASAGSLHSPGLSECFQVNGADYRGHQNRTGPRGAGRPCLFWDQTQQHSYSSASDPHGRWGLGAHNFCRNPDGDVQPWCYVAETEEGIYWRYCDIPSCHMPGYLGCFVDSGAPPALSGPSGTSTKLTVQVCLRFCRMKGYQLAGVEAGYACFCGSESDLARGRLAPATDCDQICFGHPGQLCGGDGRLGVYEVSVGSCQGNWTAPQGVIYSPDFPDEYGPDRNCSWALGPPGAALELTFRLFELADPRDRLELRDAASGSLLRAFDGARPPPSGPLRLGTAALLLTFRSDARGHAQGFALTYRGLQDAAEDPEAPEGSAQTPAAPLDGANVSCSPRPGAPPAAIGARVFSTVTAVSVLLLLLLGLLRPLRRRCGALGQGLRADRWWGAGAPEGNRARKELLGS

SEQ ID NO: 7608 - protein, 381 aa, Homo Sapiens
MGTQALQGFLFLLFLPLLQPRGASAGSLHSPGLSECFQVNGADYRGHQNRTGPRGAGRPCLFWDQTQQHSYSSASDPHGRWGLGAHNFCRNPDGDVQPWCYVAETEEGIYWRYCDIPSCHMPGYLGCFVDSGAPPALSGPSGTSTKLTVQVCLRFCRMKGYQLCGGDGRLGVYEVSVGSCQGNWTAPQGVIYSPDFPDEYGPDRNCSWALGPPGAALELTFRLFELADPRDRLELRDAASGSLLRAFDGARPPPSGPLRLGTAALLLTFRSDARGHAQGFALTYRGLQDAAEDPEAPEGSAQTPAAPLDGANVSCSPRPGAPPAAIGGAVCWLREKGPRRWGLPGAPGEAGLCGTNSPEGWPCPAPPGTPRLRVLPRATGL

SEQ ID NO: 7609 - protein, 423 aa, Homo Sapiens
MGTQALQGFLFLLFLPLLQPRGASAGSLHSPGLSECFQVNGADYRGHQNRTGPRGAGRPCLFWDQTQQHSYSSASDPHGRWGLGAHNFCRNPDGDVQPWCYVAETEEGIYWRYCDIPSCHMPGYLGCFVDSGAPPALSGPSGTSTKLTVQVCLRFCRMKGYQLCGGDGRLGVYEVSVGSCQGNWTAPQGVIYSPDFPDEYGPDRNCSWALGPPGAALELTFRLFELADPRDRLELRDAASGSLLRAFDGARPPPSGPLRLGTAALLLTFRSDARGHAQGFALTYRGLQDAAEDPEAPEGSAQTPAAPLDGANVSCSPRPGAPPAAIGARVFSTVTAVSVLLLLLLGLLRPLRRRSCLLAPGKGPPALGASRGPRRSWAVWYQQPRGVALPCSPGDPQAEGSAAGYRPLSASSQSSLRSLISAL

SEQ ID NO: 7610 - protein, 85 aa, Homo Sapiens
MKIPVLPAVVLLSLLVLHSAQGATLGGPEEESTIENYASRPEAFKADEFLNWHALFESIKRKLPFLNWDAFPKLKGLRSATPDAQ

SEQ ID NO: 7611 - protein, 99 aa, Homo Sapiens
MKIPVLPAVVLLSLLVLHSAQGATLGGPEEESTIENYASRPEAFNTPFLNIDKLRSAFKADEFLNWHALFESIKRKLPFLNWDAFPKLKGLRSATPDAQ

SEQ ID NO: 7612 - protein, 153 aa, Homo Sapiens
EEKGGASLSPQYVSYNQSSYTQWDLQPDTDYEIHLFKERMFRHQMAVKTNGTVKDKEDTQVDSEARPMKDETFGEYSDNEEKAFGSSQPSLNGDIKPLGSDDSLADYGGSVDVQFNEDGSFIGQYSGKKEKEAAGGNDSSGATSPINPAVALE

SEQ ID NO: 7613 - protein, 90 aa, Homo Sapiens
MVVALRYVWPLLLCSPCLLIQIPEELMEPPVITEQSPRRLVVFPTDDISLKCEASGKPEVQFRWTRDGVHFKPKEELGVTVYQSPHSGSF

SEQ ID NO: 7614 - protein, 128 aa, Homo Sapiens
MVVALRYVWPLLLCSPCLLIQIPEELMEPPVITEQSPRRLVVFPTDDISLKCEASGKPEVQFRWTRDGVHFKPKEELGVTVYQSPHSGSFTITGNNSNFAQRFQGIYRCFASNKLGTAMSHEIRLMAE

SEQ ID NO: 7615 - protein, 1248 aa, Homo Sapiens
MVVALRYVWPLLLCSPCLLIQIPEELMEPPVITEQSPRRLVVFPTDDISLKCEASGKPEVQFRWTRDGVHFKPKEELGVTVYQSPHSGSFTITGNNSNFAQRFQGIYRCFASNKLGTAMSHEIRLMAEGAPKWPKETVKPVEVEEGESVVLPCNPPPSAEPLRIYWMNSKILHIKQDERVTMGQNGNLYFANVLTSDNHSDYICHAHFPGTRTIIQKEPIDLRVKATNSMIDRKPRLLFPTNSSSHLVALQGQPLVLECIAEGFPTPTIKWLRPSGPMPADRVTYQNHNKTLQLLKVGEEDDGEYRCLAENSLGSARHAYYVTVEAAPYWLHKPQSHLYGPGETARLDCQVQGRPQPEVTWRINGIPVEELAKDQKYRIQRGALILSNVQPSDTMVTQCEARNRHGLLLANAYIYVVQLPAKILTADNQTYMAVQGSTAYLLCKAFGAPVPSVQWLDEDGTTVLQDERFFPYANGTLGIRDLQANDTGRYFCLAANDQNNVTIMANLKVKDATQITQGPRSTIEKKGSRVTFTCQASFDPSLQPSITWRGDGRDLQELGDSDKYFIEDGRLVIHSLDYSDQGNYSCVASTELDVVESRAQLLVVGSPGPVPRLVLSDLHLLTQSQVRVSWSPAEDHNAPIEKYDIEFEDKEMAPEKWYSLGKVPGNQTSTTLKLSPYVHYTFRVTAINKYGPGEPSPVSETVVTPEAAPEKNPVDVKGEGNETTNMVITWKPLRWMDWNAPQVQYRVQWRPQGTRGPWQEQIVSDPFLVVSNTSTFVPYEIKVQAVNSQGKGPEPQVTIGYSGEDYPQAIPELEGIEILNSSAVLVKWRPVDLAQVKGHLRGYNVTYWREGSQRKHSKRHIHKDHVVVPANTTSVILSGLRPYSSYHLEVQAFNGRGSGPASEFTFSTPEGVPGHPEALHLECQSNTSLLLRWQPPLSHNGVLTGYVLSYHPLDEGGKGQLSFNLRDPELRTHNLTDLSPHLRYRFQLQATTKEGPGEAIVREGGTMALSGISDFGNISATAGENYSVVSWVPKEGQCNFRFHILFKALGEEKGGASLSPQYVSYNQSSYTQWDLQPDTDYEIHLFKERMFRHQMAVKTNGTGRVRLPPAGFATEGWFIGFVSAIILLLLVLLILCFIKRSKGGKYSVKDKEDTQVDSEARPMKDETFGEYSDNEEKAFGSSQPSLNGDIKPLGSDDSLADYGGSVDVQFNEDGSFIGQYSGKKEKEAAGGNDSSGATSPINPAVALE

SEQ ID NO: 7616 - protein, 1248 aa, Homo Sapiens; identical to SEQ ID NO: 7615

SEQ ID NO: 7617 - protein, 84 aa, Homo Sapiens
MVVALRYVWPLLLCSPCLLIQIPEEYEGHHVMEPPVITEQSPRRLVVFPTDDISLKCEASGKPEVQFRWTRDGVHFKPKEELGV

SEQ ID NO: 7618 - protein, 151 aa, Homo Sapiens
MVVALRYVWPLLLCSPCLLIQIPEEYEGHHVMEPPVITEQSPRRLVVFPTDDISLKCEASGKPEVQFRWTRDGVHFKPKEELGVTVYQSPHSGSFTITGNNSNFAQRFQGIYRCFASNKLGTAMSHEIRLMAEGAPKWPKETVKPVEVEEG

SEQ ID NO: 7619 - protein, 1253 aa, Homo Sapiens
MVVALRYVWPLLLCSPCLLIQIPEEYEGHHVMEPPVITEQSPRRLVVFPTDDISLKCEASGKPEVQFRWTRDGVHFKPKEELGVTVYQSPHSGSFTITGNNSNFAQRFQGIYRCFASNKLGTAMSHEIRLMAEGAPKWPKETVKPVEVEEGESVVLPCNPPPSAEPLRIYWMNSKILHIKQDERVTMGQNGNLYFANVLTSDNHSDYICHAHFPGTRTIIQKEPIDLRVKATNSMIDRKPRLLFPTNSSSHLVALQGQPLVLECIAEGFPTPTIKWLRPSGPMPADRVTYQNHNKTLQLLKVGEEDDGEYRCLAENSLGSARHAYYVTVEAAPYWLHKPQSHLYGPGETARLDCQVQGRPQPEVTWRINGIPVEELAKDQKYRIQRGALILSNVQPSDTMVTQCEARNRHGLLLANAYIYVVQLPAKILTADNQTYMAVQGSTAYLLCKAFGAPVPSVQWLDEDGTTVLQDERFFPYANGTLGIRDLQANDTGRYFCLAANDQNNVTIMANLKVKDATQITQGPRSTIEKKGSRVTFTCQASFDPSLQPSITWRGDGRDLQELGDSDKYFIEDGRLVIHSLDYSDQGNYSCVASTELDVVESRAQLLVVGSPGPVPRLVLSDLHLLTQSQVRVSWSPAEDHNAPIEKYDIEFEDKEMAPEKWYSLGKVPGNQTSTTLKLSPYVHYTFRVTAINKYGPGEPSPVSETVVTPEAAPEKNPVDVKGEGNETTNMVITWKPLRWMDWNAPQVQYRVQWRPQGTRGPWQEQIVSDPFLVVSNTSTFVPYEIKVQAVNSQGKGPEPQVTIGYSGEDYPQAIPELEGIEILNSSAVLVKWRPVDLAQVKGHLRGYNVTYWREGSQRKHSKRHIHKDHVVVPANTTSVILSGLRPYSSYHLEVQAFNGRGSGPASEFTFSTPEGVPGHPEALHLECQSNTSLLLRWQPPLSHNGVLTGYVLSYHPLDEGGKGQLSFNLRDPELRTHNLTDLSPHLRYRFQLQATTKEGPGEAIVREGGTMALSGISDFGNISATAGENYSVVSWVPKEGQCNFRFHILFKALGEEKGGASLSPQYVSYNQSSYTQWDLQPDTDYEIHLFKERMFRHQMAVKTNGTGRVRLPPAGFATEGWFIGFVSAIILLLLVLLILCFIKRSKGGKYSVKDKEDTQVDSEARPMKDETFGEYSDNEEKAFGSSQPSLNGDIKPLGSDDSLADYGGSVDVQFNEDGSFIGQYSGKKEKEAAGGNDSSGATSPINPAVALE

SEQ ID NO: 7620 - protein, 1257 aa, Homo Sapiens
MVVALRYVWPLLLCSPCLLIQIPEEYEGHHVMEPPVITEQSPRRLVVFPTDDISLKCEASGKPEVQFRWTRDGVHFKPKEELGVTVYQSPHSGSFTITGNNSNFAQRFQGIYRCFASNKLGTAMSHEIRLMAEGAPKWPKETVKPVEVEEGESVVLPCNPPPSAEPLRIYWMNSKILHIKQDERVTMGQNGNLYFANVLTSDNHSDYICHAHFPGTRTIIQKEPIDLRVKATNSMIDRKPRLLFPTNSSSHLVALQGQPLVLECIAEGFPTPTIKWLRPSGPMPADRVTYQNHNKTLQLLKVGEEDDGEYRCLAENSLGSARHAYYVTVEAAPYWLHKPQSHLYGPGETARLDCQVQGRPQPEVTWRINGIPVEELAKDQKYRIQRGALILSNVQPSDTMVTQCEARNRHGLLLANAYIYVVQLPAKILTADNQTYMAVQGSTAYLLCKAFGAPVPSVQWLDEDGTTVLQDERFFPYANGTLGIRDLQANDTGRYFCLAANDQNNVTIMANLKVKDATQITQGPRSTIEKKGSRVTFTCQASFDPSLQPSITWRGDGRDLQELGDSDKYFIEDGRLVIHSLDYSDQGNYSCVASTELDVVESRAQLLVVGSPGPVPRLVLSDLHLLTQSQVRVSWSPAEDHNAPIEKYDIEFEDKEMAPEKWYSLGKVPGNQTSTTLKLSPYVHYTFRVTAINKYGPGEPSPVSETVVTPEAAPEKNPVDVKGEGNETTNMVITWKPLRWMDWNAPQVQYRVQWRPQGTRGPWQEQIVSDPFLVVSNTSTFVPYEIKVQAVNSQGKGPEPQVTIGYSGEDYPQAIPELEGIEILNSSAVLVKWRPVDLAQVKGHLRGYNVTYWREGSQRKHSKRHIHKDHVVVPANTTSVILSGLRPYSSYHLEVQAFNGRGSGPASEFTFSTPEGVPGHPEALHLECQSNTSLLLRWQPPLSHNGVLTGYVLSYHPLDEGGKGQLSFNLRDPELRTHNLTDLSPHLRYRFQLQATTKEGPGEAIVREGGTMALSGISDFGNISATAGENYSVVSWVPKEGQCNFRFHILFKALGEEKGGASLSPQYVSYNQSSYTQWDLQPDTDYEIHLFKERMFRHQMAVKTNGTGRVRLPPAGFATEGWFIGFVSAIILLLLVLLILCFIKRSKGGKYSVKDKEDTQVDSEARPMKDETFGEYRSLESDNEEKAFGSSQPSLNGDIKPLGSDDSLADYGGSVDVQFNEDGSFIGQYSGKKEKEAAGGNDSSGATSPINPAVALE

SEQ ID NO: 7621 - protein, 190 aa, Homo Sapiens
  misc_feature (1)..(1): Xaa can be any naturally occurring amino acid
XDPSLQPSITWRGDGRDLQELGDSDKYFIEDGRLVIHSLDYSDQGNYSCVASTELDVVESRAQLLVVEYDIEFEDKEMAPEKWYSLGKVPGNQTSTTLKLSPYVHYTFRVTAINKYGPGEPSPVSETVVTPEAAPEKNPVDVKGEGNETTNMVITWKPLRWMDWNAPQVQYRVQWRPQGTRGPWQEQIVS

SEQ ID NO: 7622 - protein, 232 aa, Homo Sapiens
ETPSSEPMEEEEDDDLELFGGYDSFRSYNSSVGSESSSYLEESSEAENEDREAGELPTSPLHLLSPGTPRSLDGSGSEPAVCEMCGIVGTREAFFSKTKRFCSVSCSRSYSSNSKKASILARLQGKPPTKKAKVLHKAAWSAKIGAFLHSQGTGQLADGTPTGQDALVLGFDWGKFLKDHSYKAAPVSCFKHGIGCCFGMKALKMTPAMTSGATWEQWMSTPLAGVPSTARS

SEQ ID NO: 7623 - protein, 705 aa, Homo Sapiens
MEKPRSIEETPSSEPMEEEEDDDLELFGGYDSFRSYNSSVGSESSSYLEESSEAENEDREAGELPTSPLHLLSPGTPRSLDGSGSEPAVCEMCGIVGTREAFFSKTKRFCSVSCSRSYSSNSKKASILARLQGKPPTKKAKVLHKAAWSAKIGAFLHSQGTGQLADGTPTGQDALVLGFDWGKFLKDHSYKAAPVSCFKHVPLYDQWEDVMKGMKVEVLNSDAVLPSRVYWIASVIQTAGYRVLLRYEGFENDASHDFWCNLGTVDVHPIGWCAINSKILVPPRTIHAKFTDWKGYLMKRLVGSRTLPVDFHIKMVESMKYPFRQGMRLEVVDKSQVSRTRMAVVDTVIGGRLRLLYEDGDSDDDFWCHMWSPLIHPVGWSRRVGHGIKMSERRSDMAHHPTFRKIYCDAVPYLFKKVRAVYTEGGWFEEGMKLEAIDPLNLGNICVATVCKVLLDGYLMICVDGGPSTDGLDWFCYHASSHAIFPATFCQKNDIELTPPKGYEAQTFNWENYLEKTKSKAAPSRLFNMDCPNHGFKVGMKLEAVDLMEPRLICVATVKRVVHRLLSIHFDGWDSEYDQWVDCESPDIYPVGWCELTGYQLQPPVAAEPATPLKAKEATKKKKKQFGKKRKRIPPTKTRPLRQGSKKPLLEDDPQGARKISSEPVPGEIIAVRVKEEHLDVASPDKASSPELPVSVENIKQETDD

SEQ ID NO: 7624 - protein, 614 aa, Homo Sapiens
MEKPRSIEETPSSEPMEEEEDDDLELFGGYDSFRSYNSSVGSESSSYLEESSEAENEDREAGELPTSPLHLLSPGTPRSLDGSGSEPAVCEMCGIVGTREAFFSKTKRFCSVSCSRSYSSNSKKASILARLQGKPPTKKAKVLHKAAWSAKIGAFLHSQGTGQLADGTPTGQDALVLGFDWGKFLKDHSYKAAPVSCFKHVPLYDQWEDVMKGMKVEVLNSDAVLPSRVYWIASVIQTAGYRVLLRYEGFENDASHDFWCNLGTVDVHPIGWCAINSKILVPPRTIHAKFTDWKGYLMKRLVGSRTLPVDFHIKMVESMKYPFRQGMRLEVVDKSQVSRTRMAVVDTVIGGRLRLLYEDGDSDDDFWCHMWSPLIHPVGWSRRVGHGIKMSERRSDMAHHPTFRKIYCDAVPYLFKKVRAVYTEGGWFEEGMKLEAIDPLNLGNICVATVCKVLLDGYLMICVDGGPSTDGLDWFCYHASSHAIFPATFCQKNDIELTPPKGYEAQTFNWENYLEKTKSKAAPSRLFNMDCPNHGFKVGMKLEAVDLMEPRLICVATVKRVVHRLLSIHFDGWDSEYDQWVDCESPDIYPVGWCELTGYQLQPPVAAGKLPRSL

SEQ ID NO: 7625 - protein, 40 aa, Homo Sapiens
MEKPRSIERWGVAVLPRLVSNSWVQAIHLPQPPKVLGLQM

SEQ ID NO: 7626 - protein, 288 aa, Homo Sapiens
  misc_feature (1)..(1): Xaa can be any naturally occurring amino acid
XRPHLQNQWRKRKMTTWSCLVAMIVSGVITAVWAVRAAPIWRSQVKQKMRIGKQGNCRPPRCICSALGLLAPWMAVVLSQGKPPTKKAKVLHKAAWSAKIGAFLHSQGTGQLADGTPTGQDALVLGFDWGKFLKDHSYKAAPVSCFKHVPLYDQWEDVMKGMKVEVLNSDAVLPSRVYWIASVIQTAGYRVLLRYEGFENDASHDFWCNLGTVDVHPIGWCAINSKILVPPRTIHAKFTDWKGYLMKRLVGSRTLPVDFHIKVGSEPLTDVPPSALPFFCILHATHWS

SEQ ID NO: 7627 - protein, 127 aa, Homo Sapiens
MKFTTLLFLAAVAGALVYAEDASSDSTGADPAQEAGTSKPNEEISGPAEPASPPETTTTAQETSAAAVQGTAKVTSSRQELNPLKQALAKAGKGMHGGVPGGKQFIENGSEFAQKLLKKFSLLKPWA

SEQ ID NO: 7628 - protein, 138 aa, Homo Sapiens
MKFTTLLFLAAVAGALVYAEDASSDSTGADPAQEAGTSKPNEEISGPAEPASPPETTTTAQETSAAAVQGTAKVTSSRQELNPLKSIVEKSILLTEQALAKAGKGMHGGVPGGKQFIENGSEFAQKLLKKFSLLKPWA

SEQ ID NO: 7629 - protein, 85 aa, Homo Sapiens
PAQEAGTSKPNEEISGPAEPASPPETTTTAQETSAAAVQGTAKVTSSRQELNPLKQALAKAGKGMHGGVPGGKQFIESECIPRWK

SEQ ID NO: 7630 - protein, 126 aa, Homo Sapiens
MRIASISKSLTMVALAKLWEAGKLDLDIPVQHYVPEFPEKEYEGEKVSVTTRLLISHLSGIRHYEKDIKKVKEEKAYKALKMMKENVAFEQEKEGKSNEKNDFTKFKTEQENEAKCRNSKPGKKKN

SEQ ID NO: 7631 - protein, 547 aa, Homo Sapiens
MYRLMSAVTARAAAPGGLASSCGRRGVHQRAGLPPLGHGWVGGLGLGLGLALGVKLAGGLRGAAPAQSPAAPDPEASPLAEPPQEQSLAPWSPQTPAPPCSRCFARAIESSRDLLHRIKDEVGAPGIVVGVSVDGKEVWSEGLGYADVENRVPCKPETVMRIASISKSLTMVALAKLWEAGKLDLDIPVQHYVPEFPEKEYEGEKVSVTTRLLISHLSGIRHYEKDIKKVKEEKAYKALKMMKENVAFEQEKEGKSNEKNDFTKFKTEQENEAKCRNSKPGKKKNDFEQGELYLREKFENSIESLRLFKNDPLFFKPGSQFLYSTFGYTLLAAIVERASGCKYLDYMQKIFHDLDMLTTVQEENEPVIYNRARFYVYNKKKRLVNTPYVDNSYKWAGGGFLSTVGDLLKFGNAMLYGYQVGLFKNSNENLLPGYLKPETMVMMWTPVPNTEMSWDKEGKYAMAWGVVERKQTYGSCRKQRHYASHTGGAVGASSVLLVLPEELDTETINNKVPPRGIIVSIICNMQSVGLNSTALKIALEFDKDRSD

SEQ ID NO: 7632 - protein, 373 aa, Homo Sapiens
MYRLMSAVTARAAAPGGLASSCGRRGVHQRAGLPPLGHGWVGGLGLGLGLALGVKLAGGLRGAAPAQSPAAPDPEASPLAEPPQEQSLAPWSPQTPAPPCSRCFARAIESSRDLLHRIKDEVGAPGIVVGVSVDGKEVWSEGLGYADVENRVPCKPETVMRIASISKSLTMVALAKLWEAGKLDLDIPVQHYVPEFPEKEYEGEKVSVTTRLLISHLSGIRHYEKDIKKVKEEKAYKALKMMKENVAFEQEKEGKSNEKNDFTKFKTEQENEAKCRNSKPGKKKNDFEQGELYLREKFENSIESLRLFKNDPLFFKPGSQFLYSTFGYTLLAAIVERASGCKYLDYMQKIFHDLDMLTTVQEENEPVIYNRAR

SEQ ID NO: 7633 - protein, 525 aa, Homo Sapiens
MWEAQFLGLLFLQPLWVAPVKPLQPGAEVPVVWAQEGAPAQLPCSPTIPLQDLSLLRRAGVTWQHQPDSGPPAAAPGHPLAPGPHPAAPSSWGPRPRRYTVLSVGPGGLRSGRLPLQPRVQLDERGRQRGDFSLWLRPARRADAGEYRAAVHLRDRALSCRLRLRLGQASMTASPPGSLRASDWVILNCSFSRPDRPASVHWFRNRGQGRVPVRESPHHHLAESFLFLPQVSPMDSGPWGCILTYRDGFNVSIMYNLTVLGLEPPTPLTVYAGAGSRVGLPCRLPAGVGTRSFLTAKWTPPGGGPDLLVTGDNGDFTLRLEDVSQAQAGTYTCHIHLQEQQLNATVTLAIITVTPKSFGSPGSLGKLLCEVTPVSGQERFVWSSLDTPSQRSFSGPWLEAQEAQLLSQPWQCQLYQGERLLGAAVYFTELSSPGAQRSGRAPGALPAGHLLLFLILGVLSLLLLVTGAFGFHLWRRQWRPRRFSALEQGIHPPQAQSKIEELEQEPEPEPEPEPEPEPEPEPEQL

SEQ ID NO: 7634 - protein, 360 aa, Homo Sapiens
MWEAQFLGLLFLQPLWVAPVKPLQPGAEVPVVWAQEGAPAQLPCSPTIPLQDLSLLRRAGVTWQHQPDSGPPAAAPGHPLAPGPHPAAPSSWGPRPRRYTVLSVGPGGLRSGRLPLQPRVQLDERGRQRGDFSLWLRPARRADAGEYRAAVHLRDRALSCRLRLRLGQASMTASPPGSLRASDWVILNCSFSRPDRPASVHWFRNRGQGRVPVRESPHHHLAESFLFLPQVSPMDSGPWGCILTYRDGFNVSIMYNLTVLGLEPPTPLTVYAGAGSRVGLPCRLPAGVGTRSFLTAKWTPPGGGPDLLVTGDNGDFTLRLEDVSQAQAGTYTCHIHLQEQQLNATVTLAIITGQPQVGKE

SEQ ID NO: 7635 - protein, 77 aa, Homo Sapiens
MEREMGALPRPSISAEPGTVISPGSHVTFMCRGPVGVQTFRLEREDRAKYKDSYNVFRLGPSESEARFHIDSVSEGN

SEQ ID NO: 7636 - protein, 89 aa, Homo Sapiens
MEREMVLCLAQTIHTQEGALPRPSISAEPGTVISPGSHVTFMCRGPVGVQTFRLEREDRAKYKDSYNVFRLGPSESEARFHIDSVSEGN

SEQ ID NO: 7637 - protein, 152 aa, Homo Sapiens
MSPHLTALLGLVLCLAQTIHTQEGALPRPSISAEPGTVISPGSHVTFMCRGPVGVQTFRLEREDRAKYKDSYNVFRLGPSESEARFHIDSVSEGNAGLYRCLYYKPPGWSEHSDFLELLVKESSGGPDSPDTEPGSSAGTVPGTEASGFDAP

SEQ ID NO: 7638 - protein, 135 aa, Homo Sapiens
MSPHLTALLGLVLCLAQTIHTQEGALPRPSISAEPGTVISPGSHVTFMCRGPVGVQTFRLEREDRAKYKDSYNVFRLGPSESEARFHIDSVSEGNAGLYRCLYYKPPGWSEHSDFLELLVKGTVPGTEASGFDAP

SEQ ID NO: 7639 - protein, 123 aa, Homo Sapiens
MRFFVPLFLVGILFPAILAKQFTKCELSQLLKDIDGYGGIALPELICTMFHTSGYDTQAIVENNESTEYGLFQISNKLWCKSSQVPQSRNICDISCDKFLDDDITDDIMCAKKILDIKGIDYW

SEQ ID NO: 7640 - protein, 142 aa, Homo Sapiens
MRFFVPLFLVGILFPAILAKQFTKCELSQLLKDIDGYGGIALPELICTMFHTSGYDTQAIVENNESTEYGLFQISNKLWCKSSQVPQSRNICDISCDKFLDDDITDDIMCAKKILDIKGIDYWLAHKALCTEKLEQWLCEKL

SEQ ID NO: 7641 - protein, 217 aa, Homo Sapiens
MLIGGNIEVHVNPGDGTGLRKALLHAPTGTCSDGQAHSISLVRNRRIITVQLDENNPVEMKLGTLVESRTINVSNLYVGGIPEGEGTSLLTMRRSFHGCIKNLIFNLELLDFNSAVGMSKSTWTPAGCQKGLSWLPMQRTKLLPEPRAFPVGAASFTISQVQSAKEGLGQRELKWGLAVKVPAKAGAGAGAGAVLKIRAGTGRERVPQATQMTRPNP

SEQ ID NO: 7642 - protein, 3075 aa, Homo Sapiens
MRGGVLLVLLLCVAAQCRQRGLFPAILNLASNAHISTNATCGEKGPEMFCKLVEHVPGRPVRNPQCRICDGNSANPRERHPISHAIDGTNNWWQSPSIQNGREYHWVTITLDLRQVFQVAYVIIKAANAPRPGNWILERSLDGTTFSPWQYYAVSDSECLSRYNITPRRGPPTYRADDEVICTSYYSRLVPLEHGEIHTSLINGRPSADDLSPKLLEFTSARYIRLRLQRIRTLNADLMTLSHREPKELDPIVTRRYYYSIKDISVGGMCICYGHASSCPWDETTKKLQCQCEHNTCGESCNRCCPGYHQQPWRPGTVSSGNTCEACNCHNKAKDCYYDESVAKQKKSLNTAGQFRGGGVCINCLQNTMGINCETCIDGYYRPHKVSPYEDEPCRPCNCDPVGSLSSVCIKDDLHSDLHNGKQPGQCPCKEGYTGEKCDRCQLGYKDYPTCVSCGCNPVGSASDEPCTGPCVCKENVEGKACDRCKPGFYNLKEKNPRGCSECFCFGVSDVCSSLSWPVGQVNSMSGWLVTDLISPRKIPSQQDALGGRHQVSINNTAVMQRLAPKYYWAAPEAYLGNKLTAFGGFLKYTVSYDIPVETVDSNLMSHADVIIKGNGLTLSTQAEGLSLQPYEEYLNVVRLVPENFQDFHSKRQIDRDQLMTVLANVTHLLIRANYNSAKMALYRLESVSLDIASSNAIDLVVAADVEHCECPQGYTGTSCESCLSGYYRVDGILFGGICQPCECHGHAAECNVHGVCIACAHNTTGVHCEQCLPGFYGEPSRGTPGDCQPCACPLTIASNNFSPTCHLNDGDEVVCDWCAPGYSGAWCERCADGYYGNPTVPGESCVPCDCSGNVDPSEAGHCDSVTGECLKCLGNTDGAHCERCADGFYGDAVTAKNCRACECHVKGSHSAVCHLETGLCDCKPNVTGQQCDQCLHGYYGLDSGHGCRPCNCSVAGSVSDGCTDEGQCHCVPGVAGKRCDRCAHGFYAYQDGSCTPCDCPHTQNTCDPETGECVCPPHTQGVKCEECEDGHWGYDAEVGCQACNCSLVGSTHHRCDVVTGHCQCKSKFGGRACDQCSLGYRDFPDCVPCDCDLRGTSGDACNLEQGLCGCVEETGACPCKENVFGPQCNECREGTFALRADNPLGCSPCFCSGLSHLCSELEDYVRTPVTLGSDQPLLRVVSQSNLRGTTEGVYYQAPDFLLDAATVRQHIRAEPFYWRLPQQFQGDQLMAYGGKLKYSVAFYSLDGVGTSNFEPQVLIKGGRIRKQVIYMDAPAPENGVRQEQEVAMRENFWKYFNSVSEKPVTREDFMSVLSDIEYILIKASYGQGLQQSRISDISMEVGRKAEKLHPEEEVASLLENCVCPPGTVGFSCQDCAPGYHRGKLPAGSDRGPRPLVAPCVPCSCNNHSDTCDPNTGKCLNCGDNTAGDHCDVCTSGYYGKVTGSASDCALCACPHSPPASFSPTCVLEGDHDFRCDACLLGYEGKHCERCSSSYYGNPQTPGGSCQKCDCNPHGSVHGDCDRTSGQCVCRLGASGLRCDECEPRHILMETDCVSCDDECVGVLLNDLDEIGDAVLSLNLTGIIPVPYGILSNLENTTKYLQESLLKENMQKDLGKIKLEGVAEETDNLQKKLTRMLASTQKVNRATERIFKESQDLAIAIERLQMSITEIMEKTTLNQTLDEDFLLPNSTLQNMQQNGTSLLEIMQIRDFTQLHQNATLELKAAEDLLSQIQENYQKPLEELEVLKEAASHVLSKHNNELKAAEALVREAEAKMQESNHLLLMVNANLREFSDKKLHVQEEQNLTSELIVQGRGLIDAAAAQTDAVQDALEHLEDHQDKLLLWSAKIRHHIDDLVMHMSQRNAVDLVYRAEDHAAEFQRLADVLYSGLENIRNVSLNATSAAYVHYNIQSLIEESEELARDAHRTVTETSLLSESLVSNGKAAVQRSSRFLKEGNNLSRKLPGIALELSELRNKTNRFQENAVEITRQTNESLLILRAIPKGIRDKGAKTKELATSASQSAVSTLRDVAGLSQELLNTSASLSRVNTTLRETHQLLQDSTMATLLAGRKVKDVEIQANLLFDRLKPLKMLEENLSRNLSEIKLLISQARKQAASIKVAVSADRDCIRAYQPQISSTNYNTLTLNVKTQEPDNLLFYLGSSTASDFLAVEMRRGRVAFLWDLGSGSTRLEFPDFPIDDNRWHSIHVARFGNIGSLSVKEMSSNQKSPTKTSKSPGTANVLDVNNSTLMFVGGLGGQIKKSPAVKVTHFKGCLGEAFLNGKSIGLWNYIEREGKCRGCFGSSQNEDPSFHFDGSGYSVVEKSLPATVTQIIMLFNTFSPNGLLLYLGSYGTKDFLSIELFRGRVKVMTDLGSGPITLLTDRRYNNGTWYKIAFQRNRKQGVLAVIDAYNTSNKETKQGETPGASSDLNRLDKDPIYVGGLPRSRVVRRGVTTKSFVGCIKNLEISRSTFDLLRNSYGVRKGCLLEPIRSVSFLKGGYIELPPKSLSPESEWLVTFATTNSSGIILAALGGDVEKRGDREEAHVPFFSVMLIGGNIEVHVNPGDGTGLRKALLHAPTGTCSDGQAHSISLVRNRRIITVQLDENNPVEMKLGTLVESRTINVSNLYVGGIPEGEGTSLLTMRRSFHGCIKNLIFNLELLDFNSAVGHEQVDLDTCWLSERPKLAPDAEDSKLLPEPRAFPEQCVVDAALEYVPGAHQFGLTQNSHFILPFNQSAVRKKLSVELSIRTFASSGLIYYMAHQNQADYAVLQLHGGRLHFMFDLGKGRTKVSHPALLSDGKWHTVKTDYVKRKGFITVDGRESPMVTVVGDGTMLDVEGLFYLGGLPSQYQARKIGNITHSIPACIGDVTVNSKQLDKDSPVSAFTVNRCYAVAQEGTYFDGSGYAALVKEGYKVQSDVNITLEFRTSSQNGVLLGISTAKVDAIGLELVDGKVLFHVNNGAGRITAAYEPKTATVLCDGKWHTLQANKSKHRITLIVDGNAVGAESPHTQSTSVDTNNPIYVGGYPAGVKQKCLRSQTSFRGCLRKLALIKSPQVQSFDFSRAFELHGVFLHSCPGTES

SEQ ID NO: 7643 - protein, 3122 aa, Homo Sapiens
MPGAAGVLLLLLLSGGLGGVQAQRPQQQRQSQAHQQRGLFPAVLNLASNALITTNATCGEKGPEMYCKLVEHVPGQPVRNPQCRICNQNSSNPNQRHPITNAIDGKNTWWQSPSIKNGIEYHYVTITLDLQQVFQIAYVIVKAANSPRPGNWILERSLDDVEYKPWQYHAVTDTECLTLYNIYPRTGPPSYAKDDEVICTSFYSKIHPLENGEIHISLINGRPSADDPSPELLEFTSARYIRLRFQRIRTLNADLMMFAHKDPREIDPIVTRRYYYSVKDISVGGMCICYGHARACPLDPATNKSRCECEHNTCGDSCDQCCPGFHQKPWRAGTFLTKTECEACNCHGKAEECYYDENVARRNLSLNIRGKYIGGGVCINCTQNTAGINCETCTDGFFRPKGVSPNYPRPCQPCHCDPIGSLNEVCVKDEKHARRGLAPGSCHCKTGFGGVSCDRCARGYTGYPDCKACNCSGLGSKNEDPCFGPCICKENVEGGDCSRCKSGFFNLQEDNWKGCDECFCSGVSNRCQSSYWTYGKIQDMSGWYLTDLPGRIRVAPQQDDLDSPQQISISNAEARQALPHSYYWSAPAPYLGNKLPAVGGQLTFTISYDLEEEEEDTERVLQLMIILEGNDLSISTAQDEVYLHPSEEHTNVLLLKEESFTIHGTHFPVRRKEFMTVLANLKRVLLQITYSFGMDAIFRLSSVNLESAVSYPTDGSIAAAVEVCQCPPGYTGSSCESCWPRHRRVNGTIFGGICEPCQCFGHAESCDDVTGECLNCKDHTGGPYCDKCLPGFYGEPTKGTSEDCQPCACPLNIPSNNFSPTCHLDRSLGLICDGCPVGYTGPRCERCAEGYFGQPSVPGGSCQPCQCNDNLDFSIPGSCDSLSGSCLICKPGTTGRYCELCADGYFGDAVDAKNCQPCRCNAGGSFSEVCHSQTGQCECRANVQGQRCDKCKAGTFGLQSARGCVPCNCNSFGSKSFDCEESGQCWCQPGVTGKKCDRCAHGYFNFQEGGCTACECSHLGNNCDPKTGRCICPPNTIGEKCSKCAPNTWGHSITTGCKACNCSTVGSLDFQCNVNTGQCNCHPKFSGAKCTECSRGHWNYPRCNLCDCFLPGTDATTCDSETKKCSCSDQTGQCTCKVNVEGIHCDRCRPGKFGLDAKNPLGCSSCYCFGTTTQCSEAKGLIRTWVTLKAEQTILPLVDEALQHTTTKGIVFQHPEIVAHMDLMREDLHLEPFYWKLPEQFEGKKLMAYGGKLKYAIYFEAREETGFSTYNPQVIIRGGTPTHARIIVRHMAAPLIGQLTRHEIEMTEKEWKYYGDDPRVHRTVTREDFLDILYDIHYILIKATYGNFMRQSRISEISMEVAEQGRGTTMTPPADLIEKCDCPLGYSGLSCEACLPGFYRLRSQPGGRTPGPTLGTCVPCQCNGHSSLCDPETSICQNCQHHTAGDFCERCALGYYGIVKGLPNDCQQCACPLISSSNNFSPSCVAEGLDDYRCTACPRGYEGQYCERCAPGYTGSPGNPGGSCQECECDPYGSLPVPCDPVTGFCTCRPGATGRKCDGCKHWHAREGWECVFCGDECTGLLLGDLARLEQMVMSINLTGPLPAPYKMLYGLENMTQELKHLLSPQRAPERLIQLAEGNLNTLVTEMNELLTRATKVTADGEQTGQDAERTNTRAKSLGEFIKELARDAEAVNEKAIKLNETLGTRDEAFERNLEGLQKEIDQMIKELRRKNLETQKEIAEDELVAAEALLKKVKKLFGESRGENEEMEKDLREKLADYKNKVDDAWDLLREATDKIREANRLFAVNQKNMTALEKKKEAVESGKRQIENTLKEGNDILDEANRLADEINSIIDYVEDIQTKLPPMSEELNDKIDDLSQEIKDRKLAEKVSQAESHAAQLNDSSAVLDGILDEAKNISFNATAAFKAYSNIKDYIDEAEKVAKEAKDLAHEATKLATGPRGLLKEDAKGCLQKSFRILNEAKKLANDVKENEDHLNGLKTRIENADARNGDLLRTLNDTLGKLSAIPNDTAAKLQAVKDKARQANDTAKDVLAQITELHQNLDGLKKNYNKLADSVAKTNAVVKDPSKNKIIADADATVKNLEQEADRLIDKLKPIKELEDNLKKNISEIKELINQARKQANSIKVSVSSGGDCIRTYKPEIKKGSYNNIVVNVKTAVADNLLFYLGSAKFIDFLAIEMRKGKVSFLWDVGSGVGRVEYPDLTIDDSYWYRIVASRTGRNGTISVRALDGPKASIVPSTHHSTSPPGYTILDVDANAMLFVGGLTGKLKKADAVRVITFTGCMGETYFDNKPIGLWNFREKEGDCKGCTVSPQVEDSEGTIQFDGEGYALVSRPIRWYPNISTVMFKFRTFSSSALLMYLATRDLRDFMSVELTDGHIKVSYDLGSGMASVVSNQNHNDGKWKSFTLSRIQKQANISIVDIDTNQEENIATSSSGNNFGLDLKADDKIYFGGLPTLRNLSMKARPEVNLKKYSGCLKDIEISRTPYNILSSPDYVGVTKGCSLENVYTVSFPKPGFVELSPVPIDVGTEINLSFSTKNESGIILLGSGGTPAPPRRKRRQTGQAYYAILLNRGRLEVHLSTGARTMRKIVIRPEPNLFHDGREHSVHVERTRGIFTVQVDENRRYMQNLTVEQPIEVKKLFVGGAPPEFQPSPLRNIPPFEGCIWNLVINSVPMDFARPVSFKNADIGRCAHQKLREDEDGAAPAEIVIQPEPVPTPAFPTPTPVLTHGPCAAESEPALLIGSKQFGLSRNSHIAIAFDDTKVKNRLTIELEVRTEAESGLLFYMARINHADFATVQLRNGLPYFSYDLGSGDTHTMIPTKINDGQWHKIKIMRSKQEGILYVDGASNRTISPKKADILDVVGMLYVGGLPINYTTRRIGPVTYSIDGCVRNLHMAEAPADLEQPTSSFHVGTCFANAQRGTYFDGTGFAKAVGGFKVGLDLLVEFEFRTTTTTGVLLGISSQKMDGMGIEMIDEKLMFHVDNGAGRFTAVYDAGVPGHLCDGQWHKVTANKIKHRIELTVDGNQVEAQSPNPASTSADTNDPVFVGGFPDDLKQFGLTTSIPFRGCIRSLKLTKGTGKPLEVNFAKALELRGVQPVSCPAN

SEQ ID NO: 7644 - protein, 3121 aa, Homo Sapiens
MPGAAGVLLLLLLSGGLGGVQAQRPQQQRQSQAHQQRGLFPAVLNLASNALITTNATCGEKGPEMYCKLVEHVPGQPVRNPQCRICNQNSSNPNQRHPITNAIDGKNTWWQSPSIKNGIEYHYVTITLDLQQVFQIAYVIVKAANSPRPGNWILERSLDDVEYKPWQYHAVTDTECLTLYNIYPRTGPPSYAKDDEVICTSFYSKIHPLENGEIHISLINGRPSADDPSPELLEFTSARYIRLRFQRIRTLNADLMMFAHKDPREIDPIVTRRYYYSVKDISVGGMCICYGHARACPLDPATNKSRCECEHNTCGDSCDQCCPGFHQKPWRAGTFLTKTECEACNCHGKAEECYYDENVARRNLSLNIRGKYIGGGVCINCTQNTAGINCETCTDGFFRPKGVSPNYPRPCQPCHCDPIGSLNEVCVKDEKHARRGLAPGSCHCKTGFGGVSCDRCARGYTGYPDCKACNCSGLGSKNEDPCFGPCICKENVEGGDCSRCKSGFFNLQEDNWKGCDECFCSGVSNRCQSSYWTYGKIQDMSGWYLTDLPGRIRVAPQQDDLDSPQQISISNAEARQALPHSYYWSAPAPYLGNKLPAVGGQLTFTISYDLEEEEEDTERVLQLMIILEGNDLSISTAQDEVYLHPSEEHTNVLLLKEESFTIHGTHFPVRRKEFMTVLANLKRVLLQITYSFGMDAIFRLSSVNLESAVSYPTDGSIAAAVEVCQCPPGYTGSSCESCWPRHRRVNGTIFGGICEPCQCFGHAESCDDVTGECLNCKDHTGGPYCDKCLPGFYGEPTKGTSEDCQPCACPLNIPSNNFSPTCHLDRSLGLICDGCPVGYTGPRCERCAEGYFGQPSVPGGSCQPCQCNDNLDFSIPGSCDSLSGSCLICKPGTTGRYCELCADGYFGDAVDAKNCQPCRCNAGGSFSEVCHSQTGQCECRANVQGQRCDKCKAGTFGLQSARGCVPCNCNSFGSKSFDCEESGQCWCQPGVTGKKCDRCAHGYFNFQEGGCTACECSHLGNNCDPKTGRCICPPNTIGEKCSKCAPNTWGHSITTGCKACNCSTVGSLDFQCNVNTGQCNCHPKFSGAKCTECSRGHWNYPRCNLCDCFLPGTDATTCDSETKKCSCSDQTGQCTCKVNVEGIHCDRCRPGKFGLDAKNPLGCSSCYCFGTTTQCSEAKGLIRTWVTLKAEQTILPLVDEALQHTTTKGIVFQHPEIVAHMDLMREDLHLEPFYWKLPEQFEGKKLMAYGGKLKYAIYFEAREETGFSTYNPQVIIRGGTPTHARIIVRHMAAPLIGQLTRHEIEMTEKEWKYYGDDPRVHRTVTREDFLDILYDIHYILIKATYGNFMRQSRISEISMEVAEQGRGTTMTPPADLIEKCDCPLGYSGLSCEACLPGFYRLRSQPGGRTPGPTLGTCVPCQCNGHSSLCDPETSICQNCQHHTAGDFCERCALGYYGIVKGLPNDCQQCACPLISSSNNFSPSCVAEGLDDYRCTACPRGYEGQYCERCAPGYTGSPGNPGGSCQECECDPYGSLPVPCDPVTGFCTCRPGATGRKCDGCKHWHAREGWECVFCGDECTGLLLGDLARLEQMVMSINLTGPLPAPYKMLYGLENMTQELKHLLSPQRAPERLIQLAEGNLNTLVTEMNELLTRATKVTADGEQTGQDAERTNTRAKSLGEFIKELARDAEAVNEKAIKLNETLGTRDEAFERNLEGLQKEIDQMIKELRRKNLETQKEIAEDELVAAEALLKKVKKLFGESRGENEEMEKDLREKLADYKNKVDDAWDLLREATDKIREANRLFAVNQKNMTALEKKKEAVESGKRQIENTLKEGNDILDEANRLADEINSIIDYVEDIQTKLPPMSEELNDKIDDLSQEIKDRKLAEKVSQAESHAAQLNDSSAVLDGILDEAKNISFNATAAFKAYSNIKDYIDEAEKVAKEAKDLAHEATKLATGPRGLLKEDAKGCLQKSFRILNEAKKLANDVKENEDHLNGLKTRIENADARNGDLLRTLNDTLGKLSAIPNDTAAKLQAVKDKARQANDTAKDVLAQITELHQNLDGLKKNYNKLADSVAKTNAVVKDPSKNTVADADATVKNLEQEADRLIDKLKPIKELEDNLKKNISEIKELINQARKQANSIKVSVSSGGDCIRTYKPEIKKGSYNNIVVNVKTAVADNLLFYLGSAKFIDFLAIEMRKGKVSFLWDVGSGVGRVEYPDLTIDDSYWYRIVASRTGRNGTISVRALDGPKASIVPSTHHSTSPPGYTILDVDANAMLFVGGLTGKLKKADAVRVITFTGCMGETYFDNKPIGLWNFREKEGDCKGCTVSPQVEDSEGTIQFDGEGYALVSRPIRWYPNISTVMFKFRTFSSSALLMYLATRDLRDFMSVELTDGHIKVSYDLGSGMASVVSNQNHNDGKWKSFTLSRIQKQANISIVDIDTNQEENIATSSSGNNFGLDLKADDKIYFGGLPTLRNLSMKARPEVNLKKYSGCLKDIEISRTPYNILSSPDYVGVTKGCSLENVYTVSFPKPGFVELSPVPIDVGTEINLSFSTKNESGIILLGSGGTPAPPRRKRRQTGQAYYAILLNRGRLEVHLSTGARTMRKIVIRPEPNLFHDGREHSVHVERTRGIFTVQVDENRRYMQNLTVEQPIEVKKLFVGGAPPEFQPSPLRNIPPFEGCIWNLVINSVPMDFARPVSFKNADIGRCAHQKLREDEDGAAPAEIVIQPEPVPTPAFPTPTPVLTHGPCAAESEPALLIGSKQFGLSRNSHIAIAFDDTKVKNRLTIELEVRTEAESGLLFYMARINHADFATVQLRNGLPYFSYDLGSGDTHTMIPTKINDGQWHKIKIMRSKQEGILYVDGASNRTISPKKADILDVVGMLYVGGLPINYTTRRIGPVTYSIDGCVRNLHMAEAPADLEQPTSSFHVGTCFANAQRGTYFDGTGFAKAVGGFKVGLDLLVEFEFRTTTTTGVLLGISSQKMDGMGIEMIDEKLMFHVDNGAGRFTAVYDAGVPGHLCDGQWHKVTANKIKHRIELTVDGNQVEAQSPNPASTSADTNDPVFVGGFPDDLKQFGLTTSIPFRGCIRSLKLTKGTGKPLEVNFAKALELRGVQPVSCPAN

SEQ ID NO: 7645 - protein, 3118 aa, Homo Sapiens
MPGAAGVLLLLLLSGGLGGVQAQRPQQQRQSQAHQQRGLFPAVLNLASNALITTNATCGEKGPEMYCKLVEHVPGQPVRNPQCRICNQNSSNPNQRHPITNAIDGKNTWWQSPSIKNGIEYHYVTITLDLQQVFQIAYVIVKAANSPRPGNWILERSLDDVEYKPWQYHAVTDTECLTLYNIYPRTGPPSYAKDDEVICTSFYSKIHPLENGEIHISLINGRPSADDPSPELLEFTSARYIRLRFQRIRTLNADLMMFAHKDPREIDPIVTRRYYYSVKDISVGGMCICYGHARACPLDPATNKSRCECEHNTCGDSCDQCCPGFHQKPWRAGTFLTKTECEACNCHGKAEECYYDENVARRNLSLNIRGKYIGGGVCINCTQNTAGINCETCTDGFFRPKGVSPNYPRPCQPCHCDPIGSLNEVCVKDEKHARRGLAPGSCHCKTGFGGVSCDRCARGYTGYPDCKACNCSGLGSKNEDPCFGPCICKENVEGGDCSRCKSGFFNLQEDNWKGCDECFCSGVSNRCQSSYWTYGKIQDMSGWYLTDLPGRIRVAPQQDDLDSPQQISISNAEARQALPHSYYWSAPAPYLGNKLPAVGGQLTFTISYDLEEEEEDTERVLQLMIILEGNDLSISTAQDEVYLHPSEEHTNVLLLKEESFTIHGTHFPVRRKEFMTVLANLKRVLLQITYSFGMDAIFRLSSVNLESAVSYPTDGSIAAAVEVCQCPPGYTGSSCESCWPRHRRVNGTIFGGICEPCQCFGHAESCDDVTGECLNCKDHTGGPYCDKCLPGFYGEPTKGTSEDCQPCACPLNIPSNNFSPTCHLDRSLGLICDGCPVGYTGPRCERCAEGYFGQPSVPGGSCQPCQCNDNLDFSIPGSCDSLSGSCLICKPGTTGRYCELCADGYFGDAVDAKNCQPCRCNAGGSFSEVCHSQTGQCECRANVQGQRCDKCKAGTFGLQSARGCVPCNCNSFGSKSFDCEESGQCWCQPGVTGKKCDRCAHGYFNFQEGGCTACECSHLGNNCDPKTGRCICPPNTIGEKCSKCAPNTWGHSITTGCKACNCSTVGSLDFQCNVNTGQCNCHPKFSGAKCTECSRGHWNYPRCNLCDCFLPGTDATTCDSETKKCSCSDQTGQCTCKVNVEGIHCDRCRPGKFGLDAKNPLGCSSCYCFGTTTQCSEAKGLIRTWVTLKAEQTILPLVDEALQHTTTKGIVFQHPEIVAHMDLMREDLHLEPFYWKLPEQFEGKKLMAYGGKLKYAIYFEAREETGFSTYNPQVIIRGGTPTHARIIVRHMAAPLIGQLTRHEIEMTEKEWKYYGDDPRVHRTVTREDFLDILYDIHYILIKATYGNFMRQSRISEISMEVAEQGRGTTMTPPADLIEKCDCPLGYSGLSCEACLPGFYRLRSQPGGRTPGPTLGTCVPCQCNGHSSLCDPETSICQNCQHHTAGDFCERCALGYYGIVKGLPNDCQQCACPLISSSNNFSPSCVAEGLDDYRCTACPRGYEGQYCERCAPGYTGSPGNPGGSCQECECDPYGSLPVPCDPVTGFCTCRPGATGRKCDGCKHWHAREGWECVFCGDECTGLLLGDLARLEQMVMSINLTGPLPAPYKMLYGLENMTQELKHLLSPQRAPERLIQLAEGNLNTLVTEMNELLTRATKVTADGEQTGQDAERTNTRAKSLGEFIKELARDAEAVNEKAIKLNETLGTRDEAFERNLEGLQKEIDQMIKELRRKNLETQKEIAEDELVAAEALLKKVKKLFGESRGENEEMEKDLREKLADYKNKVDDAWDLLREATDKIREANRLFAVNQKNMTALEKKKEAVESGKRQIENTLKEGNDILDEANRLADEINSIIDYVEDIQTKLPPMSEELNDKIDDLSQEIKDRKLAEKVSQAESHAAQLNDSSAVLDGILDEAKNISFNATAAFKAYSNIKDYIDEAEKVAKEAKDLAHEATKLATGPRGLLKEDAKGCLQKSFRILNEAKKLANDVKENEDHLNGLKTRIENADARNGDLLRTLNDTLGKLSAIPNDTAAKLQAVKDKARQANDTAKDVLAQITELHQNLDGLKKNYNKLADSVAKTNAVVKDPSKNNAVADADATVKNLEQEADRLIDKLKPIKELEDNLKKNISEIKELINQARKQANSIKVSVSSGGDCIRTYKPEIKKGSYNNIVVNVKTAVADNLLFYLGSAKFIDFLAIEMRKGKVSFLWDVGSGVGRVEYPDLTIDDSYWYRIVASRTGRNGTISVRALDGPKASIVPSTHHSTSPPGYTILDVDANAMLFVGGLTGKLKKADAVRVITFTGCMGETYFDNKPIGLWNFREKEGDCKGCTVSPQVEDSEGTIQFDGEGYALVSRPIRWYPNISTVMFKFRTFSSSALLMYLATRDLRDFMSVELTDGHIKVSYDLGSGMASVVSNQNHNDGKWKSFTLSRIQKQANISIVDIDTNQEENIATSSSGNNFGLDLKADDKIYFGGLPTLRNLRPEVNLKKYSGCLKDIEISRTPYNILSSPDYVGVTKGCSLENVYTVSFPKPGFVELSPVPIDVGTEINLSFSTKNESGIILLGSGGTPAPPRRKRRQTGQAYYAILLNRGRLEVHLSTGARTMRKIVIRPEPNLFHDGREHSVHVERTRGIFTVQVDENRRYMQNLTVEQPIEVKKLFVGGAPPEFQPSPLRNIPPFEGCIWNLVINSVPMDFARPVSFKNADIGRCAHQKLREDEDGAAPAEIVIQPEPVPTPAFPTPTPVLTHGPCAAESEPALLIGSKQFGLSRNSHIAIAFDDTKVKNRLTIELEVRTEAESGLLFYMARINHADFATVQLRNGLPYFSYDLGSGDTHTMIPTKINDGQWHKIKIMRSKQEGILYVDGASNRTISPKKADILDVVGMLYVGGLPINYTTRRIGPVTYSIDGCVRNLHMAEAPADLEQPTSSFHVGTCFANAQRGTYFDGTGFAKAVGGFKVGLDLLVEFEFRTTTTTGVLLGISSQKMDGMGIEMIDEKLMFHVDNGAGRFTAVYDAGVPGHLCDGQWHKVTANKIKHRIELTVDGNQVEAQSPNPASTSADTNDPVFVGGFPDDLKQFGLTTSIPFRGCIRSLKLTKGTGKPLEVNFAKALELRGVQPVSCPAN

SEQ ID NO: 7646 - protein, 184 aa, Homo Sapiens
  misc_feature (1)..(1): Xaa can be any naturally occurring amino acid
XCRCNAGGSFSEVCHSQTGQCECRANVQGQRCDKCKPNMWRDPEKRFCVLCDCDPVGSVSPQCDITGRCVCKSGFVGKQCNLGRQVHQQEEQPRRAQRVLGSPQRWAIGSSSGCPRGAYRAPAPAGTFGLQSARGCVPCNCNSFGSKSFDCEESGQCWCQPGVTGKKCDRCAHGYFNFQEGGCT

SEQ ID NO: 7647 - protein, 94 aa, Homo Sapiens
LVRSASFSRGGQLSFTDLGLPPTDHLQASFGFQTFQPSGILLDHQTWTRNLQVTLEDGYIELSTSDSGGPIFKSPQTYMDGLLHYVSVISDNSG

SEQ ID NO: 7648 - protein, 3333 aa, Homo Sapiens
MAAAARPRGRALGPVLPPTPLLLLVLRVLPACGATARDPGAAAGLSLHPTYFNLAEAARIWATATCGERGPGEGRPQPELYCKLVGGPTAPGSGHTIQGQFCDYCNSEDPRKAHPVTNAIDGSERWWQSPPLSSGTQYNRVNLTLDLGQLFHVAYILIKFANSPRPDLWVLERSVDFGSTYSPWQYFAHSKVDCLKEFGREANMAVTRDDDVLCVTEYSRIVPLENGEVVVSLINGRPGAKNFTFSHTLREFTKATNIRLRFLRTNTLLGHLISKAQRDPTVTRRYYYSIKDISIGGQCVCNGHAEVCNINNPEKLFRCECQHHTCGETCDRCCTGYNQRRWRPAAWEQSHECEACNCHGHASNCYYDPDVERQQASLNTQGIYAGGGVCINCQHNTAGVNCEQCAKGYYRPYGVPVDAPDGCIPCSCDPEHADGCEQGSGRCHCKPNFHGDNCEKCAIGYYNFPFCLRIPIFPVSTPSSEDPVAGDIKGCDCNLEGVLPEICDAHGRCLCRPGVEGPRCDTCRSGFYSFPICQACWCSALGSYQMPCSSVTGQCECRPGVTGQRCDRCLSGAYDFPHCQGSSSACDPAGTINSNLGYCQCKLHVEGPTCSRCKLLYWNLDKENPSGCSECKCHKAGTVSGTGECRQGDGDCHCKSHVGGDSCDTCEDGYFALEKSNYFGCQGCQCDIGGALSSMCSGPSGVCQCREHVVGKVCQRPENNYYFPDLHHMKYEIEDGSTPNGRDLRFGFDPLAFPEFSWRGYAQMTSVQNDVRITLNVGKSSGSLFRVILRYVNPGTEAVSGHITIYPSWGAAQSKEIIFLPSKEPAFVTVPGNGFADPFSITPGIWVACIKAEGVLLDYLVLLPRDYYEASVLQLPVTEPCAYAGPPQENCLLYQHLPVTRFPCTLACEARHFLLDGEPRPVAVRQPTPAHPVMVDLSGREVELHLRLRIPQVGHYVVVVEYSTEAAQLFVVDVNVKSSGSVLAGQVNIYSCNYSVLCRSAVIDHMSRIAMYELLADADIQLKGHMARFLLHQVCIIPIEEFSAEYVRPQVHCIASYGRFVNQSATCVSLAHETPPTALILDVLSGRPFPHLPQQSSPSVDVLPGVTLKAPQNQVTLRGRVPHLGRYVFVIHFYQAAHPTFPAQVSVDGGWPRAGSFHASFCPHVLGCRDQVIAEGQIEFDISEPEVAATVKVPEGKSLVLVRVLVVPAENYDYQILHKKSMDKSLEFITNCGKNSFYLDPQTASRFCKNSARSLVAFYHKGALPCECHPTGATGPHCSPEGGQCPCQPNVIGRQCTRCATGHYGFPRCKPCSCGRRLCEEMTGQCRCPPRTVRPQCEVCETHSFSFHPMAGCEGCNCSRRGTIEAAMPECDRDSGQCRCKPRITGRQCDRCASGFYRFPECVPCNCNRDGTEPGVCDPGTGACLCKENVEGTECNVCREGSFHLDPANLKGCTSCFCFGVNNQCHSSHKRRTKFVDMLGWHLETADRVDIPVSFNPGSNSMVADLQELPATIHSASWVAPTSYLGDKVSSYGGYLTYQAKSFGLPGDMVLLEKKPDVQLTGQHMSIIYEETNTPRPDRLHHGRVHVVEGNFRHASSRAPVSREELMTVLSRLADVRIQGLYFTETQRLTLSEVGLEEASDTGSGRIALAVEICACPPAYAGDSCQGCSPGYYRDHKGLYTGRCVPCNCNGHSNQCQDGSGICVNCQHNTAGEHCERCQEGYYGNAVHGSCRACPCPHTNSFATGCVVNGGDVRCSCKAGYTGTQCERCAPGYFGNPQKFGGSCQPCSCNSNGQLGSCHPLTGDCINQEPKDSSPAEECDDCDSCVMTLLNDLATMGEQLRLVKSQLQGLSASAGLLEQMRHMETQAKDLRNQLLNYRSAISNHGSKIEGLERELTDLNQEFETLQEKAQVNSRKAQTLNNNVNRATQSAKELDVKIKNVIRNVHILLKQISGTDGEGNNVPSGDFSREWAEAQRMMRELRNRNFGKHLREAEADKRESQLLLNRIRTWQKTHQGENNGLANSIRDSLNEYEAKLSDLRARLQEAAAQAKQANGLNQENERALGAIQRQVKEINSLQSDFTKYLTTADSSLLQTNIALQLMEKSQKEYEKLAASLNEARQELSDKVRELSRSAGKTSLVEEAEKHARSLQELAKQLEEIKRNASGDELVRCAVDAATAYENILNAIKAAEDAANRAASASESALQTVIKEDLPRKAKTLSSNSDKLLNEAKMTQKKLKQEVSPALNNLQQTLNIVTVQKEVIDTNLTTLRDGLHGIQRGDIDAMISSAKSMVRKANDITDEVLDGLNPIQTDVERIKDTYGRTQNEDFKKALTDADNSVNKLTNKLPDLWRKIESINQQLLPLGNISDNMDRIRELIQQARDAASKVAVPMRFNGKSGVEVRLPNDLEDLKGYTSLSLFLQRPNSRENGGTENMFVMYLGNKDASRDYIGMAVVDGQLTCVYNLGDREAELQVDQILTKSETKEAVMDRVKFQRIYQFARLNYTKGATSSKPETPGVYDMDGRNSNTLLNLDPENVVFYVGGYPPDFKLPSRLSFPPYKGCIELDDLNENVLSLYNFKKTFNLNTTEVEPCRRRKEESDKNYFEGTGYARVPTQPHAPIPTFGQTIQTTVDRGLLFFAENGDRFISLNIEDGKLMVRYKLNSELPKERGVGDAINNGRDHSIQIKIGKLQKRMWINVDVQNTIIDGEVFDFSTYYLGGIPIAIRERFNISTPAFRGCMKNLKKTSGVVRLNDTVGVTKKCSEDWKLVRSASFSRGGQLSFTDLGLPPTDHLQASFGFQTFQPSGILLDHQTWTRNLQVTLEDGYIELSTSDSGGPIFKSPQTYMDGLLHYVSVISDNSGLRLLIDDQLLRNSKRLKHISSSRQSLRLGGSNFEGCISNVFVQRLSLSPEVLDLTSNSLKRDVSLGGCSLNKPPFLMLLKGSTRFNKTKTFRINQLLQDTPVASPRSVKVWQDACSPLPKTQANHGALQFGDIPTSHLLFKLPQELLKPRSQFAVDMQTTSSRGLVFHTGTKNSFMALYLSKGRLVFALGTDGKKLRIKSKEKCNDGKWHTVVFGHDGEKGRLVVDGLRAREGSLPGNSTISIRAPVYLGSPPSGKPKSLPTNSFVGCLKNFQLDSKPLYTPSSSFGVSSCLGGPLEKGIYFSEEGGHVVLAHSVLLGPEFKLVFSIRPRSLTGILIHIGSQPGKHLCVYLEAGKVTASMDSGAGGTSTSVTPKQSLCDGQWHSVAVTIKQHILHLELDTDSSYTAGQIPFPPASTQEPLHLGGAPANLTTLRIPVWKSFFGCLRNIHVNHIPVPVTEALEVQGPVSLNGCPDQ

SEQ ID NO: 7649 - protein, 3277 aa, Homo Sapiens
MAAAARPRGRALGPVLPPTPLLLLVLRVLPACGATARDPGAAAGLSLHPTYFNLAEAARIWATATCGERGPGEGRPQPELYCKLVGGPTAPGSGHTIQGQFCDYCNSEDPRKAHPVTNAIDGSERWWQSPPLSSGTQYNRVNLTLDLGQLFHVAYILIKFANSPRPDLWVLERSVDFGSTYSPWQYFAHSKVDCLKEFGREANMAVTRDDDVLCVTEYSRIVPLENGEVVVSLINGRPGAKNFTFSHTLREFTKATNIRLRFLRTNTLLGHLISKAQRDPTVTRRYYYSIKDISIGGQCVCNGHAEVCNINNPEKLFRCECQHHTCGETCDRCCTGYNQRRWRPAAWEQSHECEACNCHGHASNCYYDPDVERQQASLNTQGIYAGGGVCINCQHNTAGVNCEQCAKGYYRPYGVPVDAPDGCIPCSCDPEHADGCEQGSGRCHCKPNFHGDNCEKCAIGYYNFPFCLRIPIFPVSTPSSEDPVAGDIKGCDCNLEGVLPEICDAHGRCLCRPGVEGPRCDTCRSGFYSFPICQACWCSALGSYQMPCSSVTGQCECRPGVTGQRCDRCLSGAYDFPHCQGSSSACDPAGTINSNLGYCQCKLHVEGPTCSRCKLLYWNLDKENPSGCSECKCHKAGTVSGTGECRQGDGDCHCKSHVGGDSCDTCEDGYFALEKSNYFGCQGCQCDIGGALSSMCSGPSGVCQCREHVVGKVCQRPENNYYFPDLHHMKYEIEDGSTPNGRDLRFGFDPLAFPEFSWRGYAQMTSVQNDVRITLNVGKSSGSLFRVILRYVNPGTEAVSGHITIYPSWGAAQSKEIIFLPSKEPAFVTVPGNGFADPFSITPGIWVACIKAEGVLLDYLVLLPRDYYEASVLQLPVTEPCAYAGPPQENCLLYQHLPVTRFPCTLACEARHFLLDGEPRPVAVRQPTPAHPVMVDLSGREVELHLRLRIPQVGHYVVVVEYSTEAAQLFVVDVNVKSSGSVLAGQVNIYSCNYSVLCRSAVIDHMSRIAMYELLADADIQLKGHMARFLLHQVCIIPIEEFSAEYVRPQVHCIASYGRFVNQSATCVSLAHETPPTALILDVLSGRPFPHLPQQSSPSVDVLPGVTLKAPQNQVTLRGRVPHLGRYVFVIHFYQAAHPTFPAQVSVDGGWPRAGSFHASFCPHVLGCRDQVIAEGQIEFDISEPEVAATVKVPEGKSLVLVRVLVVPAENYDYQILHKKSMDKSLEFITNCGKNSFYLDPQTASRFCKNSARSLVAFYHKGALPCECHPTGATGPHCSPEGGQCPCQPNVIGRQCTRCATGHYGFPRCKPCSCGRRLCEEMTGQCRCPPRTVRPQCEVCETHSFSFHPMAGCEGCNCSRRGTIEAAMPECDRDSGQCRCKPRITGRQCDRCASGFYRFPECVPCNCNRDGTEPGVCDPGTGACLCKENVEGTECNVCREGSFHLDPANLKGCTSCFCFGVNNQCHSSHKRRTKFVDMLGWHLETADRVDIPVSFNPGSNSMVADLQELPATIHSASWVAPTSYLGDKVSSYGGYLTYQAKSFGLPGDMVLLEKKPDVQLTGQHMSIIYEETNTPRPDRLHHGRVHVVEGNFRHASSRAPVSREELMTVLSRLADVRIQGLYFTETQRLTLSEVGLEEASDTGSGRIALAVEICACPPAYAGDSCQGCSPGYYRDHKGLYTGRCVPCNCNGHSNQCQDGSGICVNCQHNTAGEHCERCQEGYYGNAVHGSCRACPCPHTNSFATGCVVNGGDVRCSCKAGYTGTQCERCAPGYFGNPQKFGGSCQPCSCNSNGQLGSCHPLTGDCINQEPKDSSPAEECDDCDSCVMTLLNDLATMGEQLRLVKSQLQGLSASAGLLEQMRHMETQAKDLRNQLLNYRSAISNHGSKIEGLERELTDLNQEFETLQEKAQVNSRKAQTLNNNVNRATQSAKELDVKIKNVIRNVHMLNRIRTWQKTHQGENNGLANSIRDSLNEYEAKLSDLRARLQEAAAQAKQANGLNQENERALGAIQRQVKEINSLQSDFTKYLTTADSSLLQTNIALQLMEKSQKEYEKLAASLNEARQELSDKVRELSRSAGKTSLVEEAEKHARSLQELAKQLEEIKRNASGDELVRCAVDAATAYENILNAIKAAEDAANRAASASESALQTVIKEDLPRKAKTLSSNSDKLLNEAKMTQKKLKQEVSPALNNLQQTLNIVTVQKEVIDTNLTTLRDGLHGIQRGDIDAMISSAKSMVRKANDITDEVLDGLNPIQTDVERIKDTYGRTQNEDFKKALTDADNSVNKLTNKLPDLWRKIESINQQLLPLGNISDNMDRIRELIQQARDAASKVAVPMRFNGKSGVEVRLPNDLEDLKGYTSLSLFLQRPNSRENGGTENMFVMYLGNKDASRDYIGMAVVDGQLTCVYNLGDREAELQVDQILTKSETKEAVMDRVKFQRIYQFARLNYTKGATSSKPETPGVYDMDGRNSNTLLNLDPENVVFYVGGYPPDFKLPSRLSFPPYKGCIELDDLNENVLSLYNFKKTFNLNTTEVEPCRRRKEESDKNYFEGTGYARVPTQPHAPIPTFGQTIQTTVDRGLLFFAENGDRFISLNIEDGKLMVRYKLNSELPKERGVGDAINNGRDHSIQIKIGKLQKRMWINVDVQNTIIDGEVFDFSTYYLGGIPIAIRERFNISTPAFRGCMKNLKKTSGVVRLNDTVGVTKKCSEDWKLVRSASFSRGGQLSFTDLGLPPTDHLQASFGFQTFQPSGILLDHQTWTRNLQVTLEDGYIELSTSDSGGPIFKSPQTYMDGLLHYVSVISDNSGLRLLIDDQLLRNSKRLKHISSSRQSLRLGGSNFEGCISNVFVQRLSLSPEVLDLTSNSLKRDVSLGGCSLNKPPFLMLLKGSTRFNKTKTFRINQLLQDTPVASPRSVKVWQDACSPLPKTQANHGALQFGDIPTSHLLFKLPQELLKPRSQFAVDMQTTSSRGLVFHTGTKNSFMALYLSKGRLVFALGTDGKKLRIKSKEKCNDGKWHTVVFGHDGEKGRLVVDGLRAREGSLPGNSTISIRAPVYLGSPPSGKPKSLPTNSFVGCLKNFQLDSKPLYTPSSSFGVSSCLGGPLEKGIYFSEEGGHVVLAHSVLLGPEFKLVFSIRPRSLTGILIHIGSQPGKHLCVYLEAGKVTASMDSGAGGTSTSVTPKQSLCDGQWHSVAVTIKQHILHLELDTDSSYTAGQIPFPPASTQEPLHLGGAPANLTTLRIPVWKSFFGCLRNIHVNHIPVPVTEALEVQGPVSLNGCPDQ

SEQ ID NO: 7650 - protein, 576 aa, Homo Sapiens
MAAAARPRGRALGPVLPPTPLLLLVLRVLPACGATARDPGAAAGLSLHPTYFNLAEAARIWATATCGERGPGEGRPQPELYCKLVGGPTAPGSGHTIQGQFCDYCNSEDPRKAHPVTNAIDGSERWWQSPPLSSGTQYNRVNLTLDLGQLFHVAYILIKFANSPRPDLWVLERSVDFGSTYSPWQYFAHSKVDCLKEFGREANMAVTRDDDVLCVTEYSRIVPLENGEVVVSLINGRPGAKNFTFSHTLREFTKATNIRLRFLRTNTLLGHLISKAQRDPTVTRRYYYSIKDISIGGQCVCNGHAEVCNINNPEKLFRCECQHHTCGETCDRCCTGYNQRRWRPAAWEQSHECEACNCHGHASNCYYDPDVERQQASLNTQGIYAGGGVCINCQHNTAGVNCEQCAKGYYRPYGVPVDAPDGCIPCSCDPEHADGCEQGSGRCHCKPNFHGDNCEKCAIGYYNFPFCLRIPIFPVSTPSSEDPVAGDIKGCDCNLEGVLPEICDAHGRCLCRPGVEGPRCDTCRSGFYSFPICQGPSEKVAIYKPESRPSAETEPASTWILDFPASRTGEINFYCL

SEQ ID NO: 7651 - protein, 1724 aa, Homo Sapiens
MPPAVRRSACSMGWLWIFGAALGQCLGYSSQQQRVPFLQPPGQSQLQASYVEFRPSQGCSPGYYRDHKGLYTGRCVPCNCNGHSNQCQDGSGICVNCQHNTAGEHCERCQEGYYGNAVHGSCRACPCPHTNSFATGCVVNGGDVRCSCKAGYTGTQCERCAPGYFGNPQKFGGSCQPCSCNSNGQLGSCHPLTGDCINQEPKDSSPAEECDDCDSCVMTLLNDLATMGEQLRLVKSQLQGLSASAGLLEQMRHMETQAKDLRNQLLNYRSAISNHGSKIEGLERELTDLNQEFETLQEKAQVNSRKAQTLNNNVNRATQSAKELDVKIKNVIRNVHILLKQISGTDGEGNNVPSGDFSREWAEAQRMMRELRNRNFGKHLREAEADKRESQLLLNRIRTWQKTHQGENNGLANSIRDSLNEYEAKLSDLRARLQEAAAQAKQANGLNQENERALGAIQRQVKEINSLQSDFTKYLTTADSSLLQTNIALQLMEKSQKEYEKLAASLNEARQELSDKVRELSRSAGKTSLVEEAEKHARSLQELAKQLEEIKRNASGDELVRCAVDAATAYENILNAIKAAEDAANRAASASESALQTVIKEDLPRKAKTLSSNSDKLLNEAKMTQKKLKQEVSPALNNLQQTLNIVTVQKEVIDTNLTTLRDGLHGIQRGDIDAMISSAKSMVRKANDITDEVLDGLNPIQTDVERIKDTYGRTQNEDFKKALTDADNSVNKLTNKLPDLWRKIESINQQLLPLGNISDNMDRIRELIQQARDAASKVAVPMRFNGKSGVEVRLPNDLEDLKGYTSLSLFLQRPNSRENGGTENMFVMYLGNKDASRDYIGMAVVDGQLTCVYNLGDREAELQVDQILTKSETKEAVMDRVKFQRIYQFARLNYTKGATSSKPETPGVYDMDGRNSNTLLNLDPENVVFYVGGYPPDFKLPSRLSFPPYKGCIELDDLNENVLSLYNFKKTFNLNTTEVEPCRRRKEESDKNYFEGTGYARVPTQPHAPIPTFGQTIQTTVDRGLLFFAENGDRFISLNIEDGKLMVRYKLNSELPKERGVGDAINNGRDHSIQIKIGKLQKRMWINVDVQNTIIDGEVFDFSTYYLGGIPIAIRERFNISTPAFRGCMKNLKKTSGVVRLNDTVGVTKKCSEDWKLVRSASFSRGGQLSFTDLGLPPTDHLQASFGFQTFQPSGILLDHQTWTRNLQVTLEDGYIELSTSDSGGPIFKSPQTYMDGLLHYVSVISDNSGLRLLIDDQLLRNSKRLKHISSSRQSLRLGGSNFEGCISNVFVQRLSLSPEVLDLTSNSLKRDVSLGGCSLNKPPFLMLLKGSTRFNKTKTFRINQLLQDTPVASPRSVKVWQDACSPLPKTQANHGALQFGDIPTSHLLFKLPQELLKPRSQFAVDMQTTSSRGLVFHTGTKNSFMALYLSKGRLVFALGTDGKKLRIKSKEKCNDGKWHTVVFGHDGEKGRLVVDGLRAREGSLPGNSTISIRAPVYLGSPPSGKPKSLPTNSFVGCLKNFQLDSKPLYTPSSSFGVSSCLGGPLEKGIYFSEEGGHVVLAHSVLLGPEFKLVFSIRPRSLTGILIHIGSQPGKHLCVYLEAGKVTASMDSGAGGTSTSVTPKQSLCDGQWHSVAVTIKQHILHLELDTDSSYTAGQIPFPPASTQEPLHLGGAPANLTTLRIPVWKSFFGCLRNIHVNHIPVPVTEALEVQGPVSLNGCPDQ

SEQ ID NO: 7652 - protein, 1668 aa, Homo Sapiens
MPPAVRRSACSMGWLWIFGAALGQCLGYSSQQQRVPFLQPPGQSQLQASYVEFRPSQGCSPGYYRDHKGLYTGRCVPCNCNGHSNQCQDGSGICVNCQHNTAGEHCERCQEGYYGNAVHGSCRACPCPHTNSFATGCVVNGGDVRCSCKAGYTGTQCERCAPGYFGNPQKFGGSCQPCSCNSNGQLGSCHPLTGDCINQEPKDSSPAEECDDCDSCVMTLLNDLATMGEQLRLVKSQLQGLSASAGLLEQMRHMETQAKDLRNQLLNYRSAISNHGSKIEGLERELTDLNQEFETLQEKAQVNSRKAQTLNNNVNRATQSAKELDVKIKNVIRNVHMLNRIRTWQKTHQGENNGLANSIRDSLNEYEAKLSDLRARLQEAAAQAKQANGLNQENERALGAIQRQVKEINSLQSDFTKYLTTADSSLLQTNIALQLMEKSQKEYEKLAASLNEARQELSDKVRELSRSAGKTSLVEEAEKHARSLQELAKQLEEIKRNASGDELVRCAVDAATAYENILNAIKAAEDAANRAASASESALQTVIKEDLPRKAKTLSSNSDKLLNEAKMTQKKLKQEVSPALNNLQQTLNIVTVQKEVIDTNLTTLRDGLHGIQRGDIDAMISSAKSMVRKANDITDEVLDGLNPIQTDVERIKDTYGRTQNEDFKKALTDADNSVNKLTNKLPDLWRKIESINQQLLPLGNISDNMDRIRELIQQARDAASKVAVPMRFNGKSGVEVRLPNDLEDLKGYTSLSLFLQRPNSRENGGTENMFVMYLGNKDASRDYIGMAVVDGQLTCVYNLGDREAELQVDQILTKSETKEAVMDRVKFQRIYQFARLNYTKGATSSKPETPGVYDMDGRNSNTLLNLDPENVVFYVGGYPPDFKLPSRLSFPPYKGCIELDDLNENVLSLYNFKKTFNLNTTEVEPCRRRKEESDKNYFEGTGYARVPTQPHAPIPTFGQTIQTTVDRGLLFFAENGDRFISLNIEDGKLMVRYKLNSELPKERGVGDAINNGRDHSIQIKIGKLQKRMWINVDVQNTIIDGEVFDFSTYYLGGIPIAIRERFNISTPAFRGCMKNLKKTSGVVRLNDTVGVTKKCSEDWKLVRSASFSRGGQLSFTDLGLPPTDHLQASFGFQTFQPSGILLDHQTWTRNLQVTLEDGYIELSTSDSGGPIFKSPQTYMDGLLHYVSVISDNSGLRLLIDDQLLRNSKRLKHISSSRQSLRLGGSNFEGCISNVFVQRLSLSPEVLDLTSNSLKRDVSLGGCSLNKPPFLMLLKGSTRFNKTKTFRINQLLQDTPVASPRSVKVWQDACSPLPKTQANHGALQFGDIPTSHLLFKLPQELLKPRSQFAVDMQTTSSRGLVFHTGTKNSFMALYLSKGRLVFALGTDGKKLRIKSKEKCNDGKWHTVVFGHDGEKGRLVVDGLRAREGSLPGNSTISIRAPVYLGSPPSGKPKSLPTNSFVGCLKNFQLDSKPLYTPSSSFGVSSCLGGPLEKGIYFSEEGGHVVLAHSVLLGPEFKLVFSIRPRSLTGILIHIGSQPGKHLCVYLEAGKVTASMDSGAGGTSTSVTPKQSLCDGQWHSVAVTIKQHILHLELDTDSSYTAGQIPFPPASTQEPLHLGGAPANLTTLRIPVWKSFFGCLRNIHVNHIPVPVTEALEVQGPVSLNGCPDQ

SEQ ID NO: 7653 - protein, 59 aa, Homo Sapiens
  misc_feature (1)..(1): Xaa can be any naturally occurring amino acid
XAGQVNIYSCNYRCDAMNSLLSPQRLCQVPGCIAQGKRLILSNVRGCTPTFATHLQNWG

SEQ ID NO: 7654 - protein, 1147 aa, Homo Sapiens
  misc_feature (1)..(1): Xaa can be any naturally occurring amino acid
XFATGCVVNGGDVRCSCKAGYTGTQCERCAPGYFGNPQKFGGSCQPCSCNSNGQLGSCHPLTGDCINQEPKDSSPAEECDDCDSCVMTLLNDLATMGEQLRLVKSQLQGLSASAGLLEQMRHMETQAKDLRNQLLNYRSAISNHGSKIEGLERELTDLNQEFETLQEKAQVNSRKAQTLNNNVNRATQSAKELDVKIKNVIRNVHILLKQISGTDGEGNNVPSGDFSREWAEAQRMMRELRNRNFGKHLREAEADKRESQLLLNRIRTWQKTHQGENNGLANSIRDSLNEYEAKLSDLRARLQEAAAQAKQANGLNQENERALGAIQRQVKEINSLQSDFTKYLTTADSSLLQTNIALQLMEKSQKEYEKLAASLNEARQELSDKVRELSRSAGKTSLVEEAEKHARSLQELAKQLEEIKRNASGDELVRCAVDAATAYENILNAIKAAEDAANRAASASESALQTVIKEDLPRKAKTLSSNSDKLLNEAKMTQKKLKQEVSPALNNLQQTLNIVTVQKEVIDTNLTTLRDGLHGIQRGDIDAMISSAKSMVRKANDITDEVLDGLNPIQTDVERIKDTYGRTQNEDFKKALTDADNSVNKLTNKLPDLWRKIESINQQLLPLGNISDNMDRIRELIQQARDAASKVAVPMRFNGKSGVEVRLPNDLEDLKGYTSLSLFLQRPNSRENGGTENMFVMYLGNKDASRDYIGMAVVDGQLTCVYNLGDREAELQVDQILTKSETKEAVMDRVKFQRIYQFARLNYTKGATSSKPETPGVYDMDGRNSNTLLNLDPENVVFYVGGYPPDFKLPSRLSFPPYKGCIELDDLNENVLSLYNFKKTFNLNTTEVEPCRRRKEESDKNYFEGTGYARVPTQPHAPIPTFGQTIQTTVDRGLLFFAENGDRFISLNIEDGKLMVRYKLNSELPKERGVGDAINNGRDHSIQIKIGKLQKRMWINVDVQNTIIDGEVFDFSTYYLGGIPIAIRERFNISTPAFRGCMKNLKKTSGVVRLNDTVGVTKKCSEDWKLVRSASFSRGGQLSFTDLGLPPTDHLQASFGFQTFQPSGILLDHQTWTRNLQVTLEDGYIELSTSDSGGPIFKSPQTYMDGLLHYVSVISDNSGLRQEGCLRPRVRDQSWKHSETMSLRKLK

SEQ ID NO: 7655 - protein, 134 aa, Homo Sapiens
  misc_feature (1)..(1): Xaa can be any naturally occurring amino acid
XFSEEGGHVVLAHSVLLGPEFKLVFSIRPRSLTGILIHIGSQPGKHLCVYLEAGKVTASMDSGAGGTSTSVTPKQSLCDGQWHSVAANLTTLRIPVWKSFFGCLRNIHVNHIPVPVTEALEVQGPVSLNGCPDQ

SEQ ID NO: 7656 - protein, 37 aa, Homo Sapiens
  misc_feature (1)..(1): Xaa can be any naturally occurring amino acid
XGWTEGPGGKFAWKLHHQHQSASLPGITSIRETKGAG

SEQ ID NO: 7657 - protein, 81 aa, Homo Sapiens
MALSSAWRSVLPLWLLWSAACSRAASGDDNAFPFDIEGSSAVGRQDPPETSEPRVALGRLPPAAEKCNAGFFHTLSGECVP

SEQ ID NO: 7658 - protein, 88 aa, Homo Sapiens
MALSSAWRSVLPLWLLWSAACSRAASGDDNAFPFDIEGSSAVGRQDPPETSEPRVALGRLPPAAEKCNAGFFHTLSGECVPCDCNGNS

SEQ ID NO: 7659 - protein, 107 aa, Homo Sapiens
MALSSAWRSVLPLWLLWSAACSRAASGDDNAFPFDIEGSSAVGRQDPPETSEPRVALGRLPPAAEKCNAGFFHTLSGECVPCDCNGNSNECLDGSGYCVHCQRNTTG

SEQ ID NO: 7660 - protein, 1823 aa, Homo Sapiens
MALSSAWRSVLPLWLLWSAACSRAASGDDNAFPFDIEGSSAVGRQDPPETSEPRVALGRLPPAAEKCNAGFFHTLSGECVPCDCNGNSNECLDGSGYCVHCQRNTTGEHCEKCLDGYIGDSIRGAPQFCQPCPCPLPHLANFAESCYRKNGAVRCICNENYAGPNCERCAPGYYGNPLLIGSTCKKCDCSGNSDPNLIFEDCDEVTGQCRNCLRNTTGFKCERCAPGYYGDARIAKNCAVCNCGGGPCDSVTGECLEEGFEPPTGMDCPTISCDKCVWDLTDDLRLAALSIEEGKSGVLSVSSGAAAHRHVNEINATIYLLKTKLSERENQYALRKIQINNAENTMKSLLSDVEELVEKENQASRKGQLVQKESMDTINHASQLVEQAHDMRDKIQEINNKMLYYGEEHELSPKEISEKLVLAQKMLEEIRSRQPFFTQRELVDEEADEAYELLSQAESWQRLHNETRTLFPVVLEQLDDYNAKLSDLQEALDQALNYVRDAEDMNRATAARQRDHEKQQERVREQMEVVNMSLSTSADSLTTPRLTLSELDDIIKNASGIYAEIDGAKSELQVKLSNLSNLSHDLVQEAIDHAQDLQQEANELSRKLHSSDMNGLVQKALDASNVYENIVNYVSEANETAEFALNTTDRIYDAVSGIDTQIIYHKDESENLLNQARELQAKAESSSDEAVADTSRRVGGALARKSALKTRLSDAVKQLQAAERGDAQQRLGQSRLITEEANRTTMEVQQATAPMANNLTNWSQNLQHFDSSAYNTAVNSARDAVRNLTEVVPQLLDQLRTVEQKRPASNVSASIQRIRELIAQTRSVASKIQVSMMFDGQSAVEVHSRTSMDDLKAFTSLSLYMKPPVKRPELTETADQFILYLGSKNAKKEYMGLAIKNDNLVYVYNLGTKDVEIPLDSKPVSSWPAYFSIVKIERVGKHGKVFLTVPSLSSTAEEKFIKKGEFSGDDSLLDLDPEDTVFYVGGVPSNFKLPTSLNLPGFVGCLELATLNNDVISLYNFKHIYNMDPSTSVPCARDKLAFTQSRAASYFFDGSGYAVVRDITRRGKFGQVTRFDIEVRTPADNGLILLMVNGSMFFRLEMRNGYLHVFYDFGFSGGPVHLEDTLKKAQINDAKYHEISIIYHNDKKMILVVDRRHVKSMDNEKMKIPFTDIYIGGAPPEILQSRALRAHLPLDINFRGCMKGFQFQKKDFNLLEQTETLGVGYGCPEDSLISRRAYFNGQSFIASIQKISFFDGFEGGFNFRTLQPNGLLFYYASGSDVFSISLDNGTVIMDVKGIKVQSVDKQYNDGLSHFVISSVSPTRYELIVDKSRVGSKNPTKGKIEQTQASEKKFYFGGSPISAQYANFTGCISNAYFTRVDRDVEVEDFQRYTEKVHTSLYECPIESSPLFLLHKKGKNLSKPKASQNKKGGKSKDAPSWDPVALKLPERNTPRNSHCHLSNSPRAIEHAYQYGGTANSRQEFEHLKGDFGAKSQFSIRLRTRSSHGMIFYVSDQEENDFMTLFLAHGRLVYMFNVGHKKLKIRSQEKYNDGLWHDVIFIRERSSGRLVIDGLRVLEESLPPTEATWKIKGPIYLGGVAPGKAVKNVQINSIYSFSGCLSNLQLNGASITSASQTFSVTPCFEGPMETGTYFSTEGGYVVLDESFNIGLKFEIAFEVRPRSSSGTLVHGHSVNGEYLNVHMKNGQVIVKVNNGIRDFSTSVTPKQSLCDGRWHRITVIRDSNVVQLDVDSEVNHVVGPLNPKPIDHREPVFVGGVPESLLTPRLAPSKPFTGCIRHFVIDGHPVSFSKAALVSGAVSINSCPAA

SEQ ID NO: 7661 - protein, 1816 aa, Homo Sapiens
MALSSAWRSVLPLWLLWSAACSRAASGDDNAFPFDIEGSSAVGRQDPPETSEPRVALGRLPPAAEKCNAGFFHTLSGECVPCDCNGNSNECLDGSGYCVHCQRNTTGEHCEKCLDGYIGDSIRGAPQFCQPCPCPLPHLANFAESCYRKNGAVRCICNENYAGPNCERCAPGYYGNPLLIGSTCKKCDCSGNSDPNLIFEDCDEVTGQCRNCLRNTTGFKCERCAPGYYGDARIAKNCAVCNCGGGPCDSVTGECLEEGFEPPTGCDKCVWDLTDDLRLAALSIEEGKSGVLSVSSGAAAHRHVNEINATIYLLKTKLSERENQYALRKIQINNAENTMKSLLSDVEELVEKENQASRKGQLVQKESMDTINHASQLVEQAHDMRDKIQEINNKMLYYGEEHELSPKEISEKLVLAQKMLEEIRSRQPFFTQRELVDEEADEAYELLSQAESWQRLHNETRTLFPVVLEQLDDYNAKLSDLQEALDQALNYVRDAEDMNRATAARQRDHEKQQERVREQMEVVNMSLSTSADSLTTPRLTLSELDDIIKNASGIYAEIDGAKSELQVKLSNLSNLSHDLVQEAIDHAQDLQQEANELSRKLHSSDMNGLVQKALDASNVYENIVNYVSEANETAEFALNTTDRIYDAVSGIDTQIIYHKDESENLLNQARELQAKAESSSDEAVADTSRRVGGALARKSALKTRLSDAVKQLQAAERGDAQQRLGQSRLITEEANRTTMEVQQATAPMANNLTNWSQNLQHFDSSAYNTAVNSARDAVRNLTEVVPQLLDQLRTVEQKRPASNVSASIQRIRELIAQTRSVASKIQVSMMFDGQSAVEVHSRTSMDDLKAFTSLSLYMKPPVKRPELTETADQFILYLGSKNAKKEYMGLAIKNDNLVYVYNLGTKDVEIPLDSKPVSSWPAYFSIVKIERVGKHGKVFLTVPSLSSTAEEKFIKKGEFSGDDSLLDLDPEDTVFYVGGVPSNFKLPTSLNLPGFVGCLELATLNNDVISLYNFKHIYNMDPSTSVPCARDKLAFTQSRAASYFFDGSGYAVVRDITRRGKFGQVTRFDIEVRTPADNGLILLMVNGSMFFRLEMRNGYLHVFYDFGFSGGPVHLEDTLKKAQINDAKYHEISIIYHNDKKMILVVDRRHVKSMDNEKMKIPFTDIYIGGAPPEILQSRALRAHLPLDINFRGCMKGFQFQKKDFNLLEQTETLGVGYGCPEDSLISRRAYFNGQSFIASIQKISFFDGFEGGFNFRTLQPNGLLFYYASGSDVFSISLDNGTVIMDVKGIKVQSVDKQYNDGLSHFVISSVSPTRYELIVDKSRVGSKNPTKGKIEQTQASEKKFYFGGSPISAQYANFTGCISNAYFTRVDRDVEVEDFQRYTEKVHTSLYECPIESSPLFLLHKKGKNLSKPKASQNKKGGKSKDAPSWDPVALKLPERNTPRNSHCHLSNSPRAIEHAYQYGGTANSRQEFEHLKGDFGAKSQFSIRLRTRSSHGMIFYVSDQEENDFMTLFLAHGRLVYMFNVGHKKLKIRSQEKYNDGLWHDVIFIRERSSGRLVIDGLRVLEESLPPTEATWKIKGPIYLGGVAPGKAVKNVQINSIYSFSGCLSNLQLNGASITSASQTFSVTPCFEGPMETGTYFSTEGGYVVLDESFNIGLKFEIAFEVRPRSSSGTLVHGHSVNGEYLNVHMKNGQVIVKVNNGIRDFSTSVTPKQSLCDGRWHRITVIRDSNVVQLDVDSEVNHVVGPLNPKPIDHREPVFVGGVPESLLTPRLAPSKPFTGCIRHFVIDGHPVSFSKAALVSGAVSINSCPAA

SEQ ID NO: 7662 - protein, 1816 aa, Homo Sapiens; identical to SEQ ID NO: 7661

SEQ ID NO: 7663 - protein, 1816 aa, Homo Sapiens; identical to SEQ ID NO: 7661

SEQ ID NO: 7664 - protein, 331 aa, Homo Sapiens
MALSSAWRSVLPLWLLWSAACSRAASGDDNAFPFDIEGSSAVGRQDPPETSEPRVALGRLPPAAEKCNAGFFHTLSGECVPCDCNGNSNECLDGSGYCVHCQRNTTGEHCEKCLDGYIGDSIRGAPQFCQPCPCPLPHLANFAESCYRKNGAVRCICNENYAGPNCERCAPGYYGNPLLIGSTCKKCDCSGNSDPNLIFEDCDEVTGQCRNCLRNTTGFKCERCAPGYYGDARIAKNCAVCNCGGGPCDSVTGECLEEGFEPPTGMDCPTISCDKCVWDLTDDLRLAALSIEEGKSGVLSVSSGAAAHRHVNEINATIYLLKTKLSERENQ

SEQ ID NO: 7665 - protein, 129 aa, Homo Sapiens
MALSSAWRSVLPLWLLWSAACSRAASGDDNAFPFDIEGSSAVGRQDPPETSEPRVALGRLPPAAEKCNAGFFHTLSGECVPCDCNGNSNECLDGSGYCVTTDGEDPGFSASALSFILSSQGAREARAPT

SEQ ID NO: 7666 - protein, 120 aa, Homo Sapiens
MALSSAWRSVLPLWLLWSAACSRAASGDDNAFPFDIEGSSAVGRQDPPETSEPRVALGRLPPAAEVQCPCHCHPAGAPAPPRAVPHSSFSLSPPLSSPQCLESFTWARSVRKLEIKSFPL

SEQ ID NO: 7667 - protein, 120 aa, Homo Sapiens; identical to SEQ ID NO: 7666

SEQ ID NO: 7668 - protein, 120 aa, Homo Sapiens; identical to SEQ ID NO: 7666

SEQ ID NO: 7669 - protein, 178 aa, Homo Sapiens
  misc_feature (1)..(1): Xaa can be any naturally occurring amino acid
XIFEDCDEVTGQCRNCLRNTTGFKCERCAPGYYGDARIAKNCAVCNCGGGPCDSVTGECLEEGFEPPTGMDCPTISCDKCVWDLTDDLRLAALSIEEGKSGVLSVSSGAAAHRHVNEINATIYLLKTKLSERENQYALRKIQINNAENTMKSLLSDVEELVEKHWNKPRRRLELQEGV

SEQ ID NO: 7670 - protein, 188 aa, Homo Sapiens
  misc_feature (1)..(1): Xaa can be any naturally occurring amino acid
XKNASGIYAEIDGAKSELQVKLSNLSNLSHDLVQEAIDHAQDLQQEANELSRKLHSSDMNGLVQKALDASNVYENIVNYVSEANETAEFALNTTDRIYDAVSGIDTQIIYHKDESENLLNQARELQAKAESSSDEAVADTSRRVGGALARKSALKTRLSDAVKQLQAAERGKHQRELKSHLLIHWSVR

SEQ ID NO: 7671 - protein, 187 aa, Homo Sapiens
  misc_feature (1)..(1): Xaa can be any naturally occurring amino acid
XSTCKKCDCSGNSDPNLIFEDCDEVTGQCRNCLRNTTGFKCERCAPGYYGDARIAKNCAVCNCGGGPCDSVTGECLEEGFEPPTGCDKCVWDLTDDLRLAALSIEEGKSGVLSVSSGAAAHRHVNEINATIYLLKTKLSERENQYALRKIQINNAENTMKSLLSDVEELVEKHWNKPRRRLELQEGV

SEQ ID NO: 7672 - protein, 38 aa, Homo Sapiens
CVPGAYNFPYCEGAVWWDGTSVAAEGAGRCVFSGRPCG

SEQ ID NO: 7673 - protein, 3695 aa, Homo Sapiens
MAKRLCAGSALCVRGPRGPAPLLLVGLALLGAARAREEAGGGFSLHPPYFNLAEGARIAASATCGEEAPARGSPRPTEDLYCKLVGGPVAGGDPNQTIRGQYCDICTAANSNKAHPASNAIDGTERWWQSPPLSRGLEYNEVNVTLDLGQVFHVAYVLIKFANSPRPDLWVLERSMDFGRTYQPWQFFASSKRDCLERFGPQTLERITRDDAAICTTEYSRIVPLENGEIVVSLVNGRPGAMNFSYSPLLREFTKATNVRLRFLRTNTLLGHLMGKALRDPTVTRRYYYSIKDISIGGRCVCHGHADACDAKDPTDPFRLQCTCQHNTCGGTCDRCCPGFNQQPWKPATANSANECQSCNCYGHATDCYYDPEVDRRRASQSLDGTYQGGGVCIDCQHHTTGVNCERCLPGFYRSPNHPLDSPHVCRRCNCESDFTDGTCEDLTGRCYCRPNFSGERCDVCAEGFTGFPSCYPTPSSSNDTREQVLPAGQIVNCDCSAAGTQGNACRKDPRVGRCLCKPNFQGTHCELCAPGFYGPGCQPCQCSSPGVADDRCDPDTGQCRCRVGFEGATCDRCAPGYFHFPLCQLCGCSPAGTLPEGCDEAGRCLCQPEFAGPHCDRCRPGYHGFPNCQACTCDPRGALDQLCGAGGLCRCRPGYTGTACQECSPGFHGFPSCVPCHCSAEGSLHAACDPRSGQCSCRPRVTGLRCDTCVPGAYNFPYCEAGSCHPAGLAPVDPALPEAQVPCMCRAHVEGPSCDRCKPGFWGLSPSNPEGCTRCSCDLRGTLGGVAECQPGTGQCFCKPHVCGQACASCKDGFFGLDQADYFGCRSCRCDIGGALGQSCEPRTGVCRCRPNTQGPTCSEPARDHYLPDLHHLRLELEEAATPEGHAVRFGFNPLEFENFSWRGYAQMAPVQPRIVARLNLTSPDLFWLVFRYVNRGAMSVSGRVSVREEGRSATCANCTAQSQPVAFPPSTEPAFITVPQRGFGEPFVLNPGTWALRVEAEGVLLDYVVLLPSAYYEAALLQLRVTEACTYRPSAQQSGDNCLLYTHLPLDGFPSAAGLEALCRQDNSLPRPCPTEQLSPSHPPLITCTGSDVDVQLQVAVPQPGRYALVVEYANEDARQEVGVAVHTPQRAPQQGLLSLHPCLYSTLCRGTARDTQDHLAVFHLDSEASVRLTAEQARFFLHGVTLVPIEEFSPEFVEPRVSCISSHGAFGPNSAACLPSRFPKPPQPIILRDCQVIPLPPGLPLTHAQDLTPAMSPAGPRPRPPTAVDPDAEPTLLREPQATVVFTTHVPTLGRYAFLLHGYQPAHPTFPVEVLINAGRVWQGHANASFCPHGYGCRTLVVCEGQALLDVTHSELTVTVRVPKGRWLWLDYVLVVPENVYSFGYLREEPLDKSYDFISHCAAQGYHISPSSSSLFCRNAAASLSLFYNNGARPCGCHEVGATGPTCEPFGGQCPCHAHVIGRDCSRCATGYWGFPNCRPCDCGARLCDELTGQCICPPRTIPPDCLLCQPQTFGCHPLVGCEECNCSGPGIQELTDPTCDTDSGQCKCRPNVTGRRCDTCSPGFHGYPRCRPCDCHEAGTAPGVCDPLTGQCYCKENVQGPKCDQCSLGTFSLDAANPKGCTRCFCFGATERCRSSSYTRQEFVDMEGWVLLSTDRQVVPHERQPGTEMLRADLRHVPEAVPEAFPELYWQAPPSYLGDRVSSYGGTLRYELHSETQRGDVFVPMESRPDVVLQGNQMSITFLEPAYPTPGHVHRGQLQLVEGNFRHTETRNTVSREELMMVLASLEQLQIRALFSQISSAVFLRRVALEVASPAGQGALASNVELCLCPASYRGDSCQECAPGFYRDVKGLFLGRCVPCQCHGHSDRCLPGSGVCVDCQHNTEGAHCERCQAGFVSSRDDPSAPCVSCPCPLSVPSNNFAEGCVLRGGRTQCLCKPGYAGASCERCAPGFFGNPLVLGSSCQPCDCSGNGDPNLLFSDCDPLTGACRGCLRHTTGPRCEICAPGFYGNALLPGNCTRCDCTPCGTEACDPHSGHCLCKAGVTGRRCDRCQEGHFGFDGCGGCRPCACGPAAEGSECHPQSGQCHCRPGTMGPQCRECAPGYWGLPEQGCRRCQCPGGRCDPHTGRCNCPPGLSGERCDTCSQQHQVPVPGGPVGHSIHCEVCDHCVVLLLDDLERAGALLPAIHEQLRGINASSMAWARLHRLNASIADLQSQLRSPLGPRHETAQQLEVLEQQSTSLGQDARRLGGQAVGTRDQASQLLAGTEATLGHAKTLLAAIRAVDRTLSELMSQTGHLGLANASAPSGEQLLRTLAEVERLLWEMRARDLGAPQAAAEAELAAAQRLLARVQEQLSSLWEENQALATQTRDRLAQHEAGLMDLREALNRAVDATREAQELNSRNQERLEEALQRKQELSRDNATLQATLHAARDTLASVFRLLHSLDQAKEELERLAASLDGARTPLLQRMQTFSPAGSKLRLVEAAEAHAQQLGQLALNLSSIILDVNQDRLTQRAIEASNAYSRILQAVQAAEDAAGQALQQADHTWATVVRQGLVDRAQQLLANSTALEEAMLQEQQRLGLVWAALQGARTQLRDVRAKKDQLEAHIQAAQAMLAMDTDETSKKIAHAKAVAAEAQDTATRVQSQLQAMQENVERWQGQYEGLRGQDLGQAVLDAGHSVSTLEKTLPQLLAKLSILENRGVHNASLALSASIGRVRELIAQARGAASKVKVPMKFNGRSGVQLRTPRDLADLAAYTALKFYLQGPEPEPGQGTEDRFVMYMGSRQATGDYMGVSLRDKKVHWVYQLGEAGPAVLSIDEDIGEQFAAVSLDRTLQFGHMSVTVERQMIQETKGDTVAPGAEGLLNLRPDDFVFYVGGYPSTFTPPPLLRFPGYRGCIEMDTLNEEVVSLYNFERTFQLDTAVDRPCARSKSTGDPWLTDGSYLDGTGFARISFDSQISTTKRFEQELRLVSYSGVLFFLKQQSQFLCLAVQEGSLVLLYDFGAGLKKAVPLQPPPPLTSASKAIQVFLLGGSRKRVLVRVERATVYSVEQDNDLELADAYYLGGVPPDQLPPSLRRLFPTGGSVRGCVKGIKALGKYVDLKRLNTTGVSAGCTADLLVGRAMTFHGHGFLRLALSNVAPLTGNVYSGFGFHSAQDSALLYYRASPDGLCQVSLQQGRVSLQLLRTEVKTQAGFADGAPHYVAFYSNATGVWLYVDDQLQQMKPHRGPPPELQPQPEGPPRLLLGGLPESGTIYNFSGCISNVFVQRLLGPQRVFDLQQNLGSVNVSTGCAPALQAQTPGLGPRGLQATARKASRRSRQPARHPACMLPPHLRTTRDSYQFGGSLSSHLEFVGILARHRNWPSLSMHVLPRSSRGLLLFTARLRPGSPSLALFLSNGHFVAQMEGLGTRLRAQSRQRSRPGRWHKVSVRWEKNRILLVTDGARAWSQEGPHRQHQGAEHPQPHTLFVGGLPASSHSSKLPVTVGFSGCVKRLRLHGRPLGAPTRMAGVTPCILGPLEAGLFFPGSGGVITLDLPGATLPDVGLELEVRPLAVTGLIFHLGQARTPPYLQLQVTEKQVLLRADDGAGEFSTSVTRPSVLCDGQWHRLAVMKSGNVLRLEVDAQSNHTVGPLLAAAAGAPAPLYLGGLPEPMAVQPWPPAYCGCMRRLAVNRSPVAMTRSVEVHGAVGASGCPAA

SEQ ID NO: 7674 - protein, 241 aa, Homo Sapiens
RLRFLRTNTLLGHLMGKALRDPTVTRRYYYSIKDISIGGRCVCHGHADACDAKDPTDPFSSPNLSGHNRQLPCCPSPDLHSSQAGTKAQDGDGRVGAANTPHLLCPVCLLSGAAEGTAEHPPPGSPSQDGQQPWCWHRHIPGPHPESSVRLQCTCQHNTCGGTCDRCCPGFNQQPWKPATANSANECQSCNCYGHATDCYYDPEVDRRRASQSLDGTYQGGGVCIDCQHHTTGVNCERCLP

SEQ ID NO: 7675 - protein, 1810 aa, Homo Sapiens
MDCPLSAPTPPPPLVRFFRAPLPACVPPTLLPVLPAALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALQQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRACDCDPRGIETPQCDQSTGQCVCVEGVEGPRCDKCTRGYSGVFPDCTPCHQCFALWDVIIAELTNRTHRFLEKAKALKISGVIGPYRETVDSVERKVSEIKDILAQSPAAEPLKNIGNLFEEAEKLIKDVTEMMAQVEVKLSDTTSQSNSTAKELDSLQTEAESLDNTVKELAEQLEFIKNSDIRGALDSITKYFQMSLEAEERVNASTTEPNSTVEQSALMRDRVEDVMMERESQFKEKQEEQARLLDELAGKLQSLDLSAAAEMTCGTPPGASCSETECGGPNCRTDEGERKCGGPGCGGLVTVAHNAWQKAMDLDQDVLSALAEVEQLSKMVSEAKLRADEAKQSAEDILLKTNATKEKMDKSNEELRNLIKQIRNFLTQDSADLDSIEAVANEVLKMEMPSTPQQLQNLTEDIRERVESLSQVEVILQHSAADIARAEMLLEEAKRASKSATDVKVTADMVKEALEEAEKAQVAAEKAIKQADEDIQGTQNLLTSIESETAASEETLFNASQRISELERNVEELKRKAAQNSGEAEYIEKVVYTVKQSAEDVKKTLDGELDEKYKKVENLIAKKTEESADARRKAEMLQNEAKTLLAQANSKLQLLKDLERKYEDNQRYLEDKAQELARLEGEVRSLLKDISQKVAVYSTCL

SEQ ID NO: 7676 - protein, 91 aa, Homo Sapiens
MGLLQLLAFSFLALCRARVRAQEPEFSYGCAEGSCYPATGDLLIGRAQKLSVTSTCGLHKPEPYCIVSHLQEDKKCFICNSQDPYHETLNP

SEQ ID NO: 7677 - protein, 1786 aa, Homo Sapiens
MGLLQLLAFSFLALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALQQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRACDCDPRGIETPQCDQSTGQCVCVEGVEGPRCDKCTRGYSGVFPDCTPCHQCFALWDVIIAELTNRTHRFLEKAKALKISGVIGPYRETVDSVERKVSEIKDILAQSPAAEPLKNIGNLFEEAEKLIKDVTEMMAQVEVKLSDTTSQSNSTAKELDSLQTEAESLDNTVKELAEQLEFIKNSDIRGALDSITKYFQMSLEAEERVNASTTEPNSTVEQSALMRDRVEDVMMERESQFKEKQEEQARLLDELAGKLQSLDLSAAAEMTCGTPPGASCSETECGGPNCRTDEGERKCGGPGCGGLVTVAHNAWQKAMDLDQDVLSALAEVEQLSKMVSEAKLRADEAKQSAEDILLKTNATKEKMDKSNEELRNLIKQIRNFLTQDSADLDSIEAVANEVLKMEMPSTPQQLQNLTEDIRERVESLSQVEVILQHSAADIARAEMLLEEAKRASKSATDVKVTADMVKEALEEAEKAQVAAEKAIKQADEDIQGTQNLLTSIESETAASEETLFNASQRISELERNVEELKRKAAQNSGEAEYIEKVVYTVKQSAEDVKKTLDGELDEKYKKVENLIAKKTEESADARRKAEMLQNEAKTLLAQANSKLQLLKDLERKYEDNQRYLEDKAQELARLEGEVRSLLKDISQKVAVYSTCL

SEQ ID NO: 7678 - protein, 850 aa, Homo Sapiens
MGLLQLLAFSFLALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKRRFLKSIVMHSFRLTQPLWQGSIAAEPMLPS

SEQ ID NO: 7679 - protein, 183 aa, Homo Sapiens
MGLLQLLAFSFLETAGPGASLEWRSLETTPEPQGLSMGSPSSGKRRPPRAPAPRPQRSAGDPRACTHTHSRFPSSQISTRTLTPRMRGLPRARGFTCVALCRARVRAQEPEFSYGCAEGSCYPATGDLLIGRAQKLSVTSTCGLHKPEPYCIVSHLQEDKKCFICNSQDPYHETLNPDSHLIE

SEQ ID NO: 7680 - protein, 1798 aa, Homo Sapiens
MELTSRERGRGQPLPWELRLGLLLSVLAATLAQAPAPDVPGCSRGSCYPATGDLLVGRADRLTASSTCGLNGPQPYCIVSHLQDEKKCFLCDSRRPFSARDNPHSHRIQNVVTSFAPQRRAAWWQSENGIPAVTIQLDLEAEFHFTHLIMTFKTFRPAAMLVERSADFGRTWHVYRYFSYDCGADFPGVPLAPPRHWDDVVCESRYSEIEPSTEGEVIYRVLDPAIPIPDPYSSRIQNLLKITNLRVNLTRLHTLGDNLLDPRREIREKYYYALYELVVRGNCFCYGHASECAPAPGAPAHAEGMVHGACICKHNTRGLNCEQCQDFYRDLPWRPAEDGHSHACRKCECHGHTHSCHFDMAVYLASGNVSGGVCDGCQHNTAGRHCELCRPFFYRDPTKDLRDPAVCRSCDCDPMGSQDGGRCDSHDDPALGLVSGQCRCKEHVVGTRCQQCRDGFFGLSISDRLGCRRCQCNARGTVPGSTPCDPNSGSCYCKRLVTGRGCDRCLPGHWGLSHDLLGCRPCDCDVGGALDPQCDEGTGQCHCRQHMVGRRCEQVQPGYFRPFLDHLIWEAEDTRGQVLDVVERLVTPGETPSWTGSGFVRLQEGQTLEFLVASVPKAMDYDLLLRLEPQVPEQWAELELIVQRPGPVPAHSLCGHLVPKDDRIQGTLQPHARYLIFPNPVCLEPGISYKLHLKLVRTGGSAQPETPYSGPGLLIDSLVLLPRVLVLEMFSGGDAAALERQATFERYQCHEEGLVPSKTSPSEACAPLLISLSTLIYNGALPCQCNPQGSLSSECNPHGGQCLCKPGVVGRRCDLCAPGYYGFGPTGCQACQCSHEGALSSLCEKTSGQCLCRTGAFGLRCDRCQRGQWGFPSCRPCVCNGHADECNTHTGACLGCRDHTGGEHCERCIAGFHGDPRLPYGGQCRPCPCPEGPGSQRHFATSCHQDEYSQQIVCHCRAGYTGLRCEACAPGHFGDPSRPGGRCQLCECSGNIDPMDPDACDPHTGQCLRCLHHTEGPHCAHCKPGFHGQAARQSCHRCTCNLLGTNPQQCPSPDQCHCDPSSGQCPCLPNVQGPSCDRCAPNFWNLTSGHGCQPCACHPSRARGPTCNEFTGQCHCRAGFGGRTCSECQELHWGDPGLQCHACDCDSRGIDTPQCHRFTGHCSCRPGVSGVRCDQCARGFSGIFPACHPCHACFGDWDRVVQDLAARTQRLEQRAQELQQTGVLGAFESSFWHMQEKLGIVQGIVGARNTSAASTAQLVEATEELRREIGEATEHLTQLEADLTDVQDENFNANHALSGLERDRLALNLTLRQLDQHLDLLKHSNFLGAYDSIRHAHSQSAEAERRANTSALAVPSPVSNSASARHRTEALMDAQKEDFNSKHMANQRALGKLSAHTHTLSLTDINELVCGAPGDAPCATSPCGGAGCRDEDGQPRCGGLSCNGAAATADLALGRARHTQAELQRALAEGGSILSRVAETRRQASEAQQRAQAALDKANASRGQVEQANQELQELIQSVKDFLNQEGADPDSIEMVATRVLELSIPASAEQIQHLAGAIAERVRSLADVDAILARTVGDVRRAEQLLQDARRARSWAEDEKQKAETVQAALEEAQRAQGIAQGAIRGAVADTRDTEQTLYQVQERMAGAERALSSAGERARQLDALLEALKLKRAGNSLAASTAEETAGSAQGRAQEAEQLLRGPLGDQYQTVKALAERKAQGVLAAQARAEQLRDEARDLLQAAQDKLQRLQELEGTYEENERALESKAAQLDGLEARMRSVLQAINLQVQIYNTCQ

SEQ ID NO: 7681 - protein, 1798 aa, Homo Sapiens; identical to SEQ ID NO: 7680

SEQ ID NO: 7682 - protein, 151 aa, Homo Sapiens
MTFKTFRPAAMLVERSADFGRTWHVYRYFSYDCGADFPGVPLAPPRHWDDVVCESRYSEIEPSTEGEVIYRVLDPAIPIPDPYSSRIQNLLKITNLRVNLTRLHTLGDNLLDPRREIREKYYYALYELVVRGNCFCYGHASECAPAPGAPA

SEQ ID NO: 7683 - protein, 160 aa, Homo Sapiens
MNEIQAIAARLPNVDLVLSQTKQDIARARRLQAEAEEARSRAHAVEGQVEDVVGNLRQGTVALQEAQDTMQGTSRSLRLIQDRVAEVQQVLRPAEKLVTSMTKQLGDFWTRMEELRHQARQQGAEAVQAQQLAEGASEQALSAQEGFERIKQKYAELKDR

SEQ ID NO: 7684 - protein, 188 aa, Homo Sapiens
MRPFFLLCFALPGLLHAQQACSRGACYPPVGDLLVGRTRFLRASSTCGLTKPETYCTQYGEWQMKCCKCDSRQPHNYYSHRVENVASSSGPMRWWQSQNDVNPVSLQLDLDRRFQLQEVMMEFQGPMPAGMLIERSSDFGKTWRVYQYLAADCTSTFPRVRQGRPQSWQDVRCQSLPQRPNARLNGGK

SEQ ID NO: 7685 - protein, 1172 aa, Homo Sapiens [sequence omitted]

SEQ ID NO: 7686 - protein, 1172 aa, Homo Sapiens [sequence omitted]

SEQ ID NO: 7687 - protein, 1172 aa, Homo Sapiens [sequence omitted]

SEQ ID NO: 7688 - protein, 1761 aa, Homo Sapiens
MQFQLTLFLHLGWLSYSKAQDDCNRGACHPTTGDLLVGRNTQLMASSTCGLSRAQKYCILSYLEGEQKCFICDSRFPYDPYDQPNSHTIENVIVSFEPDREKKWWQSENGLDHVSIRLDLEALFRFSHLILTFKTFRPAAMLVERSTDYGHNWKVFKYFAKDCATSFPNITSGQAQGVGDIVCDSKYSDIEPSTGGEVVLKVLDPSFEIENPYSPYIQDLVTLTNLRINFTKLHTLGDALLGRRQNDSLDKYYYALYEMIVRGSCFCNGHASECRPMQKMRGDVFSPPGMVHGQCVCQHNTDGPNCERCKDFFQDAPWRPAADLQDNACRSCSCNSHSSRCHFDMTTYLASGGLSGGVCEDCQHNTEGQHCDRCRPLFYRDPLKTISDPYACIPCECDPDGTISGGICVSHSDPALGSVAGQCLCKENVEGAKCDQCKPNHYGLSATDPLGCQPCDCNPLGSLPFLTCDVDTGQCLCLSYVTGAHCEECTVGYWGLGNHLHGCSPCDCDIGGAYSNVCSPKNGQCECRPHVTGRSCSEPAPGYFFAPLNFYLYEAEEATTLQGLAPLGSETFGQSPAVHVVLGEPVPGNPVTWTGPGFARVLPGAGLRFAVNNIPFPVDFTIAIHYETQSAADWTVQIVVNPPGGSEHCIPKTLQSKPQSFALPAATRIMLLPTPICLEPDVQYSIDVYFSQPLQGESHAHSHVLVDSLGLIPQINSLENFCSKQDLDEYQLHNCVEIASAMGPQVLPGACERLIISMSAKLHDGAVACKCHPQGSVGSSCSRLGGQCQCKPLVVGRCCDRCSTGSYDLGHHGCHPCHCHPQGSKDTVCDQVTGQCPCHGEVSGRRCDRCLAGYFGFPSCHPCPCNRFAELCDPETGSCFNCGGFTTGRNCERCIDGYYGNPSSGQPCRPCLCPDDPSSNQYFAHSCYQNLWSSDVICNCLQGYTGTQCGECSTGFYGNPRISGAPCQPCACNNNIDVTDPESCSRVTGECLRCLHNTQGANCQLCKPGHYGSALNQTCRRCSCHASGVSPMECPPGGGACLCDPVTGACPCLPNVTGLACDRCADGYWNLVPGRGCQSCDCDPRTSQSSHCDQLTGQCPCKLGYGGKRCSECQENYYGDPPGRCIPCDCNRAGTQKPICDPDTGMCRCREGVSGQRCDRCARGHSQEFPTCLQCHLCFDQWDHTISSLSKAVQGLMRLAANMEDKRETLPVCEADFKDLRGNVSEIERILKHPVFPSGKFLKVKDYHDSVRRQIMQLNEQLKAVYEFQDLKDTIERAKNEADLLLEDLQEEIDLQSSVLNASIADSSENIKKYYHISSSAEKKINETSSTINTSANTRNDLLTILDTLTSKGNLSLERLKQIKIPDIQILNEKVCGDPGNVPCVPLPCGGALCTGRKGHRKCRGPGCHGSLTLSTNALQKAQEAKSIIRNLDKQVRGLKNQIESISEQAEVSKNNALQLREKLGNIRNQSDSEEENINLFIKKVKNFLLEENVPPEDIEKVANGVLDIHLPIPSQNLTDELVKIQKHMQLCEDYRTDENRLNEEADGAQKLLVKAKAAEKAANILLNLDKTLNQLQQAQITQGRANSTITQLTANITKIKKNVLQAENQTREMKSELELAKQRSGLEDGLSLLQTKLQRHQDHAVNAKVQAESAQHQAGSLEKEFVELKKQYAILQRKTSTTGLTKETLGKVKQLKDAAEKLAGDTEAKIRRITDLERKIQDLNLSRQAKADQLRILEDQVVAIKNEIVEQEKKYARCYS

SEQ ID NO: 7689 - protein, 1761 aa, Homo Sapiens; identical to SEQ ID NO: 7688

SEQ ID NO: 7690 - protein, 772 aa, Homo Sapiens
MQFQLTLFLHLGWLSYSKAQDDCNRGACHPTTGDLLVGRNTQLMASSTCGLSRAQKYCILSYLEGEQKCFICDSRFPYDPYDQPNSHTIENVIVSFEPDREKKWWQSENGLDHVSIRLDLEALFRFSHLILTFKTFRPAAMLVERSTDYGHNWKVFKYFAKDCATSFPNITSGQAQGVGDIVCDSKYSDIEPSTGGEVVLKVLDPSFEIENPYSPYIQDLVTLTNLRINFTKLHTLGDALLGRRQNDSLDKYYYALYEMIVRGSCFCNGHASECRPMQKMRGDVFSPPGMVHGQCVCQHNTDGPNCERCKDFFQDAPWRPAADLQDNACRSCSCNSHSSRCHFDMTTYLASGGLSGGVCEDCQHNTEGQHCDRCRPLFYRDPLKTISDPYACIPCECDPDGTISGGICVSHSDPALGSVAGQCLCKENVEGAKCDQCKPNHYGLSATDPLGCQPCDCNPLGSLPFLTCDVDTGQCLCLSYVTGAHCEECTVGYWGLGNHLHGCSPCDCDIGGAYSNVCSPKNGQCECRPHVTGRSCSEPAPGYFFAPLNFYLYEAEEATTLQGLAPLGSETFGQSPAVHVVLGEPVPGNPVTWTGPGFARVLPGAGLRFAVNNIPFPVDFTIAIHYETQSAADWTVQIVVNPPGGSEHCIPKTLQSKPQSFALPAATRIMLLPTPICLEPDVQYSIDVYFSQPLQGESHAHSHVLVDSAAVQWHNLGSLQPPPPECKQFSCFSFPSSWDYRHPPPHLANFCIFSRDGVSPHWPGWSQTPDLR

SEQ ID NO: 7691 - protein, 749 aa, Homo Sapiens
NIDVTDPESCSRVTGECLRCLHNTQGANCQLCKPGHYGSALNQTCRRCSCHASGVSPMECPPGGGACLCDPVTGACPCLPNVTGLACDRCADGYWNLVPGRGCQSCDCDPRTSQSSHCDQLTGQCPCKLGYGGKRCSECQENYYGDPPGRCIPCDCNRAGTQKPICDPDTGMCRCREGVSGQRCDRCARGHSQEFPTCLQCHLCFDQWDHTISSLSKAVQGLMRLAANMEDKRETLPVCEADFKDLRGNVSEIERILKHPVFPSGKFLKVKDYHDSVRRQIMQLNEQLKAVYEFQDLKDTIERAKNEADLLLEDLQEEIDLQSSVLNASIADSSENIKKYYHISSSAEKKINETSSTINTSANTRNDLLTILDTLTSKGNLSLERLKQIKIPDIQILNEKVCGDPGNVPCVPLPCGGALCTGRKGHRKCRGPGCHGSLTLSTNALQKAQEAKSIIRNLDKQVRGLKNQIESISEQAEVSKNNALQLREKLGNIRNQSDSEEENINLFIKKVKNFLLEENVPPEDIEKVANGVLDIHLPIPSQNLTDELVKIQKHMQLCEDYRTDENRLNEEADGAQKLLVKAKAAEKAANILLNLDKTLNQLQQAQITQGRANSTITQLTANITKIKKNVLQAENQTREMKSELELAKQRSGLEDGLSLLQTKLQRHQDHAVNAKVQAESAQHQAGSLEKEFVELKKQYAILQRKTSTTGLTKETLGKVKQLKDAAEKLAGDTEAKIRRITGCFQNSAR

SEQ ID NO: 7692 - protein, 38 aa, Homo Sapiens
MKNEFDKLVCNCKHNTYGVDCEKCLPFFNDRPWRRATA

SEQ ID NO: 7693 - protein, 1609 aa, Homo Sapiens
MRGSHRAAPALRPRGRLWPVLAVLAAAAAAGCAQAAMDECTDEGGRPQRCMPEFVNAAFNVTVVATNTCGTPPEEYCVQTGVTGVTKSCHLCDAGQPHLQHGAAFLTDYNNQADTTWWQSQTMLAGVQYPSSINLTLHLGKAFDITYVRLKFHTSRPESFAIYKRTREDGPWIPYQYYSGSCENTYSKANRGFIRTGGDEQQALCTDEFSDISPLTGGNVAFSTLEGRPSAYNFDNSPVLQEWVTATDIRVTLNRLNTFGDEVFNDPKVLKSYYYAISDFAVGGRCKCNGHASECMKNEFDKLVCNCKHNTYGVDCEKCLPFFNDRPWRRATAESASECLPCDCNGRSQECYFDPELYRSTGHGGHCTNCQDNTDGAHCERCRENFFRLGNNEACSSCHCSPVGSLSTQCDSYGRCSCKPGVMGDKCDRCQPGFHSLTEAGCRPCSCDPSGSIDECNIETGRCVCKDNVEGFNCERCKPGFFNLESSNPRGCTPCFCFGHSSVCTNAVGYSVYSISSTFQIDEDGWRAEQRDGSEASLEWSSERQDIAVISDSYFPRYFIAPAKFLGKQVLSYGQNLSFSFRVDRRDTRLSAEDLVLEGAGLRVSVPLIAQGNSYPSETTVKYVFRLHEATDYPWRPALTPFEFQKLLNNLTSIKIRGTYSERSAGYLDDVTLASARPGPGVPATWVESCTCPVGYGGQFCEMCLSGYRRETPNLGPYSPCVLCACNGHSETCDPETGVCNCRDNTAGPHCEKCSDGYYGDSTAGTSSDCQPCPCPGGSSCAVVPKTKEVVCTNCPTGTTGKRCELCDDGYFGDPLGRNGPVRLCRLCQCSDNIDPNAVGNCNRLTGECLKCIYNTAGFYCDRCKDGFFGNPLAPNPADKCKACNCNLYGTMKQQSSCNPVTGQCECLPHVTGQDCGACDPGFYNLQSGQGCERCDCHALGSTNGQCDIRTGQCECQPGITGQHCERCEVNHFGFGPEGCKPCDCHPEGSLSLQCKDDGRCECREGFVGNRCDQCEENYFYNRSWPGCQECPACYRLVKDKVADHRVKLQELESLIANLGTGDEMVTDQAFEDRLKEAEREVMDLLREAQDVKDVDQNLMDRLQRVNNTLSSQISRLQNIRNTIEETGNLAEQARAHVENTERLIEIASRELEKAKVAAANVSVTQPESTGDPNNMTLLAEEARKLAERHKQEADDIVRVAKTANDTSTEAYNLLLRTLAGENQTAFEIEELNRKYEQAKNISQDLEKQAARVHEEAKRAGDKAVEIYASVAQLSPLDSETLENEANNIKMEAENLEQLIDQKLKDYEDLREDMRGKELEVKNLLEKGKTEQQTADQLLARADAAKALAEEAAKKGRDTLQEANDILNNLKDFDRRVNDNKTAAEEALRKIPAINQTITEANEKTREAQQALGSAAADATEAKNKAHEAERIASAVQKNATSTKAEAERTFAEVTDLDNEVNNMLKQLQEAEKELKRKQDDADQDMMMAGMASQAAQEAEINARKAKNSVTSLLSIINDLLEQLGQLDTVDLNKLNEIEGTLNKAKDEMKVSDLDRKVSDLENEAKKQEAAIMDYNRDIEEIMKDIRNLEDIRKTLPSGCFNTPSIEKP

SEQ ID NO: 7694 - protein, 1193 aa, Homo Sapiens
MPALWLGCCLCFSLLLPAARATSRREVCDCNGKSRQCIFDRELHRQTGNGFRCLNCNDNTDGIHCEKCKNGFYRHRERDRCLPCNCNSKGSLSARCDNSGRCSCKPGVTGARCDRCLPGFHMLTDAGCTQDQRLLDSKCDCDPAGIAGPCDAGRCVCKPAVTGERCDRCRSGYYNLDGGNPEGCTQCFCYGHSASCRSSAEYSVHKITSTFHQDVDGWKAVQRNGSPAKLQWSQRHQDVFSSAQRLDPVYFVAPAKFLGNQQVSYGQSLSFDYRVDRGGRHPSAHDVILEGAGLRITAPLMPLGKTLPCGLTKTYTFRLNEHPSNNWSPQLSYFEYRRLLRNLTALRIRATYGEYSTGYIDNVTLISARPVSGAPAPWVEQCICPVGYKGQFCQDCASGYKRDSARLGPFGTCIPCNCQGGGACDPDTGDCYSGDENPDIECADCPIGFYNDPHDPRSCKPCPCHNGFSCSVMPETEEVVCNNCPPGVTGARCELCADGYFGDPFGEHGPVRPCQPCQCNNNVDPSASGNCDRLTGRCLKCIHNTAGIYCDQCKAGYFGDPLAPNPADKCRACNCNPMGSEPVGCRSDGTCVCKPGFGGPNCEHGAFSCPACYNQVKIQMDQFMQQLQRMEALISKAQGGDGVVPDTELEGRMQQAEQALQDILRDAQISEGASRSLGLQLAKVRSQENSYQSRLDDLKMTVERVRALGSQYQNRVRDTHRLITQMQLSLAESEASLGNTNIPASDHYVGPNGFKSLAQEATRLAESHVESASNMEQLTRETEDYSKQALSLVRKALHEGVGSGSGSPDGAVVQGLVEKLEKTKSLAQQLTREATQAEIEADRSYQHSLRLLDSVSRLQGVSDQSFQVEEAKRIKQKADSLSSLVTRHMDEFKRTQKNLGNWKEEAQQLLQNGKSGREKSDQLLSRANLAKSRAQEALSMGNATFYEVESILKNLREFDLQVDNRKAEAEEAMKRLSYISQKVSDASDKTQQAERALGSAAADAQRAKNGAGEALEISSEIEQEIGSLNLEANVTADGALAMEKGLASLKSEMREVEGELERKELEFDTNMDAVQMVITEAQKVDTRAKNAGVTIQDTLNTLDGLLHLMDQPLSVDEEGLVLLEQKLSRAKTQINSQLRPMMSELEERARQQRGHLHLLETSIDGILADVKNLENIRDNLPPGCYNTQALEQQ

SEQ ID NO: 7695 - protein, 1111 aa, Homo Sapiens
MPALWLGCCLCFSLLLPAARATSRREVCDCNGKSRQCIFDRELHRQTGNGFRCLNCNDNTDGIHCEKCKNGFYRHRERDRCLPCNCNSKGSLSARCDNSGRCSCKPGVTGARCDRCLPGFHMLTDAGCTQDQRLLDSKCDCDPAGIAGPCDAGRCVCKPAVTGERCDRCRSGYYNLDGGNPEGCTQCFCYGHSASCRSSAEYSVHKITSTFHQDVDGWKAVQRNGSPAKLQWSQRHQDVFSSAQRLDPVYFVAPAKFLGNQQVSYGQSLSFDYRVDRGGRHPSAHDVILEGAGLRITAPLMPLGKTLPCGLTKTYTFRLNEHPSNNWSPQLSYFEYRRLLRNLTALRIRATYGEYSTGYIDNVTLISARPVSGAPAPWVEQCICPVGYKGQFCQDCASGYKRDSARLGPFGTCIPCNCQGGGACDPDTGDCYSGDENPDIECADCPIGFYNDPHDPRSCKPCPCHNGFSCSVMPETEEVVCNNCPPGVTGARCELCADGYFGDPFGEHGPVRPCQPCQCNNNVDPSASGNCDRLTGRCLKCIHNTAGIYCDQCKAGYFGDPLAPNPADKCRACNCNPMGSEPVGCRSDGTCVCKPGFGGPNCEHGAFSCPACYNQVKIQMDQFMQQLQRMEALISKAQGGDGVVPDTELEGRMQQAEQALQDILRDAQISEGASRSLGLQLAKVRSQENSYQSRLDDLKMTVERVRALGSQYQNRVRDTHRLITQMQLSLAESEASLGNTNIPASDHYVGPNGFKSLAQEATRLAESHVESASNMEQLTRETEDYSKQALSLVRKALHEGVGSGSGSPDGAVVQGLVEKLEKTKSLAQQLTREATQAEIEADRSYQHSLRLLDSVSRLQGVSDQSFQVEEAKRIKQKADSLSSLVTRHMDEFKRTQKNLGNWKEEAQQLLQNGKSGREKSDQLLSRANLAKSRAQEALSMGNATFYEVESILKNLREFDLQVDNRKAEAEEAMKRLSYISQKVSDASDKTQQAERALGSAAADAQRAKNGAGEALEISSEIEQEIGSLNLEANVTADGALAMEKGLASLKSEMREVEGELERKELEFDTNMDAVQMVITEAQKVDTRAKNAGVTIQDTLNTLDGLLHLMGM

SEQ ID NO: 7696 - protein, 1575 aa, Homo Sapiens
MAAAALLLGLALLAPRAAGAGMGACYDGAGRPQRCLPVFENAAFGRLAQASHTCGSPPEDFCPHVGAAGAGAHCQRCDAADPQRHHNASYLTDFHSQDESTWWQSPSMAFGVQYPTSVNITLRLGKAYEITYVRLKFHTSRPESFAIYKRSRADGPWEPYQFYSASCQKTYGRPEGQYLRPGEDERVAFCTSEFSDISPLSGGNVAFSTLEGRPSAYNFEESPGLQEWVTSTELLISLDRLNTFGDDIFKDPKVLQSYYYAVSDFSVGGRCKCNGHASECGPDVAGQLACRCQHNTTGTDCERCLPFFQDRPWARGTAEAAHECLPCNCSGRSEECTFDRELFRSTGHGGRCHHCRDHTAGPHCERCQENFYHWDPRMPCQPCDCQSAGSLHLQCDDTGTCACKPTVTGWKCDRCLPGFHSLSEGGCRPCTCNPAGSLDTCDPRSGRCPCKENVEGNLCDRCRPGTFNLQPHNPAGCSSCFCYGHSKVCASTAQFQVHHILSDFHQGAEGWWARSVGGSEHPPQWSPNGVLLSPEDEEELTAPEKFLGDQRFSYGQPLILTFRVPPGDSPLPVQLRLEGTGLALSLRHSSLSGPQDAGHPREVELRFHLQETSEDVAPPLPPFHFQRLLANLTSLRLRVSPGPSPAGPVFLTEVRLTSARPGLSPPASWVEICSCPTGYTGQFCESCAPGYKREMPQGGPYASCVPCTCNQHGTCDPNTGICVCSHHTEGPSCERCLPGFYGNPFAGQADDCQPCPCPGQSACTTIPESREVVCTHCPPGQRGRRCEVCDDGFFGDPLGLFGHPQPCHQCQCSGNVDPNAVGNCDPLSGHCLRCLHNTTGDHCEHCQEGFYGSALAPRPADKCMPCSCHPQGSVSEQMPCDPVTGQCSCLPHVTARDCSRCYPGFFDLQPGRGCRSCKCHPLGSQEDQCHPKTGQCTCRPGVTGQACDRCQLGFFGFSIKGCRACRCSPLGAASAQCHENGTCVCRPGFEGYKCDRCHDNFFLTADGTHCQQCPSCYALVKEEAAKLKARLTLTEGWLQGSDCGSPWGPLDILLGEAPRGDVYQGHHLLPGAREAFLEQMMSLEGAVKAAREQLQRLNKGARCAQAGSQKTCTQLADLEAVLESSEEEILHAAAILASLEIPQEGPSQPTKWSHLATEARALARSHRDTATKIAATAWRALLASNTSYALLWNLLEGRVALETQRDLEDRYQEVQAAQKALRTAVAEVLPEAESVLATVQQVGADTAPYLALLASPGALPQKSRAEDLGLKAKALEKTVASWQHMATEAARTLQTAAQATLRQTEPLTKLHQEARAALTQASSSVQAATVTVMGARTLLADLEGMKLQFPRPKDQAALQRKADSVSDRLLADTRKKTKQAERMLGNAAPLSSSAKKKGREAEVLAKDSAKLAKALLRERKQAHRRASRLTSQTQATLQQASQQVLASEARRQELEEAERVGAGLSEMEQQIRESRISLEKDIETLSELLARLGSLDTHQAPAQALNETQWALERLRLQLGSPGSLQRKLSLLEQESQQQELQIQGFESDLAEIRADKQNLEAILHSLPENCASWQ

SEQ ID NO: 7697 - protein, 257 aa, Homo Sapiens
  misc_feature (1)..(1): Xaa can be any naturally occurring amino acid
XTLQTAAQATLRQTEPLTKLHQEARAALTQASSSVQAATVTVMGARTLLADLEDTRKKTKQAERMLGNAAPLSSSAKKKGREAEVLAKDSAKLAKALLRERKQAHRRASRLTSQTQATLQQASQQVLASEARRQELEEAERVGAGLSEMEQQIRESRISLEKDIETLSELLARLGSLDTHQAPAQALNETQWALERLRLQLGSPGSLQRKLSLLEQESQQQELQIQGFESDLAEIRADKQNLEAILHSLPENCASWQ

SEQ ID NO: 7698 - protein, 180 aa, Homo Sapiens
MPRQLSAAAALFASLAVILHDGSQMRAKAFPETRDYSQPTAAATVQDIKKPVQQPAKQAPHQTLAARFMDGHITFQTAATVKIPTTTPATTKNTATTSPITYTLVTTQATPNNSHTAPPVTEVTVGPSLAPYSLPPTITPPAHTTGTSSSTVSHTTGNTTQPSNQTTLPATLSIALHKST

SEQ ID NO: 7699 - protein, 416 aa, Homo Sapiens
MPRQLSAAAALFASLAVILHDGSQMRAKAFPETRDYSQPTAAATVQDIKKPVQQPAKQAPHQTLAARFMDGHITFQTAATVKIPTTTPATTKNTATTSPITYTLVTTQATPNNSHTAPPVTEVTVGPSLAPYSLPPTITPPAHTTGTSSSTVSHTTGNTTQPSNQTTLPATLSIALHKSTTGQKPVQPTHAPGTTAAAHNTTRTAAPASTVPGPTLAPQPSSVKTGIYQVLNGSRLCIKAEMGIQLIVQDKESVFSPRRYFNIDPNATQASGNCGTRKSNLLLNFQGGFVNLTFTKDEESYYISEVGAYLTVSDPETIYQGIKHAVVMFQTAVGHSFKCVSEQSLQLSAHLQVKTTDVQLQAFDFEDDHFGNVDECSSDYTIVLPVIGAIVVGLCLMGMGVYKIRLRCQSSGYQRI

SEQ ID NO: 7700 - protein, 143 aa, Homo Sapiens
MRAKAFPETRDYSQPTAAATVQDIKKPVQQPAKQAPHQTLAARFMDGHITFQTAATVKIPTTTPATTKNTATTSPITYTLVTTQATPNNSHTAPPVTEVTVGPSLAPYSLPPTITPPAHTTGTSSSTVSHTTGNTTQPSNQTT

SEQ ID NO: 7701 - protein, 392 aa, Homo Sapiens
MRAKAFPETRDYSQPTAAATVQDIKKPVQQPAKQAPHQTLAARFMDGHITFQTAATVKIPTTTPATTKNTATTSPITYTLVTTQATPNNSHTAPPVTEVTVGPSLAPYSLPPTITPPAHTTGTSSSTVSHTTGNTTQPSNQTTLPATLSIALHKSTTGQKPVQPTHAPGTTAAAHNTTRTAAPASTVPGPTLAPQPSSVKTGIYQVLNGSRLCIKAEMGIQLIVQDKESVFSPRRYFNIDPNATQASGNCGTRKSNLLLNFQGGFVNLTFTKDEESYYISEVGAYLTVSDPETIYQGIKHAVVMFQTAVGHSFKCVSEQSLQLSAHLQVKTTDVQLQAFDFEDDHFGNVDECSSDYTIVLPVIGAIVVGLCLMGMGVYKIRLRCQSSGYQRI

SEQ ID NO: 7702 - protein, 690 aa, Homo Sapiens
MLPRGRPRALGAAALLLLLLLLGFLLFDGRLRRAAALDGDPGAGPGDHNRSDCGPQPPPPPKCELLHVAIVCAGHNSSRDVITLVKSMLFYRKNPLHLHLVTDAVARNILETLFHTWMVPAVRVSFYHADQLKPQVSWIPNKHYSGLYGLMKLVLPSALPAELARVIVLDTDVTFASDISELWALFAHFSDTQAIGLVENQSDWYLGNLWKNHRPWPALGRGFNTGVILLRLDRLRQAGWEQMWRLTARRELLSLPATSLADQDIFNAVIKEHPGLVQRLPCVWNVQLSDHTLAERCYSEASDLKVIHWNSPKKLRVKNKHVEFFRNFYLTFLEYDGNLLRRELFVCPSQPPPGAEQLQQALAQLDEEDPCFEFRQQQLTVHRVHVTFLPHEPPPPRPHDVTLVAQLSMDRLQMLEALCRHWPGPMSLALYLTDAEAQQFLHFVEASPVLAARQDVAYHVVYREGPLYPVNQLRNVALAQALTPYVFLSDIDFLPAYSLYDYLRASIEQLGLGSRRKAALVVPAFETLRYRFSFPHSKVELLALLDAGTLYTFRYHEWPRGHAPTDYARWREAQAPYRVQWAANYEPYVVVPRDCPRYDPRFVGFGWNKVAHIVELDAQEYELLVLPEAFTIHLPHAPSLDISRFRSSPTYRDCLQALKDEFHQDLSRHHGAAALKYLPALQQPQSPARG

SEQ ID NO: 7703 - protein, 721 aa, Homo Sapiens
MLPRGRPRALGAAALLLLLLLLGFLLFGGDLGCERREPGGRAGAPGCFPGPLMPRVPPDGRLRRAAALDGDPGAGPGDHNRSDCGPQPPPPPKCELLHVAIVCAGHNSSRDVITLVKSMLFYRKNPLHLHLVTDAVARNILETLFHTWMVPAVRVSFYHADQLKPQVSWIPNKHYSGLYGLMKLVLPSALPAELARVIVLDTDVTFASDISELWALFAHFSDTQAIGLVENQSDWYLGNLWKNHRPWPALGRGFNTGVILLRLDRLRQAGWEQMWRLTARRELLSLPATSLADQDIFNAVIKEHPGLVQRLPCVWNVQLSDHTLAERCYSEASDLKVIHWNSPKKLRVKNKHVEFFRNFYLTFLEYDGNLLRRELFVCPSQPPPGAEQLQQALAQLDEEDPCFEFRQQQLTVHRVHVTFLPHEPPPPRPHDVTLVAQLSMDRLQMLEALCRHWPGPMSLALYLTDAEAQQFLHFVEASPVLAARQDVAYHVVYREGPLYPVNQLRNVALAQALTPYVFLSDIDFLPAYSLYDYLRASIEQLGLGSRRKAALVVPAFETLRYRFSFPHSKVELLALLDAGTLYTFRYHEWPRGHAPTDYARWREAQAPYRVQWAANYEPYVVVPRDCPRYDPRFVGFGWNKVAHIVELDAQEYELLVLPEAFTIHLPHAPSLDISRFRSSPTYRDCLQALKDEFHQDLSRHHGAAALKYLPALQQPQSPARG

SEQ ID NO: 7704 - protein, 721 aa, Homo Sapiens; identical to SEQ ID NO: 7703

SEQ ID NO: 7705 - protein, 721 aa, Homo Sapiens; identical to SEQ ID NO: 7703

SEQ ID NO: 7706 - protein, 158 aa, Homo Sapiens
WNSPKKLRVKNKHVEFFRNFYLTFLEYDGNLLRRELFVCPSQPPPGAEQLQQALAQLDEEDPCFEFRQQQLTVHRVHVTFLPHEPPPPRPHDVTLVAQLSMDRTWPTMWCTVRGPYTPSTSFATWPWPRPSRLTSSSVTLTSCLPILSTTTSGPPLSS

SEQ ID NO: 7707 - protein, 109 aa, Homo Sapiens
  misc_feature (1)..(1): Xaa can be any naturally occurring amino acid
XLLDAGTLYTFRNMSSWCCPRPSPSICPTLQAWTSPASAPAPPIVTASRPSRTNSTRTCPATMGLLPSNTSQPCSSPRALPEAEAGPALPLILALGRHQGNLPSAIPAI

SEQ ID NO: 7708 - protein, 166 aa, Homo Sapiens
IPRSPQPLGGSHRTPSSRRDSDGANSVASYENEEPACEDADEDEDDYHNPGYLVVLPDSTPATSTAAPSAPALSTPGIRDSAFSMESIDDYVNVPESGESAEASLDGSREYVNVSQELHPGAAKTEPVEAESVLEPGLPGTAELGSWKWLWGPHMASCPCSSLTTA

SEQ ID NO: 7709 - protein, 269 aa, Homo Sapiens
MEATAASWQVAVPVLGGASRPLGPRGAASLLRAPLQMEEAILVPCVLGLLLLPILAMLMALCVHCHRLPGSYDSTSSDSLYPRGIQFKRPHTVAPWPPAYPPVTSYPPLSQPDLLPIPRSPQPLGGSHRTPSSRRDSDGANSVASYENEEPACEDADEDEDDYHNPGYLVVLPDSTPATSTAAPSAPALSTPGIRDSAFSMESIDDYVNVPESGESAEASLDGSREYVNVSQELHPGAAKTEPAALSSQEAEEVEEEGAPDYENLQELN

SEQ ID NO: 7710 - protein, 85 aa, Homo Sapiens
MEEAILVPCVLGLLLLPILAMLMALCVHCHRLPGSYDSTSSDSLYPRGIQFKRPHTVAPWPPAYPPVTSYPPLSQPDLLPIPHDP

SEQ ID NO: 7711 - protein, 85 aa, Homo Sapiens; identical to SEQ ID NO: 7710

SEQ ID NO: 7712 - protein, 233 aa, Homo Sapiens
MEEAILVPCVLGLLLLPILAMLMALCVHCHRLPGSYDSTSSDSLYPRGIQFKRPHTVAPWPPAYPPVTSYPPLSQPDLLPIPRSPQPLGGSHRTPSSRRDSDGANSVASYENEEPACEDADEDEDDYHNPGYLVVLPDSTPATSTAAPSAPALSTPGIRDSAFSMESIDDYVNVPESGESAEASLDGSREYVNVSQELHPGAAKTEPAALSSQEAEEVEEEGAPDYENLQELN

SEQ ID NO: 7713 - protein, 262 aa, Homo Sapiens
MEEAILVPCVLGLLLLPILAMLMALCVHCHRLPGSYDSTSSDSLYPRGIQFKRPHTVAPWPPAYPPVTSYPPLSQPDLLPIPRSPQPLGGSHRTPSSRRDSDGANSVASYENEGASGIRGAQAGWGVWGPSWTRLTPVSLPPEPACEDADEDEDDYHNPGYLVVLPDSTPATSTAAPSAPALSTPGIRDSAFSMESIDDYVNVPESGESAEASLDGSREYVNVSQELHPGAAKTEPAALSSQEAEEVEEEGAPDYENLQELN

SEQ ID NO: 7714 - protein, 252 aa, Homo Sapiens
MEEAILVPCVLGLLLLPILAMLMALCVHCHRLPGSYDSTSSDSLYPRGIQFKRPHTVAPWPPAYPPVTSYPPLSQPDLLPIPRSPQPLRDSDGANSVASYENEGASGIRGAQAGWGVWGPSWTRLTPVSLPPEPACEDADEDEDDYHNPGYLVVLPDSTPATSTAAPSAPALSTPGIRDSAFSMESIDDYVNVPESGESAEASLDGSREYVNVSQELHPGAAKTEPAALSSQEAEEVEEEGAPDYENLQELN

SEQ ID NO: 7715 - protein, 232 aa, Homo Sapiens
MEEAILVPCVLGLLLLPILAMLMALCVHCHRLPGSYDSTSSDSLYPRGIQFKRPHTVAPWPPAYPPVTSYPPLSQPDLLPIPSPQPLGGSHRTPSSRRDSDGANSVASYENEEPACEDADEDEDDYHNPGYLVVLPDSTPATSTAAPSAPALSTPGIRDSAFSMESIDDYVNVPESGESAEASLDGSREYVNVSQELHPGAAKTEPAALSSQEAEEVEEEGAPDYENLQELN

SEQ ID NO: 7716 - protein, 232 aa, Homo Sapiens; identical to SEQ ID NO: 7715

SEQ ID NO: 7717 - protein, 261 aa, Homo Sapiens
MEEAILVPCVLGLLLLPILAMLMALCVHCHRLPGSYDSTSSDSLYPRGIQFKRPHTVAPWPPAYPPVTSYPPLSQPDLLPIPSPQPLGGSHRTPSSRRDSDGANSVASYENEGASGIRGAQAGWGVWGPSWTRLTPVSLPPEPACEDADEDEDDYHNPGYLVVLPDSTPATSTAAPSAPALSTPGIRDSAFSMESIDDYVNVPESGESAEASLDGSREYVNVSQELHPGAAKTEPAALSSQEAEEVEEEGAPDYENLQELN

SEQ ID NO: 7718 - protein, 100 aa, Homo Sapiens
MSSGTELLWPGAALLVLLGVAASLCVRCSRPGAKRREDQQSFTGSRTYSLVGQAWPGPLADMAPTRKDKLLQFYPSLEDPASSRYQNFSKGSRHGSEEAY

SEQ ID NO: 7719 - protein, 58 aa, Homo Sapiens
MSSGTELLWPGAALLVLLGVAASLCVRCSRPGAKRSEKIYQQRSLREDQQSFTGSRTY

SEQ ID NO: 7720 - protein, 64 aa, Homo Sapiens
MSSGTELLWPGAALLVLLGVAASLCVRCSRPGAKRSEKIYQQRSLREDQQSFTGSRTYSLVGQA

SEQ ID NO: 7721 - protein, 100 aa, Homo Sapiens
MSSGTELLWPGAALLVLLGVAASLCVRCSRPGAKRSEKIYQQRSLREDQQSFTGSRTYSLVGQAWPGPLADMAPTRKDKLLQFYPSLEDPASSRYQNFSK

SEQ ID NO: 7722 - protein, 111 aa, Homo Sapiens
MSSGTELLWPGAALLVLLGVAASLCVRCSRPGAKRSEKIYQQRSLREDQQSFTGSRTYSLVGQAWPGPLADMAPTRKDKLLQFYPSLEDPASSRYQNFSKGSRHGSEEAYI

SEQ ID NO: 7723 - protein, 243 aa, Homo Sapiens
MSSGTELLWPGAALLVLLGVAASLCVRCSRPGAKRSEKIYQQRSLREDQQSFTGSRTYSLVGQAWPGPLADMAPTRKDKLLQFYPSLEDPASSRYQNFSKGSRHGSEEAYIDPIAMEYYNWGRFSKPPEDDDANSYENVLICKQKTTETGAQQEGIGGLCRGDLSLSLALKTGPTSGLCPSASPEEDEESEDYQNSASIHQWRESRKVMGQLQREASPGPVGSPDEEDGEPDYVNGEVAATEA

SEQ ID NO: 7724 - protein, 243 aa, Homo Sapiens; identical to SEQ ID NO: 7723

SEQ ID NO: 7725 - protein, 243 aa, Homo Sapiens; identical to SEQ ID NO: 7723

SEQ ID NO: 7726 - protein, 243 aa, Homo Sapiens; identical to SEQ ID NO: 7723

SEQ ID NO: 7727 - protein, 481 aa, Homo Sapiens
MGALARALPSILLALLLTSTPEALGANPGLVARITDKGLQYAAQEGLLALQSELLRITLPDFTGDLRIPHVGRGRYEFHSLNIHSCELLHSALRPVPGQGLSLSISDSSIRVQGRWKVRKSFFKLQGSFDVSVKGISISVNLLLGSESSGRPTVTASSCSSDIADVEVDMSGDLGWLLNLFHNQIESKFQKVLESRICEMIQKSVSSDLQPYLQTLPVTTEIDSFADIDYSLVEAPRATAQMLEVMFKGEIFHRNHRSPVTLLAAVMSLPEEHNKMVYFAISDYVFNTASLVYHEEGYLNFSITDDMIPPDSNIRLTTKSFRPFVPRLARLYPNMNLELQGSVPSAPLLNFSPGNLSVDPYMEIDAFVLLPSSSKEPVFRLSVATNVSATLTFNTSKITGFLKPGKVKVELKESKVGLFNAELLEALLNYYILNTFYPKFNDKLAEGFPLPLLKRVQLYDLGLQIHKDFLFLGANVQYMRV

SEQ ID NO: 7728 - protein, 255 aa, Homo Sapiens
MCYRKTEDFFTIWLDLNMFLPLGVDCWIDNTRVVYNRSSGLVSNAPGVQIRVPGFGKTYSVEYLDSSKLAGYLHTLVQNLVNNGYVRDETVRAAPYDWRLEPGQQEEYYRKLAGLVEEMHAAYGKPVFLIGHSLGCLHLLYFLLRQPQAWKDRFIDGFISLGAPWGGSIKPMLVLASGDNQGIPIMSSIKLKEEQRITTTSPWMFPSRMAWPEDHVFISTPSFNYTGRDFQRFFADLHFEEGWYMWLQSRDLLAG

SEQ ID NO: 7729 - protein, 93 aa, Homo Sapiens
MGPPGSPWQWVTLLLGLLLPPAAPFWLLNVLFPPHTTPKAELSNHTRPVILARSQAGQTRCGELDVLPQDRGLLHHLAGSQHVPTPWGRLLDR

SEQ ID NO: 7730 - protein, 440 aa, Homo Sapiens
MGPPGSPWQWVTLLLGLLLPPAAPFWLLNVLFPPHTTPKAELSNHTRPVILVPGCLGNQLEAKLDKPDVVNWMCYRKTEDFFTIWLDLNMFLPLGVDCWIDNTRVVYNRSSGLVSNAPGVQIRVPGFGKTYSVEYLDSSKLAGYLHTLVQNLVNNGYVRDETVRAAPYDWRLEPGQQEEYYRKLAGLVEEMHAAYGKPVFLIGHSLGCLHLLYFLLRQPQAWKDRFIDGFISLGAPWGGSIKPMLVLASGDNQGIPIMSSIKLKEEQRITTTSPWMFPSRMAWPEDHVFISTPSFNYTGRDFQRFFADLHFEEGWYMWLQSRDLLAGLPAPGVEVYCLYGVGLPTPRTYIYDHGFPYTDPVGVLYEDGDDTVATRSTELCGLWQGRQPQPVHLLPLHGIQHLNMVFSNLTLEHINAILLGAYRQGPPASPTASPEPPPPE

SEQ ID NO: 7731 - protein, 61 aa, Homo Sapiens
SPRPGRTALLMASSLLGLPGVAPSSPCWSWPQECLCPGMCFTEDGSARARARPPEAPPALP

SEQ ID NO: 7732 - protein, 138 aa, Homo Sapiens
VQIRVPGFGKTYSVEYLDSSKLAGYLHTLVQNLVNNGYVRDETVRAAPYDWRLEPGQQEEYYRKLAGLVEEMHAAYGKPVFLIGHSLGCLHLLYFLLRQPQAWKDRFIDGFISLGAPWGGSIKPMLVLASETGSHCIA

SEQ ID NO: 7733 - protein, 80 aa, Homo Sapiens
  misc_feature (1)..(1): Xaa can be any naturally occurring amino acid
XEYYRKLAGLVEEMHAAYGKPVFLIGHSLGCLHLLYFLLRQPQAWKDRFIDGFISLGAPWGGSIKPMLVLASGSGTRAQH

SEQ ID NO: 7734 - protein, 107 aa, Homo Sapiens
  misc_feature (1)..(1): Xaa can be any naturally occurring amino acid
XLPLGVDCWIDNTRVVYNRSSGLVSNAPGVQIRVPGFGKTYSVEYLDSSKLAGPPATACAPAAPARDTASQHGLQQPDPGAHQCHPAGCLPPGSPCIPDCQPRAPAS

SEQ ID NO: 7735 - protein, 176 aa, Homo Sapiens
MKPLLLAVSLGLIAALQAHHLLASDEEIQDVSGTWYLKAMTVDREFPEMNLESVTPMTLTTLEGGNLEAKVTMLISGRCQEVKAVLEKTDEPGKYTADGGKHVAYIIRSHVKDHYIFYCEGELHGKPVRGVKLVGRDPKNNLEALEDFEKAAGARGLSTESILIPRQSETCSPGSD

SEQ ID NO: 7736 - protein, 176 aa, Homo Sapiens; identical to SEQ ID NO: 7735

SEQ ID NO: 7737 - protein, 86 aa, Homo Sapiens
MRQGLLVLALVLVLVLVLAAGSQVQEWYPRESHALNWNKFSGFWYILATATDAQGFLPARDKRKLGASVVKVNKVGQLRVLLAFRR

SEQ ID NO: 7738 - protein, 187 aa, Homo Sapiens
MRQGLLVLALVLVLVLVLAAGSQVQEWYPRESHALNWNKFSGFWYILATATDAQGFLPARDKRKLGASVVKVNKVGQLRVLLAFRRGQGCGRAQPRHPGTSGHLWASLSVKGVKAFHVLSTDYSYGLVYLRLGRATQNYKNLLLFHRQNVSSFQSLKEFMDACDILGLSKAAVILPKDASRTHTILP

SEQ ID NO: 7739 - protein, 164 aa, Homo Sapiens
MRQGLLVLALVLVLVLVLAAGSQVQEWYPRESHALNWNKFSGFWYILATATDAQGFLPARDKRKLGASVVKVNKVGQLRVLLAFRRLKGCQSQEVILRKDGKKPVFGNACAYAAGPREGQEGDRQNVSSFQSLKEFMDACDILGLSKAAVILPKDASRTHTILP

SEQ ID NO: 7740 - protein, 200 aa, Homo Sapiens
MRQGLLVLALVLVLVLVLAAGSQVQEWYPRESHALNWNKFSGFWYILATATDAQGFLPARDKRKLGASVVKVNKVGQLRVLLAFRRLKGCQSQEVILRKDGKKPVFGNACAYAAGPREGQEGVKGVKAFHVLSTDYSYGLVYLRLGRATQNYKNLLLFHRQNVSSFQSLKEFMDACDILGLSKAAVILPKDASRTHTILP

SEQ ID NO: 7741 - protein, 75 aa, Homo Sapiens
MRQGLLVLALVLVLVLVLAAGSQVQEWYPRESHALNWNKGQEEAGGVRGKGEQSGPAPRAPRLQTIGRMFRASRV

SEQ ID NO: 7742 - protein, 37 aa, Homo Sapiens
  misc_feature (1)..(1): Xaa can be any naturally occurring amino acid
XTDAQGFLPARDKRKLGASVVKVNKVGQLRVLLAFRR

SEQ ID NO: 7743 - protein, 102 aa, Homo Sapiens
ALLNAFTATFELSDDGRFEVWNAMTRGQHCDTWSYVLIPAAQPGQFTVDHGVGRSWLLPPGTLDQFICLGRAQGLSDDNIVFPDVTGGALDLSSLPWVAAPA

SEQ ID NO: 7744 - protein, 192 aa, Homo Sapiens
MRLLCGLWLWLSLLKVLQAQTPTPLPLPPPMQSFQGNQFQGEWFVLGLAGNSFRPEHRALLNAFTATFELSDDGRFEVWNAMTRGQHCDTWSYVLIPAAQPGQFTVDHGVEPGADREETRVVDSDYTQFALMLSRRHTSRLAVLRISLLGRSWLLPPGTLDQFICLGRAQGLSDDNIVFPDVTGWSPQASVC

SEQ ID NO: 7745 - protein, 90 aa, Homo Sapiens
TFELSDDGRFEVWNAMTRGQHCDTWSYVLIPAAQPGQFTVDHGVDTRAGWPSSGSACWAGAGCCLPGRWTSSSAWAELRASRMTTSSSQM

SEQ ID NO: 7746 - protein, 184 aa, Homo Sapiens
MMSFLLGAILTLLWAPTAQAEVLLQPDFNAEKFSGLWYVVSMASDCRVFLGKKDHLSMSTRAIRPTEEGGLHVHMEFPGADGCNQVDAEYLKVGSEGHFRVPALGYLDVRIVDTDYSSFAVLYIYKELEGALSTMVQLYSRTQDVSPQALKSFQDFYPTLGLPKDMMVMLPQSDACNPESKEAP

SEQ ID NO: 7747 - protein, 200 aa, Homo Sapiens
MPLGLLWLGLALLGALHAQAQDSTSDLIPAPPLSKVPLQQNFQDNQFQGKWYVVGLAGNAILREDKDPQKMYATIYELKEDKSYNVTSVLFREKAQKCDYWIRTFVPGCQPGEFTLGNIKSYPGLTSYLVRVVSTNYNQHAMVFFKKVSQNREYFKITLYGRTKELTSELKENFIRFSKSLGLPENHIVFPVPIDQCIDG

SEQ ID NO: 7748 - protein, 198 aa, Homo Sapiens
MPLGLLWLGLALLGALHAQAQDSTSDLIPAPPLSKVPLQQNFQDNQFQGKWYVVGLAGNAILREDKDPQKMYATIYELKEDKSYNVTSVLFRKKKCDYWIRTFVPGCQPGEFTLGNIKSYPGLTSYLVRVVSTNYNQHAMVFFKKVSQNREYFKITLYGRTKELTSELKENFIRFSKSLGLPENHIVFPVPIDQCIDG

SEQ ID NO: 7749 - protein, 198 aa, Homo Sapiens; identical to SEQ ID NO: 7748

SEQ ID NO: 7750 - protein, 78 aa, Homo Sapiens
MDLIKRNSGWVFENPSIGVLELWVLATNFRDYAIIFTQLEFGDEPFNTVELYSLTETASQEAMGLFTKWSRSLGFLSQ

SEQ ID NO: 7751 - protein, 163 aa, Homo Sapiens
MGGLLLAAFLALVSVPRAQAVWLGRLDPEQLLGPWYVLAVASREKGFAMEKDMKNVVGVVVTLTPENNLRTLSSQHGLGGCDQSVMDLIKRNSGWVFENPSIGVLELWVLATNFRDYAIIFTQLEFGDEPFNTVELYSLTETASQEAMGLFTKWSRSLGFLSQ

SEQ ID NO: 7752 - protein, 152 aa, Homo Sapiens
MEELDRQKIGGFWREVGVASDQSLVLTAPKRVEGLFLTLSGSNLTVKVAYNSSGSCEIEKIVGSEIDSTGKFAFPGHREIHVLDTDYEGYAILRVSLMWRGRNFRVLKYFTRSLEDKDRLGFWKFRELTADTGLYLAARPGRCAELLKEELI

SEQ ID NO: 7753 - protein, 175 aa, Homo Sapiens
MPGAAEALPTVTVTLVAGAVPPASGALTAHCIGGFWREVGVASDQSLVLTAPKRVEGLFLTLSGSNLTVKVAYNSSGSCEIEKIVGSEIDSTGKFAFPGHREIHVLDTDYEGYAILRVSLMWRGRNFRVLKYFTRSLEDKDRLGFWKFRELTADTGLYLAARPGRCAELLKEELI

SEQ ID NO: 7754 - protein, 176 aa, Homo Sapiens [sequence omitted]

SEQ ID NO: 7755 - protein, 176 aa, Homo Sapiens
MALLLLSLGLSLIAAQEFDPHTVMQRNYNVARVSGVWYSIFMASDDLNRIKENGDLRVFVRNIEHLKNGSLIFDFEYMVQGECVAVVVVCEKTEKNGEYSINYEGQNTVAVSETDYRLFITFHLQNFRNGTETHTLALYETCEKYGLGSQNIIDLTNKDPCYSKHYRSPPRPPMRW

SEQ ID NO: 7756 - protein, 518 aa, Homo Sapiens
MDEKCSFCNLQREAVSDCIPSLDSSQSTPTEELSSQGQSNTDKIECQAENYLNALFRKKDLPQNCDPNIPLVAQELMKKMIRQFAIEYISKSGKTQENRNGSIGPSIVCKSIQMNQAENSLQEEQEGPLDLTVNRMQEQNTQQGDGVLDLSTKKTSIKSEESSICDPSSENSVAGRLHRNREDYVERSAEFADGLLSKALKDIQSGALDINKAGILYGIPQKTLLLHLEALPAGKPASFKNKTRDFHDSYSYKDSKETCAVLQKVALWARAQAERTEKSKLNLLETSEIKFPTASTYLHQLTLQKMVTQFKEKNESLQYETSNPTVQLKIPQLRVSSVSKSQPDGSGLLDVMYQVSKTSSVLEGSALQKLKNILPKQNKIECSGPVTHSSVDSYFLHGDLSPLCLNSKNGTVDGTSENTEDGLDRKDSKQPRKKRGRYRQYDHEIMEEAIAMVMSGKMSVSKAQGIYGVPHSTLEYKVKERSGTLKTPPKKKLRLPDTGLYNMTDSGTGSCKNSSKPV

SEQ ID NO: 7757 - protein, 318 aa, Homo Sapiens
MDKGRERMAAAAAAAAAAAAAAQCRSPRCAAERRGFRRELDSWRHRLMHCVGFESILEGLYGPRLRRDLSLFEDCEPEELTDWSMDEKCSFCNLQREAVSDCIPSLDSSQSTPTEELSSQGQSNTDKIECQAENYLNALFRKKDLPQNCDPNIPLVAQELMKKMIRQFAIEYISKSGKTQENRNGSIGPSIVCKSIQMNQAENSLQEEQEGPLDLTVNRMQEQNTQQGDGVLDLSTKKTSIKSEESSICDPSSENSVAGMLQVKTDEKLNVSDENTASCPLSPIKMCLNRPIEWNLNLTTASLTSCTVHNQNLKSEEK

SEQ ID NO: 7758 - protein, 602 aa, Homo Sapiens
MDKGRERMAAAAAAAAAAAAAAQCRSPRCAAERRGFRRELDSWRHRLMHCVGFESILEGLYGPRLRRDLSLFEDCEPEELTDWSMDEKCSFCNLQREAVSDCIPSLDSSQSTPTEELSSQGQSNTDKIECQAENYLNALFRKKDLPQNCDPNIPLVAQELMKKMIRQFAIEYISKSGKTQENRNGSIGPSIVCKSIQMNQAENSLQEEQEGPLDLTVNRMQEQNTQQGDGVLDLSTKKTSIKSEESSICDPSSENSVAGRLHRNREDYVERSAEFADGLLSKALKDIQSGALDINKAGILYGIPQKTLLLHLEALPAGKPASFKNKTRDFHDSYSYKDSKETCAVLQKVALWARAQAERTEKSKLNLLETSEIKFPTASTYLHQLTLQKMVTQFKEKNESLQYETSNPTVQLKIPQLRVSSVSKSQPDGSGLLDVMYQVSKTSSVLEGSALQKLKNILPKQNKIECSGPVTHSSVDSYFLHGDLSPLCLNSKNGTVDGTSENTEDGLDRKDSKQPRKKRGRYRQYDHEIMEEAIAMVMSGKMSVSKAQGIYGVPHSTLEYKVKERSGTLKTPPKKKLRLPDTGLYNMTDSGTGSCKNSSKPV

SEQ ID NO: 7759 - protein, 1871 aa, Homo Sapiens
MDKGRERMAAAAAAAAAAAAAAQCRSPRCAAERRGFRRELDSWRHRLMHCVGFESILEGLYGPRLRRDLSLFEDCEPEELTDWSMDEKCSFCNLQREAVSDCIPSLDSSQSTPTEELSSQGQSNTDKIECQAENYLNALFRKKDLPQNCDPNIPLVAQELMKKMIRQFAIEYISKSGKTQENRNGSIGPSIVCKSIQMNQAENSLQEEQEGPLDLTVNRMQEQNTQQGDGVLDLSTKKTSIKSEESSICDPSSENSVAGSTVDAKSEEATKMEKRKSALNKVLESLCIHHQQQVLAMLKFLVQEQNAASLCCCNTSCVVSSESQKPLIEDDLCGLFCSCEYRLAERGCLQNEKQSPGLEPLPVCIKDLHCLSCQTVTVEHVKPVVNRGIADSYNSHRCCSGLLPNIHSTKSAFRSPLLSKEVCDLSVTLKDACRSRSPSPPPLSPIETEGFEKLKDVISEISALENNKLEANINQPPSLTPAEISSNKSDHQDKILKTKKSSNSYSLLSNDSNNSTTNHEKGETAVIFQDLMDRINEKLKSIETTDMTSLVKLSSSDYNTYNDLKLGDFITSLLHNAKASDYSFMELLSQHDKKVENKIIQTRFRKRQETLFAMRNSSDSPMFRRQSLQIKRELASLDENFTRKKYTEKSSRKLTQNNEISSSDKGEFYHDQGPSLQNSKRLQGKNHAETSFSPNYALQSLQLPLHSSETNLSFNEFSESFKTTSPEKMSIRKPQEKSADGKQFLQNDRKNPKLGNTQTLLRNDVSGLLSRTKRNIVPPGWYSVYVTNNYVFKKSPKAKKVSESTTKNDPVKNIHIESSHNIDLNKIAMNSNLQVVVKRLEDTISIAKKSWNNQPLSEGYKASKKLIEIDGKDQHADRNMTLTLNRMTCKEQSLSKSVVASGNIINSHCMPTVDLNNKRLENLKKSSILDMGRLISSVENVPAKYEGTESSSVSNYSSPIKLMFLSEVKSSEGVKYTLTSVGTSHSNVVLPSEKPTTHHVTEEKTETNEDISNANSENYHSSHYDTDTFQRELNKFSHAKETAGSSTMFIGDINSDKPQEEPKDNSSSATDPSFKRKPGRPKKIGPQVVKQIKRPIGRPPKPKIDQTNITVCQNEPFSAGRKSPECLISEVKEGIYKKSITVTVIYGRSRRTKRHVSEGRVNISNLMSLNNNAGDFPTEYNSPRNISEDKIDLGERISAVASLTTESEILGSGFEYVRPIKNKSVIPQPSKNIIRPNQKPLAISRKPGRPAKVKISGISVTINRTSPQEREVSISSCLPPLEQDNTSGKNLPEEKYDQQCTQMDKIRHTEADIFKNGSKRMIATVPLRHSIRDRKPSLHFLHSLASSSSLIYRNALLHKSYKLHLQKNKSQKEKHRHSKMKIAYKDTPRNRLSRNAKKCLEDNKLVPISEVSLDPIISSNPLLRWWATSASNDSLLEELNNRFEQITNAWVQVSGDEAENCIHKKREHIENDHFKVASPLETCLLELEVSPVKMLFQKKYDLNELCTWFMQTTETQSLSLVRKANARNPLEVINTRGIKLGTKYSDFNASPFRKHFKKFALSSPSKSAEKLHILHKVANSPLLNVKSNLAIARLKRTEFKRLHHERWKREGKLHNHGTVDWNSKRRNLRFFCQNQFLNKTEGETNADIPLQGKSIVDNQCVLPPEIRGDLQQRVVMPDFKIHASFENKFKSEAKENGTNCSQKDFQKGPRLENVCPNSWRSKTLKDCRIFLRKLNCLEHRNTFKLNTIIYSPESTDSGNTHQTHMEESKRFTLRSHSARQNSFKKQSKEIENANTNNPSADEFADHLGNSKLSKCVNFDKNPDSFEVLSNLNKRKRPPWKITEMSTKRHKRQSCNSGQMANYFSKSLACYK

SEQ ID NO: 7760 - protein, 79 aa, Homo Sapiens
MDKGRERMAAAAAAAAAAAAAAQCRSPRCAAERRGFRRELDSWRHRLMHCVGFESILEGLYGPRLRRDLSLFEGLYTIS

SEQ ID NO: 7761 - protein, 77 aa, Homo Sapiens
  misc_feature (1)..(1): Xaa can be any naturally occurring amino acid
XGRERMAAAAAAAAAAAAAAQCRSPRCAAERRGFRRELDSWRHRLMHCVGFESILEGLYGPRLRRDLSLFEGLYTIS

SEQ ID NO: 7762 - protein, 692 aa, Homo Sapiens
MGPWGWKLRWTVALLLAAAGTAVGDRCERNEFQCQDGKCISYKWVCDGSAECQDGSDESQETCLSVTCKSGDFSCGGRVNRCIPQFWRCDGQVDCDNGSDEQGCLTLCEGPNKFKCHSGECITLDKVCNMARDCRDWSDEPIKECGTNECLDNNGGCSHVCNDLKIGYECLCPDGFQLVAQRRCEDIDECQDPDTCSQLCVNLEGGYKCQCEEGFQLDPHTKACKAVGSIAYLFFTNRHEVRKMTLDRSEYTSLIPNLRNVVALDTEVASNRIYWSDLSQRMICSTQLDRAHGVSSYDTVISRDIQAPDGLAVDWIHSNIYWTDSVLGTVSVADTKGVKRKTLFRENGSKPRAIVVDPVHGFMYWTDWGTPAKIKKGGLNGVDIYSLVTENIQWPNGITLDLLSGRLYWVDSKLHSISSIDVNGGNRKTILEDEKRLAHPFSLAVFEDKVFWTDIINEAIFSANRLTGSDVNLLAENLLSPEDMVLFHNLTQPRGVNWCERTTLSNGGCQYLCLPAPQINPHSPKFTCACPDGMLLARDMRSCLTEAEAAVATQETSTVRLKVSSTAVRTQHTTTRPVPDTSRLPGATPGLTTVEIVTMSHQALGDVAGRGNEKKPSSVRALSIVLPIVLLVFLCLGVFLLWKNWRLKNINSINFDNPVYQKTTEDEVHICHNQDGYSYPSRQMVSLEDDVA

SEQ ID NO: 7763 - protein, 860 aa, Homo Sapiens [sequence omitted]

SEQ ID NO: 7764 - protein, 858 aa, Homo Sapiens
MGPWGWKLRWTVALLLAAAGTAVGDRCERNEFQCQDGKCISYKWVCDGSAECQDGSDESQETCLSVTCKSGDFSCGGRVNRCIPQFWRCDGQVDCDNGSDEQGCPPKTCSQDEFRCHDGKCISRQFVCDSDRDCLDGSDEASCPVLTCGPASFQCNSSTCIPQLWACDNDPDCEDGSDEWPQRCRGLYVFQGDSSPCSAFEFHCLSGECIHSSWRCDGGPDCKDKSDEENCAVATCRPDEFQCSDGNCIHGSRQCDREYDCKDMSDEVGCVNVTLCEGPNKFKCHSGECITLDKVCNMARDCRDWSDEPIKECGTNECLDNNGGCSHVCNDLKIGYECLCPDGFQLVAQRRCEDIDECQDPDTCSQLCVNLEGGYKCQCEEGFQLDPHTKACKAVGSIAYLFFTNRHEVRKMTLDRSEYTSLIPNLRNVVALDTEVASNRIYWSDLSQRMICSTQLDRAHGVSSYDTVISRDIQAPDGLAVDWIHSNIYWTDSVLGTVSVADTKGVKRKTLFRENGSKPRAIVVDPVHGFMYWTDWGTPAKIKKGGLNGVDIYSLVTENIQWPNGITLDLLSGRLYWVDSKLHSISSIDVNGGNRKTILEDEKRLAHPFSLAVFEDKVFWTDIINEAIFSANRLTGSDVNLLAENLLSPEDMVLFHNLTQPRGVNWCERTTLSNGGCQYLCLPAPQINPHSPKFTCACPDGMLLARDMRSCLTEAEAAVATQETSTVRLKVSSTAVRTQHTTTRPVPDTSRLPGATPGLTTVEIVTMSHQALGDVAGRGNEKKPSSVRALSIVLPIVLLVFLCLGVFLLWKNWRLKNINSINFDNPVYQKTTEDEVHICHNQDGYSYPSMVSLEDDVA

SEQ ID NO: 7765 - protein, 948 aa, Homo Sapiens
MGPWGWKLRWTVALLLAAAGTAVGDRCERNEFQCQDGKCISYKWVCDGSAECQDGSDESQETCLSVTCKSGDFSCGGRVNRCIPQFWRCDGQVDCDNGSDEQGCPPKTCSQDEFRCHDGKCISRQFVCDSDRDCLDGSDEASCPVLTCGPASFQCNSSTCIPQLWACDNDPDCEDGSDEWPQRCRGLYVFQGDSSPCSAFEFHCLSGECIHSSWRCDGGPDCKDKSDEENCAVATCRPDEFQCSDGNCIHGSRQCDREYDCKDMSDEVGCVNVTLCEGPNKFKCHSGECITLDKVCNMARDCRDWSDEPIKECGTNECLDNNGGCSHVCNDLKIGYECLCPDGFQLVAQRRCEDIDECQDPDTCSQLCVNLEGGYKCQCEEGFQLDPHTKACKAVGSIAYLFFTNRHEVRKMTLDRSEYTSLIPNLRNVVALDTEVASNRIYWSDLSQRMICSTQLDRAHGVSSYDTVISRDIQAPDGLAVDWIHSNIYWTDSVLGTVSVADTKGVKRKTLFRENGSKPRAIVVDPVHGFMYWTDWGTPAKIKKGGLNGVDIYSLVTENIQWPNGITLDLLSGRLYWVDSKLHSISSIDVNGGNRKTILEDEKRLAHPFSLAVFEDKVFWTDIINEAIFSANRLTGSDVNLLAENLLSPEDMVLFHNLTQPRGVNWCERTTLSNGGCQYLCLPAPQINPHSPKFTCACPDGMLLARDMRSCLTEAEAAVATQETSTVRLKVSSTAVRTQHTTTRPVPDTSRLPGATPGLTTVEIVTMSHQALGDVAGRGNEKKPSSVRALSIVLPIATELGLWSRGQLCDRACLSLQCSSSSFAWGSSFYGRTGGLRTSTASTLTTPSIRRPQRMRSTFATTRTATATPRDRWSVWRMTWREHLPGVPSLPRTLPETSPALFYSKTEKTKALPARALFYIFIHLGGRTGFGQCPCNGLGWDFGFFLSS

SEQ ID NO: 7766 - protein, 682 aa, Homo Sapiens
MGPWGWKLRWTVALLLAAAGTAVGDRCERNEFQCQDGKCISYKWVCDGSAECQDGSDESQETCLSVTCKSGDFSCGGRVNRCIPQFWRCDGQVDCDNGSDEQGCPVATCRPDEFQCSDGNCIHGSRQCDREYDCKDMSDEVGCVNVTLCEGPNKFKCHSGECITLDKVCNMARDCRDWSDEPIKECGTNECLDNNGGCSHVCNDLKIGYECLCPDGFQLVAQRRCEDIDECQDPDTCSQLCVNLEGGYKCQCEEGFQLDPHTKACKAVGSIAYLFFTNRHEVRKMTLDRSEYTSLIPNLRNVVALDTEVASNRIYWSDLSQRMICSTQLDRAHGVSSYDTVISRDIQAPDGLAVDWIHSNIYWTDSVLGTVSVADTKGVKRKTLFRENGSKPRAIVVDPVHGFMYWTDWGTPAKIKKGGLNGVDIYSLVTENIQWPNGITLDLLSGRLYWVDSKLHSISSIDVNGGNRKTILEDEKRLAHPFSLAVFEDKVFWTDIINEAIFSANRLTGSDVNLLAENLLSPEDMVLFHNLTQPREAEAAVATQETSTVRLKVSSTAVRTQHTTTRPVPDTSRLPGATPGLTTVEIVTMSHQALGDVAGRGNEKKPSSVRALSIVLPIVLLVFLCLGVFLLWKNWRLKNINSINFDNPVYQKTTEDEVHICHNQDGYSYPSRQMVSLEDDVA

SEQ ID NO: 7767 - protein, 819 aa, Homo Sapiens
MGPWGWKLRWTVALLLAAAGTAVGDRCERNEFQCQDGKCISYKWVCDGSAECQDGSDESQETCSPKTCSQDEFRCHDGKCISRQFVCDSDRDCLDGSDEASCPVLTCGPASFQCNSSTCIPQLWACDNDPDCEDGSDEWPQRCRGLYVFQGDSSPCSAFEFHCLSGECIHSSWRCDGGPDCKDKSDEENCAVATCRPDEFQCSDGNCIHGSRQCDREYDCKDMSDEVGCVNVTLCEGPNKFKCHSGECITLDKVCNMARDCRDWSDEPIKECGTNECLDNNGGCSHVCNDLKIGYECLCPDGFQLVAQRRCEDIDECQDPDTCSQLCVNLEGGYKCQCEEGFQLDPHTKACKAVGSIAYLFFTNRHEVRKMTLDRSEYTSLIPNLRNVVALDTEVASNRIYWSDLSQRMICSTQLDRAHGVSSYDTVISRDIQAPDGLAVDWIHSNIYWTDSVLGTVSVADTKGVKRKTLFRENGSKPRAIVVDPVHGFMYWTDWGTPAKIKKGGLNGVDIYSLVTENIQWPNGITLDLLSGRLYWVDSKLHSISSIDVNGGNRKTILEDEKRLAHPFSLAVFEDKVFWTDIINEAIFSANRLTGSDVNLLAENLLSPEDMVLFHNLTQPRGVNWCERTTLSNGGCQYLCLPAPQINPHSPKFTCACPDGMLLARDMRSCLTEAEAAVATQETSTVRLKVSSTAVRTQHTTTRPVPDTSRLPGATPGLTTVEIVTMSHQALGDVAGRGNEKKPSSVRALSIVLPIVLLVFLCLGVFLLWKNWRLKNINSINFDNPVYQKTTEDEVHICHNQDGYSYPSRQMVSLEDDVA

SEQ ID NO: 7768 - protein, 945 aa, Homo Sapiens
  misc_feature (1)..(1): Xaa can be any naturally occurring amino acid
XGRPGVPPRFLSQRRRQVPGPRSRLRDIHESPSVILGPPGEVPGFRCALWRHLRPHLVLGGALAPPAPIKFTEGPPATLKASVPYEVETLPQNLPAPPWSAAEIFSHVGDRCERNEFQCQDGKCISYKWVCDGSAECQDGSDESQETCLSVTCKSGDFSCGGRVNRCIPQFWRCDGQVDCDNGSDEQGCPPKTCSQDEFRCHDGKCISRQFVCDSDRDCLDGSDEASCPVLTCGPASFQCNSSTCIPQLWACDNDPDCEDGSDEWPQRCRGLYVFQGDSSPCSAFEFHCLSGECIHSSWRCDGGPDCKDKSDEENCAVATCRPDEFQCSDGNCIHGSRQCDREYDCKDMSDEVGCVNVTLCEGPNKFKCHSGECITLDKVCNMARDCRDWSDEPIKECGTNECLDNNGGCSHVCNDLKIGYECLCPDGFQLVAQRRCEDIDECQDPDTCSQLCVNLEGGYKCQCEEGFQLDPHTKACKAVGSIAYLFFTNRHEVRKMTLDRSEYTSLIPNLRNVVALDTEVASNRIYWSDLSQRMICSTQLDRAHGVSSYDTVISRDIQAPDGLAVDWIHSNIYWTDSVLGTVSVADTKGVKRKTLFRENGSKPRAIVVDPVHGFMYWTDWGTPAKIKKGGLNGVDIYSLVTENIQWPNGITLDLLSGRLYWVDSKLHSISSIDVNGGNRKTILEDEKRLAHPFSLAVFEDKVFWTDIINEAIFSANRLTGSDVNLLAENLLSPEDMVLFHNLTQPRGVNWCERTTLSNGGCQYLCLPAPQINPHSPKFTCACPDGMLLARDMRSCLTEAEAAVATQETSTVRLKVSSTAVRTQHTTTRPVPDTSRLPGATPGLTTVEIVTMSHQALGDVAGRGNEKKPSSVRALSIVLPIVLLVFLCLGVFLLWKNWRLKNINSINFDNPVYQKTTEDEVHICHNQDGYSYPSRQMVSLEDDVA

SEQ ID NO: 7769 - protein, 309 aa, Homo Sapiens
  misc_feature (1)..(1): Xaa can be any naturally occurring amino acid
XLDGSDEASCPVLTCGPASFQCNSSTCIPQLWACDNDPDCEDGSDEWPQRCRGLYVFQGDSSPCSAFEFHCLSGECIHSSWRCDGGPDCKDKSDEENCAVATCRPDEFQCSDGNCIHGSRQCDREYDCKDMSDEVGCVNVTLCEGPNKFKCHSGECITLDKVCNMARDCRDWSDEPIKECDIDECQDPDTCSQLCVNLEGGYKCQCEEGFQLDPHTKACKAVGSIAYLFFTNRHEVRKMTLDRSEYTSLIPNLRNVVALDTEVASNRIYWSDLSQRMICSTQLDRAHGVSSYDTVISRDIQAPDGLAVD

SEQ ID NO: 7770 - protein, 170 aa, Homo Sapiens
  misc_feature (1)..(1): Xaa can be any naturally occurring amino acid
XNVVALDTEVASNRIYWSDLSQRMICSTQLDRAHGVSSYDTVISRDIQAPDGLAVDWIHSNIYWTDSVLGTVSVADTKGVKRKTLFRENGSKPRAIVVDPVHGFMYWTDWGTPAKIKKGGLNGVDIYSLVTENIQWPNGITLGQSILDRYHQRSHFQCQPPHRFRCQLVG

SEQ ID NO: 7771 - protein, 272 aa, Homo Sapiens
MEACCLLQLPQRLLLLGAAALTATALETADLAELCGQTWQGDGLLLRSHAASRRFYFVAPDTDCGLWVQAAAPGDRIRFQFRFFLVYSLTPAPPALNTSSPAPADPCAPGSYLQFYEGPPGAPRPLGSPLCGLNIPVPVASSGPFLGLRLVTRGRQPRVDFVGEVTSFRLGPCGAYFRCQNGRCIPSSLVCDPWGMDNCGDGSDQGSWSPADCRGPSPVPSQTGSTDAHTSRSLTPSPALGSAGSLWIAAERSSPAGRDPTRQDAALEGSTE

SEQ ID NO: 7772 - protein, 272 aa, Homo Sapiens; identical to SEQ ID NO: 7771

SEQ ID NO: 7773 - protein, 77 aa, Homo Sapiens
MWHLKLCAVLMIFLLLLGQIDGSPIPEVSSAKRRPRRMTPFWRGVSLRPIGASCRDDSECITRLCRKRRCSLSVAQE

SEQ ID NO: 7774 - protein, 131 aa, Homo Sapiens
MFSTKALLLAGLISTALAGPWANICAGKSSNEIRTCDRHGCGQYSAQRSQRPHQGVDILCSAGSTVYAPFTGMIVGQEKPYQNKNAINNGVRISGREITTDTPIFNNYYPDQSAAVNIKTRSSTSKKMMTH

SEQ ID NO: 7775 - protein, 151 aa, Homo Sapiens
MFSTKALLLAGLISTALAGPWANICAGKSSNEIRTCDRHGCGQYSAQRSQRPHQGVDILCSAGSTVYAPFTGMIVGQEKPYQNKNAINNGVRISGRGFCVKMFYIKPIKYKGPIKKGEKLGTLLPLQKVYPGIQSHVHIENCDSSDPTAYL

SEQ ID NO: 7776 - protein, 111 aa, Homo Sapiens
MFSTKALLLAGLISTALAGPWANICAGKSSNEIRTCDRHGCGQYSAQRSQRPHQGVDILCSAGSTVYAPFTGMIVGQEKPYQNKNAINNGVRISGRGKRGGVYTWGASWRC

SEQ ID NO: 7777 - protein, 79 aa, Homo Sapiens
MIVGQEKPYQNKNAINNGVRISGRGFCVKMFYIKPIKYKGPIKKGEKLGTLLPLQKVYPGIQSHVHIENCDSSDPTAYL

SEQ ID NO: 7778 - protein, 64 aa, Homo Sapiens
MEQRLPPNSELVQAVLRLFQEPVPKAALHRHGRLSPRSARARVTVEWLRVRDDGSNRTSLIDSR

SEQ ID NO: 7779 - protein, 366 aa, Homo Sapiens
MQPLWLCWALWVLPLASPGAALTGEQLLGSLLRQLQLKEVPTLDRADMEELVIPTHVRAQYVALLQRSHGDRSRGKRFSQSFREVAGRFLALEASTHLLVFGMEQRLPPNSELVQAVLRLFQEPVPKAALHRHGRLSPRSARARVTVEWLRVRDDGSNRTSLIDSRLVSVHESGWKAFDVTEAVNFWQQLSRPRQPLLLQVSVQREHLGPLASGAHKLVRFASQGAPAGLGEPQLELHTLDLGDYGAQGDCDPEAPMTEGTRCCRQEMYIDLQGMKWAENWVLEPPGFLAYECVGTCRQPPEALAFKWPFLGPRQCIASETDSLPMIVSIKEGGRTRPQVVSLPNMRVQKCSCASDGALVPRRLQP

SEQ ID NO: 7780 - protein, 332 aa, Homo Sapiens
MWPLWLCWALWVLPLAGPGAALTEEQLLGSLLRQLQLSEVPVLDRADMEKLVIPAHVRAQYVVLLRRSHGDRSRGKRFSQSFREVAGRFLASEAALHRHGRLSPRSAQARVTVEWLRVRDDGSNRTSLIDSRLVSVHESGWKAFDVTEAVNFWQQLSRPRQPLLLQVSVQREHLGPLASGAHKLVRFASQGAPAGLGEPQLELHTLDLRDYGAQGDCDPEAPMTEGTRCCRQEMYIDLQGMKWAKNWVLEPPGFLAYECVGTCQQPPEALAFNWPFLGPRQCIASETASLPMIVSIKEGGRTRPQVVSLPNMRVQKCSCASDGALVPRRLQP

SEQ ID NO: 7781 - protein, 366 aa, Homo Sapiens
MWPLWLCWALWVLPLAGPGAALTEEQLLGSLLRQLQLSEVPVLDRADMEKLVIPAHVRAQYVVLLRRSHGDRSRGKRFSQSFREVAGRFLASEASTHLLVFGMEQRLPPNSELVQAVLRLFQEPVPKAALHRHGRLSPRSAQARVTVEWLRVRDDGSNRTSLIDSRLVSVHESGWKAFDVTEAVNFWQQLSRPRQPLLLQVSVQREHLGPLASGAHKLVRFASQGAPAGLGEPQLELHTLDLRDYGAQGDCDPEAPMTEGTRCCRQEMYIDLQGMKWAKNWVLEPPGFLAYECVGTCQQPPEALAFNWPFLGPRQCIASETASLPMIVSIKEGGRTRPQVVSLPNMRVQKCSCASDGALVPRRLQP

SEQ ID NO: 7782 - protein, 167 aa, Homo Sapiens
MHWGTLCGFLWLWPYLFYVQAVPIQKVQDDTKTLIKTIVTRINDISHTQSVSSKQKVTGLDFIPGLHPILTLSKMDQTLAVYQQILTSMPSRNVIQISNDLENLRDLLHVLAFSKSCHLPWASGLETLDSLGGVLEASGYSTEVVALSRLQGSLQDMLWQLDLSPGC

SEQ ID NO: 7783 - protein, 308 aa, Homo Sapiens
MDEQTGRLRLDTYCMSAKQIWAWSKCSGRLWDEHMKWMEGWTDRWTDGWMDGWMDEWSPTPALRSYGGGLSQQTFIFTDGEDEALARHTGNVVITNCSAAHSRQALSCKMAVEYDRFIESGRKWFCHVDDDNYVNLRALLRLLASYPHTRDVYVGKPSLDRPIQAMERVSENKVRPVHFWFATGGAGFCISRGLALKMSPWASGGHFMNTAERIRLPDDCTIGYIVEALLGVPLIRSGLFHSHLENLQQVPTSELHEQVTLSYGMFENKRNAVHVKGPFSVEADPSRFRSIHCHLYPDTPWCPRTAIF

SEQ ID NO: 7784 - protein, 248 aa, Homo Sapiens
MKGCLLKADFLLQTFIFTDGEDEALARHTGNVVITNCSAAHSRQALSCKMAVEYDRFIESGRKWFCHVDDDNYVNLRALLRLLASYPHTRDVYVGKPSLDRPIQAMERVSENKVRPVHFWFATGGAGFCISRGLALKMSPWASGGHFMNTAERIRLPDDCTIGYIVEALLGVPLIRSGLFHSHLENLQQVPTSELHEQVTLSYGMFENKRNAVHVKGPFSVEADPSRFRSIHCHLYPDTPWCPRTAIF

SEQ ID NO: 7785 - protein, 379 aa, Homo Sapiens
MLKRCGRRLLLALAGALLACLLVLTADPPPPPLPAERGRRALRSLAGPAGAAPAPGLGAAAAAPGALVRDVHSLSEYFSLLTRARRDAGPPPGAAPRPADGHPRPLAEPLAPRDVFIAVKTTKKFHRARLDLLLETWISRHKEMTFIFTDGEDEALARHTGNVVITNCSAAHSRQALSCKMAVEYDRFIESGRKWFCHVDDDNYVNLRALLRLLASYPHTRDVYVGKPSLDRPIQAMERVSENKVRPVHFWFATGGAGFCISRGLALKMSPWASGGHFMNTAERIRLPDDCTIGYIVEALLGVPLIRSGLFHSHLENLQQVPTSELHEQVTLSYGMFENKRNAVHVKGPFSVEADPSRFRSIHCHLYPDTPWCPRTAIF

SEQ ID NO: 7786 - protein, 361 aa, Homo Sapiens
MLKRCGRRLLLALAGALLACLLVLTADPPPPPLPAERGRRALRSLAGPAGAAPAPGLGAAAAAPGALVRDVHSLSEYFSLLTRARRDAGPPPGAAPRPADGHPRPLAEPLAPRDVFIAVKTTKKFHRARLDLLLETWISRHKEMTFIFTDGEDEALARHTGNVVITNCSAAHSRQALSCKMAVEYDRFIESGRKWFCHVDDDNYVNLRALLRLLASYPHTRDVYVGKPSLDRPIQAMERVSENKVRPVHFWFATGGAGFCISRGLALKMSPWASGGHFMNTAERIRLPDDCTIGYIVEALLGVPLIRSGLFHSHLENLQQVPTSELHEQVTLSYGMFENKRNAVHVKGPFSVEADPSRWGN

SEQ ID NO: 7787 - protein, 250 aa, Homo Sapiens
MTPGRCCLAADIQVETFIFTDGEDEALARHTGNVVITNCSAAHSRQALSCKMAVEYDRFIESGRKWFCHVDDDNYVNLRALLRLLASYPHTRDVYVGKPSLDRPIQAMERVSENKVRPVHFWFATGGAGFCISRGLALKMSPWASGGHFMNTAERIRLPDDCTIGYIVEALLGVPLIRSGLFHSHLENLQQVPTSELHEQVTLSYGMFENKRNAVHVKGPFSVEADPSRFRSIHCHLYPDTPWCPRTAIF

SEQ ID NO: 7788 - protein, 250 aa, Homo Sapiens; identical to SEQ ID NO: 7787

SEQ ID NO: 7789 - protein, 18 aa, Homo Sapiens
MTPPRLFWVWLLVAGTQA

SEQ ID NO: 7790 - protein, 41 aa, Homo Sapiens
MTPPRLFWVWLLVAGTQAPGIPSDDDLEVPGGSPGFRRERW

SEQ ID NO: 7791 - protein, 41 aa, Homo Sapiens; identical to SEQ ID NO: 7790

SEQ ID NO: 7792 - protein, 62 aa, Homo Sapiens
MTPPRLFWVWLLVAGTQGELSPWEIPKAEVWKAGAPWGCSELQGDILPGARGPAVSQIFSPA

SEQ ID NO: 7793 - protein, 62 aa, Homo Sapiens; identical to SEQ ID NO: 7792

SEQ ID NO: 7794 - protein, 144 aa, Homo Sapiens
MTPPRLFWVWLLVAGTQGSGPIMLDEVQCTGTEASLADCKSLGWLKSNCRHERDAGVVCTNETRSTHTLDLSRELSEALGQIFDSQRGCDLSISVNVQGEDALGFCGHTVILTANLEAQALWKEPGSNVTMSVDAECVPMVRDL

SEQ ID NO: 7795 - protein, 48 aa, Homo Sapiens
MTPPRLFWVWLLVAGTQGVNDGDMRLADGGATNQGRVEIFYRGPWPDL

SEQ ID NO: 7796 - protein, 113 aa, Homo Sapiens
MTPPRLFWVWLLVAGTQGVNDGDMRLADGGATNQGRVEIFYRGQWGTVCDNLWDLTDASVVCRALGFENATQALGRAAFGQGRACCLTGRLQVPGLAEEQLQARERRWCGLHQ

SEQ ID NO: 7797 - protein, 88 aa, Homo Sapiens
MTPPRLFWVWLLVAGTQGVNDGDMRLADGGATNQGRVEIFYRGQWGTVCDNLWDLTDASVVCRALGFENATQALGRAAFGQGSGPIML

SEQ ID NO: 7798 - protein, 209 aa, Homo Sapiens
MTPPRLFWVWLLVAGTQGVNDGDMRLADGGATNQGRVEIFYRGQWGTVCDNLWDLTDASVVCRALGFENATQALGRAAFGQGSGPIMLDEVQCTGTEASLADCKSLGWLKSNCRHERDAGVVCTNETRSTHTLDLSRELSEALGQIFDSQRGCDLSISVNVQGEDALGFCGHTVILTANLEAQALWKEPGSNVTMSVDAECVPMVRDLL

SEQ ID NO: 7799 - protein, 210 aa, Homo Sapiens
MTPPRLFWVWLLVAGTQGVNDGDMRLADGGATNQGRVEIFYRGQWGTVCDNLWDLTDASVVCRALGFENATQALGRAAFGQGSGPIMLDEVQCTGTEASLADCKSLGWLKSNCRHERDAGVVCTNETRSTHTLDLSRELSEALGQIFDSQRGCDLSISVNVQGEDALGFCGHTVILTANLEAQALWKEPGSNVTMSVDAECVPMVRDLLR

SEQ ID NO: 7800 - protein, 585 aa, Homo Sapiens
MTPPRLFWVWLLVAGTQGVNDGDMRLADGGATNQGRVEIFYRGQWGTVCDNLWDLTDASVVCRALGFENATQALGRAAFGQGSGPIMLDEVQCTGTEASLADCKSLGWLKSNCRHERDAGVVCTNETRSTHTLDLSRELSEALGQIFDSQRGCDLSISVNVQGEDALGFCGHTVILTANLEAQALWKEPGSNVTMSVDAECVPMVRDLLRYFYSRRIDITLSSVKCFHKLASAYGARQLQGYCASLFAILLPQDPSFQMPLDLYAYAVATGDALLEKLCLQFLAWNFEALTQAEAWPSVPTDLLQLLLPRSDLAVPSELALLKAVDTWSWGERASHEEVEGLVEKIRFPMMLPEELFELQFNLSLYWSHEALFQKKTLQALEFHTVPFQLLARYKGLNLTEDTYKPRIYTSPTWSAFVTDSSWSARKSQLVYQSRRGPLVKYSSDYFQAPSDYRYYPYQSFQTPQHPSFLFQDKRVSWSLVYLPTIQSCWNYGFSCSSDELPVLGLTKSGGSDRTIAYENKALMLCEGLFVADVTDFEGWKAAIPSALDTNSSKSTSSFPCPAGHFNGFRTVIRPFYLTNSSGVD

SEQ ID NO: 7801 - protein, 259 aa, Homo Sapiens
MTPPRLFWVWLLVAGTQGVNDGDMRLADGGATNQGRVEIFYRGQWGTVCDNLWDLTDASVVCRALGFENATQALGRAAFGQGSGPIMLDEVQCTGTEASLADCKSLGWLKSNCRHERDAGVVCTNETRSTHTLDLSRELSEALGQIFDSQRGCDLSISVNVQGEDALGFCGHTVILTANLEAQALWKEPGSNVTMSVDAECVPMVRDLLRYFYSRRIDITLSSVKCFHKLASAYGARQLQGYCASLFAILLPQDPSFQM

SEQ ID NO: 7802 - protein, 131 aa, Homo Sapiens
MTPPRLFWVWLLVAGTQGVNDGDMRLADGGATNQGRVEIFYRGQWGTVCDNLWDLTDASVVCRALGFENATQALGRAAFGQGSGPIMLDEVQCTGTEASLADCKSLGWLKSNCRHERDAGVVCTNGAFQSE

SEQ ID NO: 7803 - protein, 205 aa, Homo Sapiens
MTPPRLFWVWLLVAGTQGVNDGDMRLADGGATNQGRVEIFYRGQWGTVCDNLWDLTDASVVCRALGFENATQALGRAAFGQGSGPIMLDEVQCTGTEASLADCKSLGWLKSNCRHERDAGVVCTNGTSTPEGLTSPCRQSSASTSWPLPMGPGSCRATAQASLPSSSPRTPRSRCPWTCMPMQWPQGTPCWRSSAYSSWPGTSRP

SEQ ID NO: 7804 - protein, 52 aa, Homo Sapiens
MESERSKRMGNACIPLKRIAYFLCLLSALLLTEGKKPAKPKCPAILCEIWFY

SEQ ID NO: 7805 - protein, 72 aa, Homo Sapiens
MESERSKRMGNACIPLKRIAYFLCLLSALLLTEGKKPAKPKCPAVCTCTKDNALCENARSIPRTVPPDVISL

SEQ ID NO: 7806 - protein, 72 aa, Homo Sapiens; identical to SEQ ID NO: 7805

SEQ ID NO: 7807 - protein, 72 aa, Homo Sapiens; identical to SEQ ID NO: 7805

SEQ ID NO: 7808 - protein, 72 aa, Homo Sapiens; identical to SEQ ID NO: 7805

SEQ ID NO: 7809 - protein, 72 aa, Homo Sapiens; identical to SEQ ID NO: 7805

SEQ ID NO: 7810 - protein, 533 aa, Homo Sapiens
MESERSKRMGNACIPLKRIAYFLCLLSALLLTEGKKPAKPKCPAVCTCTKDNALCENARSIPRTVPPDVISLLFTSNSFDVISDDAFIGLPHLEYLFIENNNIKSISRHTFRGLKSLIHLSLANNNLQTLPKDIFKGLDSLTNVDLRGNSFNCDCKLKWLVEWLGHTNATVEDIYCEGPPEYKKRKINSLSSKDFDCIITEFAKSQDLPYQSLSIDTFSYLNDEYVVIAQPFTGKCIFLEWDHVEKTFRNYDNITGTSTVVCKPIVIETQLYVIVAQLFGGSHIYKRDSFANKFIKIQDIEILKIRKPNDIETFKIENNWYFVVADSSKAGFTTIYKWNGNGFYSHQSLHAWYRDTDVEYLEIVRTPQTLRTPHLILSSSSQRPVIYQWNKATQLFTNQTDIPNMEDVYAVKHFSVKGDVYICLTRFIGDSKVMKWGGSSFQDIQRMPSRGSMVFQPLQINNYQYAILGSDYSFTQVYNWDAEKAKFVKFQELNVQAPRSFTHVSINKRNFLFASSFKGNTQIYKHVIVDLSA

SEQ ID NO: 7811 - protein, 96 aa, Homo Sapiens
MESERSKRMGNACIPLKRIAYFLCLLSALLLTEGKKPAKPKCPAVCTCTKDNALCENARSIPRTVPPDVISLSFVRSGFTEISEGSFLFTPSLQLL

SEQ ID NO: 7812 - protein, 96 aa, Homo Sapiens; identical to SEQ ID NO: 7811

SEQ ID NO: 7813 - protein, 236 aa, Homo Sapiens
MESERSKRMGNACIPLKRIAYFLCLLSALLLTEGKKPAKPKCPAVCTCTKDNALCENARSIPRTVPPDVISLSFVRSGFTEISEGSFLFTPSLQLLLFTSNSFDVISDDAFIGLPHLEYLFIENNNIKSISRHTFRGLKSLIHLFRETQTQAENLHCRGAGAPQMAVGDAFLAAEPGGTETNAVFEPVWSALERRLSSGFHSHNRRFSWVNDENTKGQEMVIISVKKEWPSAFENT

SEQ ID NO: 7814 - protein, 151 aa, Homo Sapiens
MESERSKRMGNACIPLKRIAYFLCLLSALLLTEGKKPAKPKCPAVCTCTKDNALCENARSIPRTVPPDVISLSFVRSGFTEISEGSFLFTPSLQLLLFTSNSFDVISDDAFIGLPHLEYLFIENNNIKSISRHTFRGLKSLIHLRDGVGRI

SEQ ID NO: 7815 - protein, 168 aa, Homo Sapiens
MESERSKRMGNACIPLKRIAYFLCLLSALLLTEGKKPAKPKCPAVCTCTKDNALCENARSIPRTVPPDVISLSFVRSGFTEISEGSFLFTPSLQLLLFTSNSFDVISDDAFIGLPHLEYLFIENNNIKSISRHTFRGLKSLIHLSLANNNLQTLPKDIFKGLDSLTNV

SEQ ID NO: 7816 - protein, 168 aa, Homo Sapiens; identical to SEQ ID NO: 7815

SEQ ID NO: 7817 - protein, 557 aa, Homo Sapiens
MESERSKRMGNACIPLKRIAYFLCLLSALLLTEGKKPAKPKCPAVCTCTKDNALCENARSIPRTVPPDVISLSFVRSGFTEISEGSFLFTPSLQLLLFTSNSFDVISDDAFIGLPHLEYLFIENNNIKSISRHTFRGLKSLIHLSLANNNLQTLPKDIFKGLDSLTNVDLRGNSFNCDCKLKWLVEWLGHTNATVEDIYCEGPPEYKKRKINSLSSKDFDCIITEFAKSQDLPYQSLSIDTFSYLNDEYVVIAQPFTGKCIFLEWDHVEKTFRNYDNITGTSTVVCKPIVIETQLYVIVAQLFGGSHIYKRDSFANKFIKIQDIEILKIRKPNDIETFKIENNWYFVVADSSKAGFTTIYKWNGNGFYSHQSLHAWYRDTDVEYLEIVRTPQTLRTPHLILSSSSQRPVIYQWNKATQLFTNQTDIPNMEDVYAVKHFSVKGDVYICLTRFIGDSKVMKWGGSSFQDIQRMPSRGSMVFQPLQINNYQYAILGSDYSFTQVYNWDAEKAKFVKFQELNVQAPRSFTHVSINKRNFLFASSFKGNTQIYKHVIVDLSA

SEQ ID NO: 7818 - protein, 291 aa, Homo Sapiens
MESERSKRMGNACIPLKRIAYFLCLLSALLLTEGKKPAKPKCPAVCTCTKDNALCENARSIPRTVPPDVISLSFVRSGFTEISEGSFLFTPSLQLLLFTSNSFDVISDDAFIGLPHLEYLFIENNNIKSISRHTFRGLKSLIHLSLANNNLQTLPKDIFKGLDSLTNVDLRGNSFNCDCKLKWLVEWLGHTNATVEDIYCEGPPEYKKRKINSLSSKDFDCIITEFAKSQDLPYQSLSIDTFSYLNDEYVVIAQPFTGKCIFLEWDHVEKTFRNYDNITVLREIHRFTNMS

SEQ ID NO: 7819 - protein, 287 aa, Homo Sapiens
MESERSKRMGNACIPLKRIAYFLCLLSALLLTEGKKPAKPKCPAVCTCTKDNALCENARSIPRTVPPDVISLSFVRSGFTEISEGSFLFTPSLQLLLFTSNSFDVISDDAFIGLPHLEYLFIENNNIKSISRHTFRGLKSLIHLSLANNNLQTLPKDIFKGLDSLTNVDLRGNSFNCDCKLKWLVEWLGHTNATVEDIYCEGPPEYKKRKINSLSSKDFDCIITEFAKSQDLPYQSLSIDTFSYLNDEYVVIAQPFTGKCIFLEWDHVEKTFRNYDNITGQSCWCPQ

SEQ ID NO: 7820 - protein, 281 aa, Homo Sapiens
MESERSKRMGNACIPLKRIAYFLCLLSALLLTEGKKPAKPKCPAVCTCTKDNALCENARSIPRTVPPDVISLSFVRSGFTEISEGSFLFTPSLQLLLFTSNSFDVISDDAFIGLPHLEYLFIENNNIKSISRHTFRGLKSLIHLSLANNNLQTLPKDIFKGLDSLTNVDLRGNSFNCDCKLKWLVEWLGHTNATVEDIYCEGPPEYKKRKINSLSSKDFDCIITEFAKSQDLPYQSLSIDTFSYLNDEYVVIAQPFTGKCIFLEWDHVEKTFRNYDNITGS

SEQ ID NO: 7821 - protein, 509 aa, Homo Sapiens
MESERSKRMGNACIPLKRIAYFLCLLSALLLTEGKKPAKPKCPAVCTCTKDNALCENARSIPRTVPPDVISLSFVRSGFTEISEGSFLFTPSLQLLSLANNNLQTLPKDIFKGLDSLTNVDLRGNSFNCDCKLKWLVEWLGHTNATVEDIYCEGPPEYKKRKINSLSSKDFDCIITEFAKSQDLPYQSLSIDTFSYLNDEYVVIAQPFTGKCIFLEWDHVEKTFRNYDNITGTSTVVCKPIVIETQLYVIVAQLFGGSHIYKRDSFANKFIKIQDIEILKIRKPNDIETFKIENNWYFVVADSSKAGFTTIYKWNGNGFYSHQSLHAWYRDTDVEYLEIVRTPQTLRTPHLILSSSSQRPVIYQWNKATQLFTNQTDIPNMEDVYAVKHFSVKGDVYICLTRFIGDSKVMKWGGSSFQDIQRMPSRGSMVFQPLQINNYQYAILGSDYSFTQVYNWDAEKAKFVKFQELNVQAPRSFTHVSINKRNFLFASSFKGNTQIYKHVIVDLSA

SEQ ID NO: 7822 - protein, 100 aa, Homo Sapiens
MKWGGSSFQDIQRMPSRGSMVFQPLQINNYQYAILGSDYSFTQVYNWDAEKAKFVKFQELNVQAPRSFTHVSINKRNFLFASSFKGNTQIYKHVIVDLSA

SEQ ID NO: 7823 - protein, 545 aa, Homo Sapiens
MALRRGGCGALGLLLLLLGAACLIPRSAQVRRLARCPATCSCTKESIICVGSSWVPRIVPGDISSLSLVNGTFSEIKDRMFSHLPSLQLLLLNSNSFTIIRDDAFAGLFHLEYLFIEGNKIETISRNAFRGLRDLTHLSLANNHIKALPRDVFSDLDSLIELDLRGNKFECDCKAKWLYLWLKMTNSTVSDVLCIGPPEYQEKKLNDVTSFDYECTTTDFVVHQTLPYQSVSVDTFNSKNDVYVAIAQPSMENCMVLEWDHIEMNFRSYDNITGQSIVGCKAILIDDQVFVVVAQLFGGSHIYKYDESWTKFVKFQDIEVSRISKPNDIELFQIDDETFFVIADSSKAGLSTVYKWNSKGFYSYQSLHEWFRDTDAEFVDIDGKSHLILSSRSQVPIILQWNKSSKKFVPHGDIPNMEDVLAVKSFRMQNTLYLSLTRFIGDSRVMRWNSKQFVEIQALPSRGAMTLQPFSFKDNHYLALGSDYTFSQIYQWDKEKQLFKKFKEIYVQAPRSFTAVSTDRRDFFFASSFKGKTKIFEHIIVDLSL

SEQ ID NO: 7824 - protein, 256 aa, Homo Sapiens
  misc_feature (1)..(1): Xaa can be any naturally occurring amino acid
XLGLLLLLLGAACLIPRSAQVRRLARCPATCSCTKESIICVGSSWVPRIVPGDISSLSLVNGTFSEIKDRMFSHLPSLQLLLLNSNSFTIIRDDAFAGLFHLEYLFIEGNKIETISRNAFRGLRDLTHLSLANNHIKALPRDVFSDLDSLIELDLRGNKFECDCKAKWLYLWLKMTNSTVSDVLCIGPPEYQEKKLNDVTSFDYECTTTDKQEEICEGKIQNLNARVVMNCSRPSSAFRKHTGNGRVAFFLPHGVR

SEQ ID NO: 7825 - protein, 134 aa, Homo Sapiens
MAGLRARGGPGPGLLALSALGFCLMLQVSAKRPPKTPPCPPSCSCTRDTAFCVDSKAVPRNLPSEVISLTALADPTVLTRVSPQDPGECRLLRDPGWSVLPPPAAAVLVTQLQQVYTDWRQRLHRTVAPAVSLH

SEQ ID NO: 7826 - protein, 548 aa, Homo Sapiens
MAGLRARGGPGPGLLALSALGFCLMLQVSAKRPPKTPPCPPSCSCTRDTAFCVDSKAVPRNLPSEVISLTLVNAAFSEIQDGAFSHLPLLQFLLLNSNKFTLIGDNAFTGLSHLQYLFIENNDIWALSKFTFRGLKSLTHLSLANNNLQTLPRDIFRPLDILNDLDLRGNSLNCDCKVKWLVEWLAHTNTTVAPIYCASPPRFQEHKVQDLPLREFDCITTDFVLYQTLAFPAVSAEPFLYSSDLYLALAQPGVSACTILKWDYVERQLRDYDRIPAPSAVHCKPMVVDSQLYVVVAQLFGGSYIYHWDPNTTRFTRLQDIDPQRVRKPNDLEAFRIDGDWYFAVADSSKAGATSLYRWHQNGFYSHQALHPWHRDTDLEFVDGEGKPRLIVSSSSQAPVIYQWSRTQKQFVAQGEVTQVPDAQAVKHFRAGRDSYLCLSRYIGDSKILRWEGTRFSEVQALPSRGSLALQPFLVGGRRYLALGSDFSFTQIYQWDEGRQKFVRFQELAVQAPRAFCYMPAGDAQLLLAPSFKGQTLVYRHIVVDLSA

SEQ ID NO: 7827 - protein, 524 aa, Homo Sapiens
MAGLRARGGPGPGLLALSALGFCLMLQVSAKRPPKTPPCPPSCSCTRDTAFCVDSKAVPRNLPSEVISLTLVNAAFSEIQDGAFSHLPLLQFLLLNSNKFTLIGDNAFTGLSHLQYLSLANNNLQTLPRDIFRPLDILNDLDLRGNSLNCDCKVKWLVEWLAHTNTTVAPIYCASPPRFQEHKVQDLPLREFDCITTDFVLYQTLAFPAVSAEPFLYSSDLYLALAQPGVSACTILKWDYVERQLRDYDRIPAPSAVHCKPMVVDSQLYVVVAQLFGGSYIYHWDPNTTRFTRLQDIDPQRVRKPNDLEAFRIDGDWYFAVADSSKAGATSLYRWHQNGFYSHQALHPWHRDTDLEFVDGEGKPRLIVSSSSQAPVIYQWSRTQKQFVAQGEVTQVPDAQAVKHFRAGRDSYLCLSRYIGDSKILRWEGTRFSEVQALPSRGSLALQPFLVGGRRYLALGSDFSFTQIYQWDEGRQKFVRFQELAVQAPRAFCYMPAGDAQLLLAPSFKGQTLVYRHIVVDLSA

SEQ ID NO: 7828 - protein, 198 aa, Homo Sapiens
MCPCRDRTLVNAAFSEIQDGAFSHLPLLQFLLLNSNKFTLIGDNAFTGLSHLQYLFIENNDIWALSKFTFRGLKSLTHLSLANNNLQTLPRDIFRPLDILNDLDLRGNSLNCDCKVKWLVEWLAHTNTTVAPIYCASPPRFQEHKVQDLPLREFDCITTDFVLYQTLAFPAVSAEPFLYSSDLYLALAQPGVSACTIL

SEQ ID NO: 7829 - protein, 537 aa, Homo Sapiens
MGGAGILLLLLAGAGVVVAWRPPKGKCPLRCSCSKDSALCEGSPDLPVSFSPTLLSLSLVRTGVTQLKAGSFLRIPSLHLLLFTSNSFSVIEDDAFAGLSHLQYLFIEDNEIGSISKNALRGLRSLTHLSLANNHLETLPRFLFRGLDTLTHVDLRGNPFQCDCRVLWLLQWMPTVNASVGTGACAGPASLSHMQLHHLDPKTFKCRAIELSWFQTVGESALSVEPFSYQGEPHIVLAQPFAGRCLILSWDYSLQRFRPEEELPAASVVSCKPLVLGPSLFVLAARLWGGSQLWARPSPGLRLAPTQTLAPRRLLRPNDAELLWLEGQPCFVVADASKAGSTTLLCRDGPGFYPHQSLHAWHRDTDAEALELDGRPHLLLASASQRPVLFHWTGGRFERRTDIPEAEDVYATRHFQAGGDVFLCLTRYIGDSMVMRWDGSMFRLLQQLPSRGAHVFQPLLIARDQLAILGSDFAFSQVLRLEPDKGLLEPLQELGPPALVAPRAFAHITMAGRRFLFAACFKGPTQIYQHHEIDLSA

SEQ ID NO: 7830 - protein, 494 aa, Homo Sapiens
MGGAGILLLLLAGAGVVVAWRPPKGKCPLRCSCSKDSALCEGSPDLPVSFSPTLLSLSLVRTGVTQLKAGSFLRIPSLHLLLFTSNSFSVIEDDAFAGLSHLQYLFIEDNEIGSISKNALRGLRSLTHLSLANNHLETLPRFLFRGLDTLTHVDLRGNPFQCDCRVLWLLQWMPTVNASVGTGACAGPASLSHMQLHHLDPKTFKCRAIELSWFQTVGESALSVEPFSYQGEPHIVLAQPFAGRCLILSWDYSLQRFRPEEELPGEPPPRPSACPAACLAGLTCLPTSPQRPPWCPASHWCWARASSCWLPACGGAHSCGPGPVPACAWPQRRPWPRGGCCGPMTPSSCGWKGNPASWWPMPPRRAAPRCCAATGPAFTRTRACTPGTGTRTLRPWSWTAGPTCCWPRLPSGPCSSTGPVAASRDAQTSPRPRMSMPHATSRLVGTCSCASHATLGTPWSCAGTAPCFVCCSNFPRAVPTSSSHCSSPGTSWPS

SEQ ID NO: 7831 - protein, 261 aa, Homo Sapiens
MGGAGILLLLLAGAGVVVAWRPPKGKCPLRCSCSKDSALCEGSPDLPVSFSPTLLSLSLVRTGVTQLKAGSFLRIPSLHLLLFTSNSFSVIEDDAFAGLSHLQYLFIEDNEIGSISKNALRGLRSLTHLSLANNHLETLPRFLFRGLDTLTHVDLRGNPFQCDCRVLWLLQWMPTVNASVGTGACAGPASLSHMQLHHLDPKTFKCRAIGGGLSRWGGRREIWGKGCQGQEARLTPCPAISRSGKTLSKQHCLPEPQFSHL

SEQ ID NO: 7832 - protein, 378 aa, Homo Sapiens
  misc_feature (1)..(1): Xaa can be any naturally occurring amino acid
XVIEDDAFAGLSHLQYLFIEDNEIGSISKNALRGLRSLTHLSLANNHLETLPRFLFRGLDTLTHVDLRGNPFQCDCRVLWLLQWMPTVNASVGTGACAGPASLSHMQLHHLDPKTFKCRAIELSWFQTVGESALSVEPFSYQGEPHIVLAQPFAGRCLILSWDYSLQRFRPEEELPAASVVSCKPLVLGPSLFVLAARLWGGSQLWARPSPGLRLAPTQTLAPRRLLRPNDAELLWLEGQPCFVVADASKAGSTTLLCRDGPGFYPHQSLHAWHRDTDAEALELDGRPHLLLASASQRPVLFHWTGGRFERRTDIPEAEDVYATRHFQAGGDVFLCLTRYIGDSMVRLGLGAGGWLFSTDPILHTKPLNSDLPSHADL

SEQ ID NO: 7833 - protein, 19 aa, Homo Sapiens
MVWKVAVFLSVALGIGAVP

SEQ ID NO: 7834 - protein, 57 aa, Homo Sapiens
MVWKVAVFLSVALGIGAVPIDDPEDGGKHWVVIVAGSNGWYNYRHQADACHAYQIIH

SEQ ID NO: 7835 - protein, 58 aa, Homo Sapiens
MVWKVAVFLSVALGIGAVPIDDPEDGGKHWVVIVAGSNGWYNYRHQADACHAYQIIHR

SEQ ID NO: 7836 - protein, 135 aa, Homo Sapiens
MVWKVAVFLSVALGIGAVPIDDPEDGGKHWVVIVAGSNGWYNYRHQADACHAYQIIHRNGIPDEQIVVMINPTPGIVINRPNGTDVYQGVPKDYTGEDVTPQNFLAVLRGDAEAVKGIGSGKVLKSGPQDHVFIY

SEQ ID NO: 7837 - protein, 78 aa, Homo Sapiens
MVWKVAVFLSVALGIGAVPIDDPEDGGKHWVVIVAGSNGWYNYRHQADACHAYQIIHRNGIPDEQIVVMMYDDIAYSE

SEQ ID NO: 7838 - protein, 78 aa, Homo Sapiens; identical to SEQ ID NO: 7837

SEQ ID NO: 7839 - protein, 223 aa, Homo Sapiens
MVWKVAVFLSVALGIGAVPIDDPEDGGKHWVVIVAGSNGWYNYRHQADACHAYQIIHRNGIPDEQIVVMMYDDIAYSEDNPTPGIVINRPNGTDVYQGVPKDYTGEDVTPQNFLAVLRGDAEAVKGIGSGKVLKSGPQDHVFIYFTDHGSTGILVFPNEDLHVKDLNETIHYMYKHKMYRKMVFYIEACESGSMMNHLPDNINGRWLGRRPRPGLASRLLRHR

SEQ ID NO: 7840 - protein, 433 aa, Homo Sapiens
MVWKVAVFLSVALGIGAVPIDDPEDGGKHWVVIVAGSNGWYNYRHQADACHAYQIIHRNGIPDEQIVVMMYDDIAYSEDNPTPGIVINRPNGTDVYQGVPKDYTGEDVTPQNFLAVLRGDAEAVKGIGSGKVLKSGPQDHVFIYFTDHGSTGILVFPNEDLHVKDLNETIHYMYKHKMYRKMVFYIEACESGSMMNHLPDNINVYATTAANPRESSYACYYDEKRSTYLGDWYSVNWMEDSDVEDLTKETLHKQYHLVKSHTNTSHVMQYGNKTISTMKVMQFQGMKRKASSPVPLPPVTHLDLTPSPDVPLTIMKRKLMNTNDLEESRQLTEEIQRHLDARHLIEKSVRKIVSLLAASEAEVEQLLSERAPLTGHSCYPEALLHFRTHCFNWHSPTYEYALRHLYVLVNLCEKPYPLHRIKLSMDHVCLGHY

SEQ ID NO: 7841 - protein, 433 aa, Homo Sapiens; identical to SEQ ID NO: 7840

SEQ ID NO: 7842 - protein, 376 aa, Homo Sapiens
MVWKVAVFLSVALGIGAVPIDDPEDGGKHWVVIVAGSNGWYNYRHQADACHAYQIIHRNGIPDEQIVVMMYDDIAYSEDNPTPGIVINRPNGTDVYQGVPKDYTGEDVTPQNFLAVLRGDAEAVKGIGSGKVLKSGPQDHVFIYFTDHGSTGILVFPNEDLHVKDLNETIHYMYKHKMYRKMVFYIEACESGSMMNHLPDNINVYATTAANPRESSYACYYDEKRSTYLGDWYSVNWMEDSDVEDLTKETLHKQYHLVKSHTNTSHVMQYGNKTISTMKVMQFQGMKRKASSPVPLPPVTHLDLTPSPDVPLTIMKRKLMNTNDLEESRQLTEEIQRHLDYEYALRHLYVLVNLCEKPYPLHRIKLSMDHVCLGHY

SEQ ID NO: 7843 - protein, 372 aa, Homo Sapiens
MVWKVAVFLSVALGIGAVPIDDPEDGGKHWVVIVAGSNGWYNYRHQADACHAYQIIHRNGIPDEQIVVMMYDDIAYSEDNPTPGIVINRPNGTDVYQGVPKDYTGEDVTPQNFLAVLRGDAEAVKGIGSGKVLKSGPQDHVFIYFTDHGSTGILVFPNEDLHVKDLNETIHYMYKHKMYRKMVFYIEACESGSMMNHLPDNINVYATTAANPRESSYACYYDEKRSTYLGDWYSVNWMEDSDVEDLTKETLHKQYHLVKSHTNTSHVMQYGNKTISTMKVMQFQGMKRKASSPVPLPPVTHLDLTPSPDVPLTIMKRKLMNTNDLEESRQLTEEIQRHLDDKIVHGPRVPWSLLKSCLLEAFPSVSAPPTVC

SEQ ID NO: 7844 - protein, 117 aa, Homo Sapiens
MVWKVAVFLSVALGIGAVPIDDPEDGGKHWVVIVAGSNGWYNYRHQADACHAYQIIHRNGIPDEQIVVMMYDDIAYSEDNPTPGIVINRPNGTDVYQGVPKDYTGEWPPGSRVHLLH

SEQ ID NO: 7845 - protein, 48 aa, Homo Sapiens
MVWKVAVFLSVALGIGAVPIDDPEDGGKHWVVIVAGSNGWYNYRHQEL

SEQ ID NO: 7846 - protein, 91 aa, Homo Sapiens
  misc_feature (1)..(1): Xaa can be any naturally occurring amino acid
XPTPGIVINRPNGTDVYQGVPKDYTGEDVTPQNFLAVLRGGVRSLRCSGPPGEPPLQGSLQDLLHKMTCSLLPASPVFSEKLQIRVGKALY

SEQ ID NO: 7847 - protein, 951 aa, Homo Sapiens
MPGPLGLLCFLALGLLGSAGPSGAAPPLCAAPCSCDGDRRVDCSGKGLTAVPEGLSAFTQALDISMNNITQLPEDAFKNFPFLEELQLAGNDLSFIHPKALSGLKELKVLTLQNNQLKTVPSEAIRGLSALQSLRLDANHITSVPEDSFEGLVQLRHLWLDDNSLTEVPVHPLSNLPTLQALTLALNKISSIPDFAFTNLSSLVVLHLHNNKIRSLSQHCFDGLDNLETLDLNYNNLGEFPQAIKALPSLKELGFHSNSISVIPDGAFDGNPLLRTIHLYDNPLSFVGNSAFHNLSDLHSLVIRGASMVQQFPNLTGTVHLESLTLTGTKISSIPNNLCQEQKMLRTLDLSYNNIRDLPSFNGCHALEEISLQRNQIYQIKEGTFQGLISLRILDLSRNLIHEIHSRAFATLGPITNLDVSFNELTSFPTEGLNGLNQLKLVGNFKLKEALAAKDFVNLRSLSVPYAYQCCAFWGCDSYANLNTEDNSLQDHSVAQEKGTADAANVTSTLENEEHSQIIIHCTPSTGAFKPCEYLLGSWMIRLTVWFIFLVALFFNLLVILTTFASCTSLPSSKLFIGLISVSNLFMGIYTGILTFLDAVSWGRFAEFGIWWETGSGCKVAGFLAVFSSESAIFLLMLATVERSLSAKDIMKNGKSNHLKQFRVAALLAFLGATVAGCFPLFHRGEYSASPLCLPFPTGETPSLGFTVTLVLLNSLAFLLMAVIYTKLYCNLEKEDLSENSQSSMIKHVAWLIFTNCIFFCPVAFFSFAPLITAISISPEIMKSVTLIFFPLPACLNPVLYVFFNPKFKEDWKLLKRRVTKKSGSVSVSISSQGGCLEQDFYYDCGMYSHLQGNLTVCDCCESFLLTKPVSCKHLIKSHSCPALAVASCQRPEGYWSDCGTQSAHSDYADEEDSFVSDSSDQVQACGRACFYQSRGFPLVRYAYNLPRVKD

SEQ ID NO: 7848 - protein, 158 aa, Homo Sapiens
MPGPLGLLCFLALGLLGSAGPSGAAPPLCAAPCSCDGDRRVDCSGKGLTAVPEGLSAFTQALDISMNNITQLPEDAFKNFPFLEELRLDANHITSVPEDSFEGLVQLRHLWLDDNSLTEVPVHPLSNLPTLQALTLALNKISSIPDFAFTNLSSLVVL

SEQ ID NO: 7849 - protein, 927 aa, Homo Sapiens
MPGPLGLLCFLALGLLGSAGPSGAAPPLCAAPCSCDGDRRVDCSGKGLTAVPEGLSAFTQALQLAGNDLSFIHPKALSGLKELKVLTLQNNQLKTVPSEAIRGLSALQSLRLDANHITSVPEDSFEGLVQLRHLWLDDNSLTEVPVHPLSNLPTLQALTLALNKISSIPDFAFTNLSSLVVLHLHNNKIRSLSQHCFDGLDNLETLDLNYNNLGEFPQAIKALPSLKELGFHSNSISVIPDGAFDGNPLLRTIHLYDNPLSFVGNSAFHNLSDLHSLVIRGASMVQQFPNLTGTVHLESLTLTGTKISSIPNNLCQEQKMLRTLDLSYNNIRDLPSFNGCHALEEISLQRNQIYQIKEGTFQGLISLRILDLSRNLIHEIHSRAFATLGPITNLDVSFNELTSFPTEGLNGLNQLKLVGNFKLKEALAAKDFVNLRSLSVPYAYQCCAFWGCDSYANLNTEDNSLQDHSVAQEKGTADAANVTSTLENEEHSQIIIHCTPSTGAFKPCEYLLGSWMIRLTVWFIFLVALFFNLLVILTTFASCTSLPSSKLFIGLISVSNLFMGIYTGILTFLDAVSWGRFAEFGIWWETGSGCKVAGFLAVFSSESAIFLLMLATVERSLSAKDIMKNGKSNHLKQFRVAALLAFLGATVAGCFPLFHRGEYSASPLCLPFPTGETPSLGFTVTLVLLNSLAFLLMAVIYTKLYCNLEKEDLSENSQSSMIKHVAWLIFTNCIFFCPVAFFSFAPLITAISISPEIMKSVTLIFFPLPACLNPVLYVFFNPKFKEDWKLLKRRVTKKSGSVSVSISSQGGCLEQDFYYDCGMYSHLQGNLTVCDCCESFLLTKPVSCKHLIKSHSCPALAVASCQRPEGYWSDCGTQSAHSDYADEEDSFVSDSSDQVQACGRACFYQSRGFPLVRYAYNLPRVKD

SEQ ID NO: 7850 - protein, 141 aa, Homo Sapiens
MEMLQGLLLLLLLSMGGAWASREPLRPWCHPINAILAVEKEGCPVCITVNTTICAGYCPTMMRVLQAVLPPLPQVVCTYRDVRFESIRLPGCPRGVDPVVSFPVALSCRCGPCRRSTSDCGGPKDHPLTCDHPQLSGLLFL

SEQ ID NO: 7851 - protein, 699 aa, Homo Sapiens
MKQRFSALQLLKLLLLLQPPLPRALREALCPEPCNCVPDGALRCPGPTAGLTRLSLAYLPVKVIPSQAFRGLNEVIKIEISQIDSLERIEANAFDNLLNLSEILIQNTKNLRYIEPGAFINLPRLKYLSICNTGIRKFPDVTKVFSSESNFILEICDNLHITTIPGNAFQGMNNESVTLKLYGNGFEEVQSHAFNGTTLTSLELKENVHLEKMHNGAFRGATGPKTLDISSTKLQALPSYGLESIQRLIATSSYSLKKLPSRETFVNLLEATLTYPSHCCAFRNLPTKEQNFSHSISENFSKQCESTVRKVNNKTLYSSMLAESELSGWDYEYGFCLPKTPRCAPEPDAFNPCEDIMGYDFLRVLIWLINILAIMGNMTVLFVLLTSRYKLTVPRFLMCNLSFADFCMGLYLLLIASVDSQTKGQYYNHAIDWQTGSGCSTAGFFTVFASELSVYTLTVITLERWHTITYAIHLDQKLRLRHAILIMLGGWLFSSLIAMLPLVGVSNYMKVSICFPMDVETTLSQVYILTILILNVVAFFIICACYIKIYFAVRNPELMATNKDTKIAKKMAILIFTDFTCMAPISFFAISAAFKVPLITVTNSKVLLVLFYPINSCANPFLYAIFTKTFQRDFFLLLSKFGCCKRRAELYRRKDFSAYTSNCKNGFTGSNKPSQSTLKLSTLHCQGTALLDKTRYTEC

SEQ ID NO: 7852 - protein, 672 aa, Homo Sapiens
MKQRFSALQLLKLLLLLQPPLPRALREALCPEPCNCVPDGALRCPGPTAGLTRLSLAYLPVKVIPSQAFRGLNEVIKIEISQIDSLERIEANAFDNLLNLSEILIQNTKNLRYIEPGAFINLPRLKYLSICNTGIRKFPDVTKVFSSESNFILEICDNLHITTIPGNAFQGMNNESVTLKLYGNGFEEVQSHAFNGTTLTSLELKENVHLEKMHNGAFRGATGPKTLDISSTKLQALPSYGLESIQRLIATSSYSLKKLPSRETFVNLLEATLTYPSHCCAFRNLPTKDYSSMLAESELSGWDYEYGFCLPKTPRCAPEPDAFNPCEDIMGYDFLRVLIWLINILAIMGNMTVLFVLLTSRYKLTVPRFLMCNLSFADFCMGLYLLLIASVDSQTKGQYYNHAIDWQTGSGCSTAGFFTVFASELSVYTLTVITLERWHTITYAIHLDQKLRLRHAILIMLGGWLFSSLIAMLPLVGVSNYMKVSICFPMDVETTLSQVYILTILILNVVAFFIICACYIKIYFAVRNPELMATNKDTKIAKKMAILIFTDFTCMAPISFFAISAAFKVPLITVTNSKVLLVLFYPINSCANPFLYAIFTKTFQRDFFLLLSKFGCCKRRAELYRRKDFSAYTSNCKNGFTGSNKPSQSTLKLSTLHCQGTALLDKTRYTEC

SEQ ID NO: 7853 - protein, 325 aa, Homo Sapiens
MKQRFSALQLLKLLLLLQPPLPRALREALCPEPCNCVPDGALRCPGPTAGLTRLSLAYLPVKVIPSQAFRGLNEVIKIEISQIDSLERIEANAFDNLLNLSEILIQNTKNLRYIEPGAFINLPRLKYLSICNTGIRKFPDVTKVFSSESNFILEICDNLHITTIPGNAFQGMNNESVTLKLYGNGFEEVQSHAFNGTTLTSLELKENVHLEKMHNGAFRGATGPKTLDISSTKLQALPSYGLESIQRLIATSSYSLKKLPSRETFVNLLEATLTYPSHCCAFRNLPTKEQNFSHSISENFSKQCESTVRKVNNKTLSKPRINGYQ

SEQ ID NO: 7854 - protein, 329 aa, Homo Sapiens
MKQRFSALQLLKLLLLLQPPLPRALREALCPEPCNCVPDGALRCPGPTAGLTRLSLAYLPVKVIPSQAFRGLNEVIKIEISQIDSLERIEANAFDNLLNLSEILIQNTKNLRYIEPGAFINLPRLKYLSICNTGIRKFPDVTKVFSSESNFILEICDNLHITTIPGNAFQGMNNESVTLKLYGNGFEEVQSHAFNGTTLTSLELKENVHLEKMHNGAFRGATGPKTLDISSTKLQALPSYGLESIQRLIATSSYSLKKLPSRETFVNLLEATLTYPSHCCAFRNLPTKEQNFSHSISENFSKQCESTVRKVNNKTLLLHGALSAAHSLS

SEQ ID NO: 7855 - protein, 175 aa, Homo Sapiens
NCVPDGALRCPGPTAGLTRLSLAYLPVKVIPSQAFRGLNEVIKIEISQIDSLERIEANAFDNLLNLSEILIQNTKNLRYIEPGAFINLPRLKYLSICNTGIRKFPDVTKVFSSESNFILEICDNLHITTIPGNAFQGMNNESVTLPWQNCDEAIKELTLKEKRENMDWNDSEMKR

SEQ ID NO: 7856 - protein, 202 aa, Homo Sapiens
MKVLAAGVVPLLLVLHWKHGAGSPLPITPVNATCAIRHPCHNNLMNQIRSQLAQLNGSANALFILYYTAQGEPFPNNLDKLCGPNVTDFPPFHANGTEKAKLVELYRIVVYLGTSLGNITRDQKILNPSALSLHSKLNATADILRGLLSNVLCRLCSKYHVGHVDVTYGPDTSGKDVFQKKKLGCQLLGKYKQIIAVLAQAF

SEQ ID NO: 7857 - protein, 88 aa, Homo Sapiens
MKVLAAVHSPGGAVPQQPGQAMWPQRDGLPALPRQRHGEGQAGGAVPHSRVPWHLPGQHHPGPEDPQPQCPQPPQQAQRHRRHPARPP

SEQ ID NO: 7858 - protein, 75 aa, Homo Sapiens
MMDIYVCLKRPSWMVDNKRMRTASNFQWLLSTFILLYLMNQVNSQKKGAPHDLKCVTNNLQVWNCSWKAPSGTGR

SEQ ID NO: 7859 - protein, 126 aa, Homo Sapiens
MMDIYVCLKRPSWMVDNKRMRTASNFQWLLSTFILLYLMNQVNSQKKGAPHDLKCVTNNLQVWNCSWKAPSGTGRGTDYEVCIENRSRSCYQLEKTSIKIPALSHGDYEITINSLHDFGSSTSKFT

SEQ ID NO: 7860 - protein, 1097 aa, Homo Sapiens
MMDIYVCLKRPSWMVDNKRMRTASNFQWLLSTFILLYLMNQVNSQKKGAPHDLKCVTNNLQVWNCSWKAPSGTGRGTDYEVCIENRSRSCYQLEKTSIKIPALSHGDYEITINSLHDFGSSTSKFTLNEQNVSLIPDTPEILNLSADFSTSTLYLKWNDRGSVFPHRSNVIWEIKVLRKESMELVKLVTHNTTLNGKDTLHHWSWASDMPLECAIHFVEIRCYIDNLHFSGLEEWSDWSPVKNISWIPDSQTKVFPQDKVILVGSDITFCCVSQEKVLSALIGHTNCPLIHLDGENVAIKIRNISVSASSGTNVVFTTEDNIFGTVIFAGYPPDTPQQLNCETHDLKEIICSWNPGRVTALVGPRATSYTLVESFSGKYVRLKRAEAPTNESYQLLFQMLPNQEIYNFTLNAHNPLGRSQSTILVNITEKVYPHTPTSFKVKDINSTAVKLSWHLPGNFAKINFLCEIEIKKSNSVQEQRNVTIKGVENSSYLVALDKLNPYTLYTFRIRCSTETFWKWSKWSNKKQHLTTEASPSKGPDTWREWSSDGKNLIIYWKPLPINEANGKILSYNVSCSSDEETQSLSEIPDPQHKAEIRLDKNDYIISVVAKNSVGSSPPSKIASMEIPNDDLKIEQVVGMGKGILLTWHYDPNMTCDYVIKWCNSSRSEPCLMDWRKVPSNSTETVIESDEFRPGIRYNFFLYGCRNQGYQLLRSMIGYIEELAPIVAPNFTVEDTSADSILVKWEDIPVEELRGFLRGYLFYFGKGERDTSKMRVLESGRSDIKVKNITDISQKTLRIADLQGKTSYHLVLRAYTDGGVGPEKSMYVVTKENSVGLIIAILIPVAVAVIVGVVTSILCYRKREWIKETFYPDIPNPENCKALQFQKSVCEGSSALKTLEMNPCTPNNVEVLETRSAFPKIEDTEIISPVAERPEDRSDAEPENHVVVSYCPPIIEEEIPNPAADEAGGTAQVIYIDVQSMYQPQAKPEEEQENDPVGGAGYKPQMHLPINSTVEDIAAEEDLDKTAGYRPQANVNTWNLVSPDSPRSIDSNSEIVSFGSPCSINSRQFLIPPKDEDSPKSNGGGWSFTNFFQNKPND

SEQ ID NO: 7861 - protein, 1097 aa, Homo Sapiens; identical to SEQ ID NO: 7860

SEQ ID NO: 7862 - protein, 66 aa, Homo Sapiens
  misc_feature (1)..(1): Xaa can be any naturally occurring amino acid
XWSNKKQHLTTEASPSKGPDTWREWSSDGKNLIIYWKMRKHSPFLKSLILSTKQRYDLIRMTTSSA

SEQ ID NO: 7863 - protein, 289 aa, Homo Sapiens
MTPIVTVLICLRLSLGPRTHVQAGTLPKPTLWAEPGSVITQGSPVTLWCQGILETQEYRLYREKKTAPWITRIPQEIVKKGQFPIPSITWEHTGRYRCFYGSHTAGWSEPSDPLELVVTGAYIKPTLSALPSPVVTSGGNVTLHCVSQVAFGSFILCKEGEDEHPQCLNSQPRTHGWSRAIFSVGPVSPSRRWSYRCYAYDSNSPHVWSLPSDLLELLVLGAAETLSPPQNKSDSKAGAANTLSPSQNKTASHPQDYTVENLIRMGIAGLVLVVLGILLFEAQHSQRSL

SEQ ID NO: 7864 - protein, 489 aa, Homo Sapiens
MTPIVTVLICLRLSLGPRTHVQAGTLPKPTLWAEPGSVITQGSPVTLWCQGILETQEYRLYREKKTAPWITRIPQEIVKKGQFPIPSITWEHTGRYRCFYGSHTAGWSEPSDPLELVVTGAYIKPTLSALPSPVVTSGGNVTLHCVSQVAFGSFILCKEGEDEHPQCLNSQPRTHGWSRAIFSVGPVSPSRRWSYRCYAYDSNSPHVWSLPSDLLELLVLGVSKKPSLSVQPGPIVAPGESLTLQCVSDVSYDRFVLYKEGERDFLQLPGPQPQAGLSQANFTLGPVSRSYGGQYRCSGAYNLSSEWSAPSDPLDILIAGQFRGRPFISVHPGPTVASGENVTLLCQSWGPFHTFLLTKAGAADAPLRLRSIHEYPKYQAEFPMSPVTSAHSGTYRCYGSLSSNPYLLSHPSDSLELMVSGAAETLSPPQNKSDSKAGAANTLSPSQNKTASHPQDYTVENLIRMGIAGLVLVVLGILLFEAQHSQRSL

SEQ ID NO: 7865 - protein, 454 aa, Homo Sapiens
MTPILTVLICLGHLPKPTLWAEPGSVIIQGSPVTLRCQGSLQAEEYHLYRENKSASWVRRIQEPGKNGQFPIPSITWEHAGRYHCQYYSHNHSSEYSDPLELVVTGAYSKPTLSALPSPVVTSGGNVTLQCVSQVAFDGFILCKEGEDEHPQRLNSHSHARGWSWAIFSVGPVSPSRRWSYRCYAYDSNSPYVWSLPSDLLELLVPGVSKKPSLSVQPGPMVAPGESLTLQCVSDVGYDRFVLYKEGERDFLQRPGWQPQAGLSQANFTLGPVSPSHGGQYRCYSAHNLSSEWSAPSDPLDILITGQFYDRPSLSVQPVPTVAPGKNVTLLCQSRGQFHTFLLTKEGAGHPPLHLRSEHQAQQNQAEFRMGPVTSAHVGTYRCYSSLSSNPYLLSLPSDPLELVVSASLGQHPQDYTVENLIRMGVAGLVLVVLGILLFEAQHSQRSLQDAAGR

SEQ ID NO: 7866 - protein, 203 aa, Homo Sapiens
MTPILTVLICLGLSLGPRTHVQAGHLPKPTLWAEPGSVIIQGSPVTLRCQGSLQAEEYHLYRENKSASWVRRIQEPGKNGQFPIPSITWEHAGRYHCQYYSHNHSSEHQAQQNQAEFRMGPVTSAHVGTYRCYSSLSSNPYLLSLPSDPLELVVSASLGQHPQDYTVENLIRMGVAGLVLVVLGILLFEAQHSQRSLQDAAGR

SEQ ID NO: 7867 - protein, 466 aa, Homo Sapiens
MTPILTVLICLGLSLGPRTHVQAGHLPKPTLWAEPGSVIIQGSPVTLRCQGSLQAEEYHLYRENKSASWVRRIQEPGKNGQFPIPSITWEHAGRYHCQYYSHNHSSEYSDPLELVVTGAYSKPTLSALPSPVVTSGGNVTLQCVSQVAFDGFILCKEGEDEHPQRLNSHSHARGWSWAIFSVGPVSPSRRWSYRCYAYDSNSPYVWSLPSDLLELLVPGVSKKPSLSVQPGPMVAPGESLTLQCVSDVGYDRFVLYKEGERDFLQRPGWQPQAGLSQANFTLGPVSPSHGGQYRCYSAHNLSSEWSAPSDPLDILITGQFYDRPSLSVQPVPTVAPGKNVTLLCQSRGQFHTFLLTKEGAGHPPLHLRSEHQAQQNQAEFRMGPVTSAHVGTYRCYSSLSSNPYLLSLPSDPLELVVSASLGQHPQDYTVENLIRMGVAGLVLVVLGILLFEAQHSQRSLQDAAGR

SEQ ID NO: 7868 - protein, 483 aa, Homo Sapiens
MTPILTVLICLGLSLGPRTHVQAGHLPKPTLWAEPGSVIIQGSPVTLRCQGSLQAEEYHLYRENKSASWVRRIQEPGKNGQFPIPSITWEHAGRYHCQYYSHNHSSEYSDPLELVVTGAYSKPTLSALPSPVVTSGGNVTLQCVSQVAFDGFILCKEGEDEHPQRLNSHSHARGWSWAIFSVGPVSPSRRWSYRCYAYDSNSPYVWSLPSDLLELLVPGVSKKPSLSVQPGPMVAPGESLTLQCVSDVGYDRFVLYKEGERDFLQRPGWQPQAGLSQANFTLGPVSPSHGGQYRCYSAHNLSSEWSAPSDPLDILITGQFYDRPSLSVQPVPTVAPGKNVTLLCQSRGQFHTFLLTKEGAGHPPLHLRSEHQAQQNQAEFRMGPVTSAHVGTYRCYSSLSSNPYLLSLPSDPLELVVSEAAETLSPSQNKTDSTTTSLGQHPQDYTVENLIRMGVAGLVLVVLGILLFEAQHSQRSLQDAAGR

SEQ ID NO: 7869 - protein, 483 aa, Homo Sapiens; identical to SEQ ID NO: 7868

SEQ ID NO: 7870 - protein, 327 aa, Homo Sapiens
MTPILTVLICLGLSLGPRTHVQAGHLPKPTLWAEPGSVIIQGSPVTLRCQGSLQAEEYHLYRENKSASWVRRIQEPGKNGQFPIPSITWEHAGRYHCQYYSHNHSSEYSDPLELVVTGAYSKPTLSALPSPVVTSGGNVTLQCVSQVAFDGFILCKEGEDEHPQRLNSHSHARGWSWAIFSVGPVSPSRRWSYRCYAYDSNSPYVWSLPSDLLELLVPGVSKKPSLSVQPGPMVAPGESLTLQCVSDVGYDRFVLYKEGERDFLQRPGWQPQAGLSQANFTLGPVSPSHGGQYRCYSAHNLSSEWSAPSDPLDILITGQFYDRPSLS

SEQ ID NO: 7871 - protein, 85 aa, Homo Sapiens
  misc_feature (1)..(1): Xaa can be any naturally occurring amino acid
XSLPSDPLELVVSEPLSISPSPTPAGSLGHLKTREEAAWASVGSDCDEAGVHPRCAPLERSTPAVGAAHTAPPVLTWRPLCSGHP

SEQ ID NO: 7872 - protein, 158 aa, Homo Sapiens
MTPALTALLCLGLSLGPRTRMQAGPFPKPTLWAEPGSVISWGSPVTIWCQGSLEAQEYQLDKEGSPEPWDRNNPLEPKNKARFSIPSMTQHHAGRYRCHYYSSAGWSEPSDPLELVMTGFYNKPTLSALPSPVVASGGNMTLRCGSQKGYHHFVLMKE

SEQ ID NO: 7873 - protein, 632 aa, Homo Sapiens
MTPALTALLCLGLSLGPRTRMQAGPFPKPTLWAEPGSVISWGSPVTIWCQGSLEAQEYQLDKEGSPEPWDRNNPLEPKNKARFSIPSMTQHHAGRYRCHYYSSAGWSEPSDPLELVMTGFYNKPTLSALPSPVVASGGNMTLRCGSQKGYHHFVLMKEGEHQLPRTLDSQQLHSGGFQALFPVGPVTPSHRWRFTCYYYYTNTPWVWSHPSDPLEILPSGVSRKPSLLTLQGPVLAPGQSLTLQCGSDVGYDRFVLYKEGERDFLQRPGQQPQAGLSQANFTLGPVSRSYGGQYRCYGAHNLSSEWSAPSDPLDILITGQIYDTVSLSAQPGPTVASGENMTLLCQSRGYFDTFLLTKEGAAHPPLRLRSMYGAHKYQAEFPMSPVTSAHAGTYRCYGSRSSNPHLLSFPSEPLELMVSGHSGGSSLPPTGPPSTPGLGRYLEVLIGVSVAFVLLLFLLLFLLLLRQRHSKHRTSDQRKTDFQRPAGAAETEPKDRGLLRRSSPAADVQEENLYAAVKDTQSEDRVELDSQQSPHDEDPQAVTYAPVKHSSPRREMASPPSSLSGEFLDTKDRQVEEDRQMDTEAAASEASQDVTYAQLHSLTLRRKATEPPPSQEGEPPAEPSIYATLAIH

SEQ ID NO: 7874 - protein, 643 aa, Homo Sapiens
MTPALTALLCLGLSLGPRTRMQAGPFPKPTLWAEPGSVISWGSPVTIWCQGSLEAQEYQLDKEGSPEPWDRNNPLEPKNKARFSIPSMTQHHAGRYRCHYYSSAGWSEPSDPLELVMTGFYNKPTLSALPSPVVASGGNMTLRCGSQKGYHHFVLMKEGEHQLPRTLDSQQLHSGGFQALFPVGPVTPSHRWRFTCYYYYTNTPWVWSHPSDPLEILPSGVSRKPSLLTLQGPVLAPGQSLTLQCGSDVGYDRFVLYKEGERDFLQRPGQQPQAGLSQANFTLGPVSRSYGGQYRCYGAHNLSSEWSAPSDPLDILITGQIYDTVSLSAQPGPTVASGENMTLLCQSRGYFDTFLLTKEGAAHPPLRLRSMYGAHKYQAEFPMSPVTSAHAGTYRCYGSRSSNPHLLSFPSEPLELMVSGPEDQPLNPPGSGPQNAPGLGSGAGTRAAGLGRYLEVLIGVSVAFVLLLFLLLFLLLLRQRHSKHRTSDQRKTDFQRPAGAAETEPKDRGLLRRSSPAADVQEENLYAAVKDTQSEDRVELDSQSPHDEDPQAVTYAPVKHSSPRREMASPPSSLSGEFLDTKDRQVEEDRQMDTEAAASEASQDVTYAQLHSLTLRRKATEPPPSQEGEPPAEPSIYATLAIH

SEQ ID NO: 7875 - protein, 631 aa, Homo Sapiens
MTPALTALLCLGLSLGPRTRMQAGPFPKPTLWAEPGSVISWGSPVTIWCQGSLEAQEYQLDKEGSPEPWDRNNPLEPKNKARFSIPSMTQHHAGRYRCHYYSSAGWSEPSDPLELVMTGFYNKPTLSALPSPVVASGGNMTLRCGSQKGYHHFVLMKEGEHQLPRTLDSQQLHSGGFQALFPVGPVTPSHRWRFTCYYYYTNTPWVWSHPSDPLEILPSGVSRKPSLLTLQGPVLAPGQSLTLQCGSDVGYDRFVLYKEGERDFLQRPGQQPQAGLSQANFTLGPVSRSYGGQYRCYGAHNLSSEWSAPSDPLDILITGQIYDTVSLSAQPGPTVASGENMTLLCQSRGYFDTFLLTKEGAAHPPLRLRSMYGAHKYQAEFPMSPVTSAHAGTYRCYGSRSSNPHLLSFPSEPLELMVSGHSGGSSLPPTGPPSTPGLGRYLEVLIGVSVAFVLLLFLLLFLLLLRQRHSKHRTSDQRKTDFQRPAGAAETEPKDRGLLRRSSPAADVQEENLYAAVKDTQSEDRVELDSQSPHDEDPQAVTYAPVKHSSPRREMASPPSSLSGEFLDTKDRQVEEDRQMDTEAAASEASQDVTYAQLHSLTLRRKATEPPPSQEGEPPAEPSIYATLAIH

SEQ ID NO: 7876 - protein, 191 aa, Homo Sapiens
MTPALTALLCLGLSLGPRTRMQAGPFPKPTLWAEPGSVISWGSPVTIWCQGSLEAQEYQLDKEGSPEPWDRNNPLEPKNKARFSIPSMTQHHAGRYRCHYYSSAGWSEPSDPLELVMTGFYNKPTLSALPSPVVASGGNMTLRCGSQKGYHHFVLMKEGEHQLPRTLDSQQLHSGGFQALFPVGPVTPSHS

SEQ ID NO: 7877 - protein, 253 aa, Homo Sapiens [sequence omitted]

SEQ ID NO: 7878 - protein, 131 aa, Homo Sapiens
MGLPVSWAPPALWVLGCCALLLSLWALCTACRRPEDAVAPRKRARRQRARLQGSATAAEAQVGHQTARAAPGPAQQQGPAACQHGSPAPTLAGGVQGHHRTAGSPLCLPTPGAAPGSAGSCSHRRVRWPRG

SEQ ID NO: 7879 - protein, 176 aa, Homo Sapiens
MGLPVSWAPPALWVLGCCALLLSLWALCTACRRPEDAVAPRKRARRQRARLQGSATAAEAQVGHQTARAAPGPAQQQGPAACQHGSPAPTLAGGVQGHHRTAGSPLCLPTPGAAPGSAGSCSHRRVRWPRGHLFQRGAGGPSRGQPGGQPCGGRVCPRPEAQRDPSQSPRATAGED

SEQ ID NO: 7880 - protein, 107 aa, Homo Sapiens
MGLPVSWAPPALWVLGCCALLLSLWALCTACRRPEDAVAPRKRARRQRARLQGSATAAEASLLRRTHLCSLSKSDTRLHELHRGPRSSRALRPASMDLLRPHWLEVS

SEQ ID NO: 7881 - protein, 295 aa, Homo Sapiens
MGLPVSWAPPALWVLGCCALLLSLWALCTACRRPEDAVAPRKRARRQRARLQGSATAAEASLLRRTHLCSLSKSDTRLHELHRGPRSSRALRPASMDLLRPHWLEVSRDITGPQAAPSAFPHQELPRALPAAAATAGCAGLEATYSNVGLAALPGVSLAASPVVAEYARVQKRKGTHRSPQEPQQGKTEVTPAAQVDVLYSRVCKPKRRDPGPTTDPLDPKGQGAILALAGDLAYQTLPLRALDVDSGPLENVYESIRELGDPAGRSSTCGAGTPPASSCPSLGRGWRPLPASLP

SEQ ID NO: 7882 - protein, 211 aa, Homo Sapiens
MGLPVSWAPPALWVLGCCALLLSLWALCTACRRPEDAVAPRKRARRQRARLQGSATAAEAVSARLSRGPGWGPQGTDQPSSPPVPTEADPPLLPQQVGHQTARAAPGPAQQQGPAACQHGSPAPTLAGGVQGHHRTAGSPLCLPTPGAAPGSAGSCSHRRVRWPRGHLFQRGAGGPSRGQPGGQPCGGRVCPRPEAQRDPSQSPRATAGED

SEQ ID NO: 7883 - protein, 4 aa, Homo Sapiens
MLAG

SEQ ID NO: 7884 - protein, 12 aa, Homo Sapiens
MLAGGVRSMPSP

SEQ ID NO: 7885 - protein, 19 aa, Homo Sapiens
MLAGGVRSMPSPLLACWQP

SEQ ID NO: 7886 - protein, 35 aa, Homo Sapiens
MLAGGVRSMPSPLLACWQPILLLVLGSVLSGSATG

SEQ ID NO: 7887 - protein, 55 aa, Homo Sapiens
MLAGGVRSMPSPLLACWQPILLLVLGSVLSGSATGCPPRCECSAQDRAVLCHRKR

SEQ ID NO: 7888 - protein, 72 aa, Homo Sapiens
MLAGGVRSMPSPLLACWQPILLLVLGSVLSGSATGCPPRCECSAQDRAVLCHRKRFVAVPEGIPTETRLLDL

SEQ ID NO: 7889 - protein, 125 aa, Homo Sapiens
MLAGGVRSMPSPLLACWQPILLLVLGSVLSGSATGCPPRCECSAQDRAVLCHRKRFVAVPEGIPTETRLLDLGKNRIKTLNQDEFASFPHLEELELNENIVSAVEPGAFNNLFNLRTLGLRSNRL

SEQ ID NO: 7890 - protein, 179 aa, Homo Sapiens
MLAGGVRSMPSPLLACWQPILLLVLGSVLSGSATGCPPRCECSAQDRAVLCHRKRFVAVPEGIPTETRLLDLGKNRIKTLNQDEFASFPHLEELELNENIVSAVEPGAFNNLFNLRTLGLRSNRLKLIPLGVFTGLSNLTKLDISENKIVILLDYMFQDLYNLKSLEVGDNDLVYISHR

SEQ ID NO: 7891 - protein, 614 aa, Homo Sapiens
MLAGGVRSMPSPLLACWQPILLLVLGSVLSGSATGCPPRCECSAQDRAVLCHRKRFVAVPEGIPTETRLLDLGKNRIKTLNQDEFASFPHLEELELNENIVSAVEPGAFNNLFNLRTLGLRSNRLKLIPLGVFTGLSNLTKLDISENKIVILLDYMFQDLYNLKSLEVGDNDLVYISHRAFSGLNSLEQLTLEKCNLTSIPTEALSHLHGLIVLRLRHLNINAIRDYSFKRLYRLKVLEISHWPYLDTMTPNCLYGLNLTSLSITHCNLTAVPYLAVRHLVYLRFLNLSYNPISTIEGSMLHELLRLQEIQLVGGQLAVVEPYAFRGLNYLRVLNVSGNQLTTLEESVFHSVGNLETLILDSNPLACDCRLLWVFRRRWRLNFNRQQPTCATPEFVQGKEFKDFPDVLLPNYFTCRRARIRDRKAQQVFVDEGHTVQFVCRADGDPPPAILWLSPRKHLVSAKSNGRLTVFPDGTLEVRYAQVQDNGTYLCIAANAGGNDSMPAHLHVRSYSPDWPHQPNKTFAFISNQPGEGEANSTRATVPFPFDIKTLIIATTMGFISFLGVVLFCLVLLFLWSRGKGNTKHNIEIEYVPRKSDAGISSADAPRKFNMKMI

SEQ ID NO: 7892 - protein, 620 aa, Homo Sapiens
MQVSKRMLAGGVRSMPSPLLACWQPILLLVLGSVLSGSATGCPPRCECSAQDRAVLCHRKRFVAVPEGIPTETRLLDLGKNRIKTLNQDEFASFPHLEELELNENIVSAVEPGAFNNLFNLRTLGLRSNRLKLIPLGVFTGLSNLTKLDISENKIVILLDYMFQDLYNLKSLEVGDNDLVYISHRAFSGLNSLEQLTLEKCNLTSIPTEALSHLHGLIVLRLRHLNINAIRDYSFKRLYRLKVLEISHWPYLDTMTPNCLYGLNLTSLSITHCNLTAVPYLAVRHLVYLRFLNLSYNPISTIEGSMLHELLRLQEIQLVGGQLAVVEPYAFRGLNYLRVLNVSGNQLTTLEESVFHSVGNLETLILDSNPLACDCRLLWVFRRRWRLNFNRQQPTCATPEFVQGKEFKDFPDVLLPNYFTCRRARIRDRKAQQVFVDEGHTVQFVCRADGDPPPAILWLSPRKHLVSAKSNGRLTVFPDGTLEVRYAQVQDNGTYLCIAANAGGNDSMPAHLHVRSYSPDWPHQPNKTFAFISNQPGEGEANSTRATVPFPFDIKTLIIATTMGFISFLGVVLFCLVLLFLWSRGKGNTKHNIEIEYVPRKSDAGISSADAPRKFNMKMI

SEQ ID NO: 7893 - protein, 326 aa, Homo Sapiens
MVQLEQKVSKRMLAGGVRSMPSPLLACWQPILLLVLGSVLSGSATGCPPRCECSAQDRAVLCHRKRFVAVPEGIPTETRLLDLGKNRIKTLNQDEFASFPHLEELELNENIVSAVEPGAFNNLFNLRTLGLRSNRLKLIPLGVFTGLSNLTKLDISENKIVILLDYMFQDLYNLKSLEVGDNDLVYISHRAFSGLNSLEQLTLEKCNLTSIPTEALSHLHGLIVLRLRHLNINAIRDYSFKRLYRLKVLEISHWPYLDTMTPNCLYGLNLTSLSITHCNLTAVPYLAVRHLVYLRFLNLSYNPISTIEGSMLHELLRLQEIQLVGG

SEQ ID NO: 7894 - protein, 343 aa, Homo Sapiens
MACLEFVPFDVQMCLEFLPSGPKPVVFLQHGLLADSSNWVTNLANSSLGFILADAGFDVWMGNSRGNTWSRKHKTLSVSQDEFWAFSYDEMAKYDLPASINFILNKTGQEQVYYVGHSQGTTIGFIAFSQIPELAKRIKMFFALGPVASVAFCTSPMAKLGRLPDHLIKDLFGDKEFLPQSAFLKWLGTHVCTHVILKELCGNLCFLLCGFNERNLNMSRVDVYTTHSPAGTSVQNMLHWSQAVKFQKFQAFDWGSSAKNYFHYNQSYPPTYNVKDMLVPTAVWSGGHDWLADVYDVNILLTQITNLVFHESIPEWEHLDFIWGLDAPWRLYNKIINLMRKYQ

SEQ ID NO: 7895 - protein, 283 aa, Homo Sapiens
MGNSRGNTWSRKHKTLSVSQDEFWAFSYDEMAKYDLPASINFILNKTGQEQVYYVGHSQGTTIGFIAFSQIPELAKRIKMFFALGPVASVAFCTSPMAKLGRLPDHLIKDLFGDKEFLPQSAFLKWLGTHVCTHVILKELCGNLCFLLCGFNERNLNMSRVDVYTTHSPAGTSVQNMLHWSQAVKFQKFQAFDWGSSAKNYFHYNQSYPPTYNVKDMLVPTAVWSGGHDWLADVYDVNILLTQITNLVFHESIPEWEHLDFIWGLDAPWRLYNKIINLMRKYQ

SEQ ID NO: 7896 - protein, 219 aa, Homo Sapiens
MKMRFLGLVVCLVLWTLHSEGSGGKLTAVDPETNMNVSEIISYWGFPSEEYLVETEDGYILCLNRIPHGRKNHSDKGPKPVVFLQHGLLADSSNWVTNLANSSLGFILADAGFDVWMGNSRGNTWSRKHKTLSVSQDEFWAFSYDEMAKYDLPASINFILNKTGQEQVYYVGHSQGTTIGFIAFSQIPELAKRIKMFFALGPVASVAFCTSPMAKLGRL

SEQ ID NO: 7897 - protein, 399 aa, Homo Sapiens
MKMRFLGLVVCLVLWTLHSEGSGGKLTAVDPETNMNVSEIISYWGFPSEEYLVETEDGYILCLNRIPHGRKNHSDKGPKPVVFLQHGLLADSSNWVTNLANSSLGFILADAGFDVWMGNSRGNTWSRKHKTLSVSQDEFWAFSYDEMAKYDLPASINFILNKTGQEQVYYVGHSQGTTIGFIAFSQIPELAKRIKMFFALGPVASVAFCTSPMAKLGRLPDHLIKDLFGDKEFLPQSAFLKWLGTHVCTHVILKELCGNLCFLLCGFNERNLNMSRVDVYTTHSPAGTSVQNMLHWSQAVKFQKFQAFDWGSSAKNYFHYNQSYPPTYNVKDMLVPTAVWSGGHDWLADVYDVNILLTQITNLVFHESIPEWEHLDFIWGLDAPWRLYNKIINLMRKYQ

SEQ ID NO: 7898 - protein, 290 aa, Homo Sapiens
MKMRFLGLVVCLVLWTLHSEGSGGKLTAVDPETNMNVSEIISYWGFPSEEYLVETEDGYILCLNRIPHGRKNHSDKGPKPVVFLQHGLLADSSNWVTNLANSSLGFILADAGFDVWMGNSRGNTWSRKHKTLSVSQDEFWAFSYDEMAKYDLPASINFILNKTGQEQVYYVGHSQGTTIGFIAFSQIPELAKRIKMFFALGPVASVAFCTSPMAKLGRLPDHLIKDLFGDKEFLPQSAFLKWLGTHVCTHVILKELCGNLCFLLCGFNERNLNMSRVDVYTTHSPAGTSV

SEQ ID NO: 7899 - protein, 438 aa, Homo Sapiens
MDTSPLCFSILLVLCIFIQSSALGQSLKPEPFGRRAQAVETNKTLHEMKTRFLLFGETNQGCQIRINHPDTLQECGFNSSLPLVMIIHGWSESVQLSRSHVHLIGYSLGAHVSGFAGSSIGGTHKIGRITGLDAAGPLFEGSAPSNRLSPDDANFVDAIHTFTREHMGLSVGIKQPIGHYDFYPNGGSFQPGCHFLELYRHIAQHGFNAITQTIKCSHERSVHLFIDSLLHAGTQSMAYPCGDMNSFSQGLCLSCKKGRCNTLGYHVRQEPRSKSKRLFLVTRAQSPFKVYHYQFKIQFINQTETPIQTTFTMSLLGTKEKMQKIPITLGKGIASNKTYSFLITLDVDIGELIMIKFKWENSAVWANVWDTVQTIIPWSTGPRHSGLVLKTIRVKAGETQQRMTFCSENTDDLLLRPTQEKIFVKCEIKSKTSKRKIR

SEQ ID NO: 7900 - protein, 499 aa, Homo Sapiens
MDTSPLCFSILLVLCIFIQSSALGQSLKPEPFGRRAQAVETNKTLHEMKTRFLLFGETNQGCQIRINHPDTLQECGFNSSLPLVMIIHGWSVDGVLENWIWQMVAALKSQPAQPVNVGLVDWITLAHDHYTIAVRNTRLVGKEVAALLRWLEESVQLSRSHVHLIGYSLGAHVSGFAGSSIGGTHKIGRITGLDAAGPLFEGSAPSNRLSPDDANFVDAIHTFTREHMGLSVGIKQPIGHYDFYPNGGSFQPGCHFLELYRHIAQHGFNAITQTIKCSHERSVHLFIDSLLHAGTQSMAYPCGDMNSFSQGLCLSCKKGRCNTLGYHVRQEPRSKSKRLFLVTRAQSPFKVYHYQFKIQFINQTETPIQTTFTMSLLGTKEKMQKIPITLGKGIASNKTYSFLITLDVDIGELIMIKFKWENSAVWANVWDTVQTIIPWSTGPRHSGLVLKTIRVKAGETQQRMTFCSENTDDLLLRPTQEKIFVKCEIKSKTSKRKIR

SEQ ID NO: 7901 - protein, 499 aa, Homo Sapiens; identical to SEQ ID NO: 7900

SEQ ID NO: 7902 - protein, 499 aa, Homo Sapiens
MDTSPLCFSILLVLCIFIQSSALGQSLKPEPFGRRAQAVETNKTLHEMKTRFLLFGETNQGCQIRINHPDTLQECGFNSSLPLVMIIHGWSVDGVLENWIWQMVAALKSQPAQPVNVGLVDWITLAHDHYTIAVRNTRLVGKEVAALLRWLEESVQLSRSHVHLIGYSLGAHVSGFAGSSIGGTHKIGRITGLDAAGPLFEGSAPSNRLSPDDANFVDAIHTFTREHMGLSVGIKQPIGHYDFYPNGGSFQPGCHFLELYRHIAQHGFNAITQTIKCSHERSVHLFIDSLLHAGTQSMAYPCGDMNSFSQGLCLSCKKGRCNTLGYHVRQEPRSKSKRLFLVTRAQSPFKVYHYQFKIQFINQTETPIQTTFTMSLLGTKEKMQKIPITLGKGIASNKTYSFLITLDVDIGELIMIKFKWENSAVWANVWDTVQTIIPWSTGPRHSGLVLKTIRVKAGETQQRSPNRINLGRLNCSLLFCTELFSHDSLAHWSSAASEL

SEQ ID NO: 7903 - protein, 375 aa, Homo Sapiens
MFSNANSRSKMWLLLTMASLISVLGTTHGLFGKLHPGSPEVTMNISQMITYWGYPNEEYEVVTEDGYILEVNRIPYGKKNSGNTDAGYDVWLGNSRGNTWARRNLYYSPDSVEFWAFSFDEMAKYDLPATIDFIVKKTGQKQLHYVGHSQGTTIGFIAFSTNPSLAKRIKTFYALAPVATVKYTKSLINKLRFVPQSLFKFIFGDKIFYPHNFFDQFLATEVCSREMLNLLCSNALFIICGFDSKNFNTSRLDVYLSHNPAGTSVQNMFHWTQAVKSGKFQAYDWGSPVQNRMHYDQSQPPYYNVTAMNVPIAVWNGGKDLLADPQDVGLLLPKLPNLIYHKEIPFYNHLDFIWAMDAPQEVYNDIVSMISEDKK

SEQ ID NO: 7904 - protein, 408 aa, Homo Sapiens
MFSNANSRSKMWLLLTMASLISVLGTTHGLFGKLHPGSPEVTMNISQMITYWGYPNEEYEVVTEDGYILEVNRIPYGKKNSGNTGQRPVVFLQHGLLASATNWISNLPNNSLAFILADAGYDVWLGNSRGNTWARRNLYYSPDSVEFWAFSFDEMAKYDLPATIDFIVKKTGQKQLHYVGHSQGTTIGFIAFSTNPSLAKRIKTFYALAPVATVKYTKSLINKLRFVPQSLFKFIFGDKIFYPHNFFDQFLATEVCSREMLNLLCSNALFIICGFDSKNFNTSRLDVYLSHNPAGTSVQNMFHWTQAVKSGKFQAYDWGSPVQNRMHYDQSQPPYYNVTAMNVPIAVWNGGKDLLADPQDVGLLLPKLPNLIYHKEIPFYNHLDFIWAMDAPQEVYNDIVSMISEDKK

SEQ ID NO: 7905 - protein, 365 aa, Homo Sapiens
MWLLLTMASLISVLGTTHGLFGKLHPGSPEVTMNISQMITYWGYPNEEYEVVTEDGYILEVNRIPYGKKNSGNTDAGYDVWLGNSRGNTWARRNLYYSPDSVEFWAFSFDEMAKYDLPATIDFIVKKTGQKQLHYVGHSQGTTIGFIAFSTNPSLAKRIKTFYALAPVATVKYTKSLINKLRFVPQSLFKFIFGDKIFYPHNFFDQFLATEVCSREMLNLLCSNALFIICGFDSKNFNTSRLDVYLSHNPAGTSVQNMFHWTQAVKSGKFQAYDWGSPVQNRMHYDQSQPPYYNVTAMNVPIAVWNGGKDLLADPQDVGLLLPKLPNLIYHKEIPFYNHLDFIWAMDAPQEVYNDIVSMISEDKK

SEQ ID NO: 7906 - protein, 398 aa, Homo Sapiens
MWLLLTMASLISVLGTTHGLFGKLHPGSPEVTMNISQMITYWGYPNEEYEVVTEDGYILEVNRIPYGKKNSGNTGQRPVVFLQHGLLASATNWISNLPNNSLAFILADAGYDVWLGNSRGNTWARRNLYYSPDSVEFWAFSFDEMAKYDLPATIDFIVKKTGQKQLHYVGHSQGTTIGFIAFSTNPSLAKRIKTFYALAPVATVKYTKSLINKLRFVPQSLFKFIFGDKIFYPHNFFDQFLATEVCSREMLNLLCSNALFIICGFDSKNFNTSRLDVYLSHNPAGTSVQNMFHWTQAVKSGKFQAYDWGSPVQNRMHYDQSQPPYYNVTAMNVPIAVWNGGKDLLADPQDVGLLLPKLPNLIYHKEIPFYNHLDFIWAMDAPQEVYNDIVSMISEDKK

SEQ ID NO: 7907 - protein, 188 aa, Homo Sapiens
LCYCFAAGSPVPFGPEGRLEDKLHKPKATQTEVKPSVRFNLRTSKDPEHEGCYLSVGHSQPLEDCSFNMTAKTFFIIHGWTMSGIFENWLHKLVSALHTREKDANVVVVDWLPLAHQLYTDAVNNTRVVGHSIARMLDWLQVLGDERESPVTSRISNPIFLRNAGHASVAMNFWSLIKIFEIKSFIEL

SEQ ID NO: 7908 - protein, 390 aa, Homo Sapiens
MLSFSRDRLPSGRRVSGKCPPPPLGMAVGRGGSGCPEEGSGRKLELLESQLPAERAREEAGPSVRRPRDKLHKPKATQTEVKPSVRFNLRTSKDPEHEGCYLSVGHSQPLEDCSFNMTAKTFFIIHGWTMSGIFENWLHKLVSALHTREKDANVVVVDWLPLAHQLYTDAVNNTRVVGHSIARMLDWLQEKDDFSLGNVHLIGYSLGAHVAGYAGNFVKGTVGRITGLDPAGPMFEGADIHKRLSPDDADFVDVLHTYTRSFGLSIGIQMPVGHIDIYPNGGDFQPGCGLNDVLGSIAYGTITEVVKCEHERAVHLFVDSLVNQDKPSFAFQCTDSNRFKKGICLSCRKNRCNSIGYNAKKMRNKRNSKMYLKTRAGMPFRGNLQSLECP

SEQ ID NO: 7909 - protein, 426 aa, Homo Sapiens
MSNSVPLLCFWSLCYCFAAGSPVPFGPEGRLEDKLHKPKATQTEVKPSVRFNLRTSKDPEHEGCYLSVGHSQPLEDCSFNMTAKTFFIIHGWTMSGIFENWLHKLVSALHTREKDANVVVVDWLPLAHQLYTDAVNNTRVVGHSIARMLDWLQEKDDFSLGNVHLIGYSLGAHVAGYAGNFVKGTVGRITAITEVVKCEHERAVHLFVDSLVNQDKPSFAFQCTDSNRFKKGICLSCRKNRCNSIGYNAKKMRNKRNSKMYLKTRAGMPFRVYHYQMKIHVFSYKNMGEIEPTFYVTLYGTNADSQTLPLEIVERIEQNATNTFLVYTEEDLGDLLKIQLTWEGASQSWYNLWKEFRSYLSQPRNPGRELNIRRIRVKSGETQRKLTFCTEDPENTSISPGRELWFRKCRDGWRMKNETSPTVELP

SEQ ID NO: 7910 - protein, 500 aa, Homo Sapiens
MSNSVPLLCFWSLCYCFAAGSPVPFGPEGRLEDKLHKPKATQTEVKPSVRFNLRTSKDPEHEGCYLSVGHSQPLEDCSFNMTAKTFFIIHGWTMSGIFENWLHKLVSALHTREKDANVVVVDWLPLAHQLYTDAVNNTRVVGHSIARMLDWLQEKDDFSLGNVHLIGYSLGAHVAGYAGNFVKGTVGRITGLDPAGPMFEGADIHKRLSPDDADFVDVLHTYTRSFGLSIGIQMPVGHIDIYPNGGDFQPGCGLNDVLGSIAYGTITEVVKCEHERAVHLFVDSLVNQDKPSFAFQCTDSNRFKKGICLSCRKNRCNSIGYNAKKMRNKRNSKMYLKTRAGMPFRVYHYQMKIHVFSYKNMGEIEPTFYVTLYGTNADSQTLPLEIVERIEQNATNTFLVYTEEDLGDLLKIQLTWEGASQSWYNLWKEFRSYLSQPRNPGRELNIRRIRVKSGETQRKLTFCTEDPENTSISPGRELWFRKCRDGWRMKNETSPTVELP

SEQ ID NO: 7911 - protein, 354 aa, Homo Sapiens
MSNSVPLLCFWSLCYCFAAGSPVPFGPEGRLEDKLHKPKATQTEVKPSVRFNLRTSKDPEHEGCYLSVGHSQPLEDCSFNMTAKTFFIIHGWTMSGIFENWLHKLVSALHTREKDANVVVVDWLPLAHQLYTDAVNNTRVVGHSIARMLDWLQEKDDFSLGNVHLIGYSLGAHVAGYAGNFVKGTVGRITGLDPAGPMFEGADIHKRLSPDDADFVDVLHTYTRSFGLSIGIQMPVGHIDIYPNGGDFQPGCGLNDVLGSIAYGTITEVVKCEHERAVHLFVDSLVNQDKPSFAFQCTDSNRFKKGICLSCRKNRCNSIGYNAKKMRNKRNSKMYLKTRAGMPFRGNLQSLECP

SEQ ID NO: 7912 - protein, 24 aa, Homo Sapiens
MTAKTFFIIHGWTMSGIFENWLHK

SEQ ID NO: 7913 - protein, 417 aa, Homo Sapiens
MLRFYLFISLLCLSRSDAEETCPSFTRLSFHSAVVGTGLNVRLMLYTRKNLTCAQTINSSAFGNLNVTKKTTFIVHGFRPTGSPPVWMDDLVKGLLSVEDMNVVVVDWNRGATTLIYTHASSKTRKVAMVLKEFIDQMLAEGASLDDIYMIGVSLGAHISGFVGEMYDGWLGRITALGYKEPLGNIDFYPNGGLDQPGCPKTILGGFQYFKCDHQRSVYLYLSSLRESCTITAYPCDSYQDYRNGKCVSCGTSQKESCPLLGYYADNWKDHLRGKDPPMTKAFFDTAEESPFCMYHYFVDIITWNKNVRRGDITIKLRDKAGNTTESKINHEPTTFQKYHQVSLLARFNQDLDKVAAISLMFSTGSLIGPRYKLRILRMKLRSLAHPERPQLCRYDLVLMENVETVFQPILCPELQL

SEQ ID NO: 7914 - protein, 451 aa, Homo Sapiens
MLRFYLFISLLCLSRSDAEETCPSFTRLSFHSAVVGTGLNVRLMLYTRKNLTCAQTINSSAFGNLNVTKKTTFIVHGFRPTGSPPVWMDDLVKGLLSVEDMNVVVVDWNRGATTLIYTHASSKTRKVAMVLKEFIDQMLAEGASLDDIYMIGVSLGAHISGFVGEMYDGWLGRITGLDPAGPLFNGKPHQDRLDPSDAQFVDVIHSDTDALGYKEPLGNIDFYPNGGLDQPGCPKTILGGFQYFKCDHQRSVYLYLSSLRESCTITAYPCDSYQDYRNGKCVSCGTSQKESCPLLGYYADNWKDHLRGKDPPMTKAFFDTAEESPFCMYHYFVDIITWNKNVRRGDITIKLRDKAGNTTESKINHEPTTFQKYHQVSLLARFNQDLDKVAAISLMFSTGSLIGPRYKLRILRMKLRSLAHPERPQLCRYDLVLMENVETVFQPILCPELQL

SEQ ID NO: 7915 - protein, 47 aa, Homo Sapiens
MLRFYLFISLLCLSRSDASLDMNEESPLFEEGFLQSEIWEIKLIPPK

SEQ ID NO: 7916 - protein, 86 aa, Homo Sapiens
  misc_feature (1)..(1): Xaa can be any naturally occurring amino acid
XDIYMIGVSLGAHISGFVGEMYDGWLGRITGFQYFKCDHQRSVYLYLSSLRESCTITAYPCDSYQDYRNGKCVSCGTSQKESCPLL

SEQ ID NO: 7917 - protein, 73 aa, Homo Sapiens
  misc_feature (1)..(1): Xaa can be any naturally occurring amino acid
XSPFCMYHYFVDIITWNKNVRRGDITIKLRDKAGNTTESKINQISNRPKVQAQDSPNEVKVPCPSGEASAVSV

SEQ ID NO: 7918 - protein, 399 aa, Homo Sapiens
MWQLLAAACWMLLLGSMYGYDKKGNNANPEANMNISQIISYWGYPYEEYDVTTKDGYILGIYRIPHGRGCPGRTAPKPAVYLQHGLIASASNWICNLPNNSLAFLLADSGYDVWLGNSRGNTWSRKHLKLSPKSPEYWAFSLDEMAKYDLPATINFIIEKTGQKRLYYVGHSQGTTIAFIAFSTNPELAKKIKIFFALAPVVTVKYTQSPMKKLTTLSRRVVKVLFGDKMFHPHTLFDQFIATKVCNRKLFRRICSNFLFTLSGFDPQNLNMSRLDVYLSHNPAGTSVQNMLHWAQAVNSGQLQAFDWGNSDQNMMHFHQLTPPLYNITKMEVPTAIWNGGQDIVADPKDVENLLPQIANLIYYKLIPHYNHVDFYLGEDAPQEIYQDLIILMEEYLQN

SEQ ID NO: 7919 - protein, 423 aa, Homo Sapiens
MLETLSRQWIVSHRMEMWLLILVAYMFQRNVNSVHMPTKAVDPEAFMNISEIIQHQGYPCEEYEVATEDGYILSVNRIPRGLVQPKKTGSRPVVLLQHGLVGGASNWISNLPNNSLGFILADAGFDVWMGNSRGNAWSRKHKTLSIDQDEFWAFSYDEMARFDLPAVINFILQKTGQEKIYYVGYSQGTTMGFIAFSTMPELAQKIKMYFALAPIATVKHAKSPGTKFLLLPDMMIKGLFGKKEFLYQTRFLRQLVIYLCGQVILDQICSNIMLLLGGFNTNNMNMSRASVYAAHTLAGTSVQNILHWSQAVNSGELRAFDWGSETKNLEKCNQPTPVRYRVRDMTVPTAMWTGGQDWLSNPEDVKMLLSEVTNLIYHKNIPEWAHVDFIWGLDAPHRMYNEIIHLMQQEETNLSQGRCEAVL

SEQ ID NO: 7920 - protein, 383 aa, Homo Sapiens
MTRPLDRKQSEIIQHQGYPCEEYEVATEDGYILSVNRIPRGLVQPKKTGSRPVVLLQHGLVGGASNWISNLPNNSLGFILADAGFDVWMGNSRGNAWSRKHKTLSIDQDEFWAFSYDEMARFDLPAVINFILQKTGQEKIYYVGYSQGTTMGFIAFSTMPELAQKIKMYFALAPIATVKHAKSPGTKFLLLPDMMIKGLFGKKEFLYQTRFLRQLVIYLCGQVILDQICSNIMLLLGGFNTNNMNMSRASVYAAHTLAGTSVQNILHWSQAVNSGELRAFDWGSETKNLEKCNQPTPVRYRVRDMTVPTAMWTGGQDWLSNPEDVKMLLSEVTNLIYHKNIPEWAHVDFIWGLDAPHRMYNEIIHLMQQEETNLSQGRCEAVL

SEQ ID NO: 7921 - protein, 398 aa, Homo Sapiens
MMWLLLTTTCLICGTLNAGGFLDLENEVNPEVWMNTSEIIIYNGYPSEEYEVTTEDGYILLVNRIPYGRTHARSTGPRPVVYMQHALFADNAYWLENYANGSLGFLLADAGYDVWMGNSRGNTWSRRHKTLSETDEKFWAFSFDEMAKYDLPGVIDFIVNKTGQEKLYFIGHSLGTTIGFVAFSTMPELAQRIKMNFALGPTISFKYPTGIFTRFFLLPNSIIKAVFGTKGFFLEDKKTKIASTKICNNKILWLICSEFMSLWAGSNKKNMNQSRMDVYMSHAPTGSSVHNILHIKQLYHSDEFRAYDWGNDADNMKHYNQSHPPIYDLTAMKVPTAIWAGGHDVLVTPQDVARILPQIKSLHYFKLLPDWNHFDFVWGLDAPQRMYSEIIALMKAYS

SEQ ID NO: 7922 - protein, 288 aa, Homo Sapiens
MAAEGWIWRWGWGRRCLGRPGLLGPGPGPTTPLFLLLLLGSVTADITDGNSEHLKREHSLIKPYQGVGSSSMPLWDFQGSTMLTSQYVRLTPDERSKEGSIWNHQPCFLKDWEMHVHFKVHGTGKKNLHGDGIALWYTRDRLVPDNFHGLAIFLDTYPNDETTERVFPYISVMVNNGSLSYDHSKDGRWTELAGCTADFRNRDHDTFLAVRYSRGRLTVMTDLEDKNEWKNCIDITGVRLPTGYYFGASAGTGDLSDNHDIISMKLFQLMVEHTPDEESIDWTKIEPS

SEQ ID NO: 7923 - protein, 203 aa, Homo Sapiens
MAAEGWIWRWGWGRRCLGRPGLLGPGPGPTTPLFLLLLLGSVTADITDGNSEHLKREHSLIKPYQGVGSSSMPLWDFQGSTMLTSQYVRLTPDERSKEGSIWNHQPCFLKDWEMHVHFKVHGTGKKNLHGDGIALWYTRDRLVPGPVFGSKDNFHGLAIFLDTYPNDETTEHRLDQDRAQRQLPQVAQRQRGRPHGELPQRAP

SEQ ID NO: 7924 - protein, 356 aa, Homo Sapiens
MAAEGWIWRWGWGRRCLGRPGLLGPGPGPTTPLFLLLLLGSVTADITDGNSEHLKREHSLIKPYQGVGSSSMPLWDFQGSTMLTSQYVRLTPDERSKEGSIWNHQPCFLKDWEMHVHFKVHGTGKKNLHGDGIALWYTRDRLVPGPVFGSKDNFHGLAIFLDTYPNDETTERVFPYISVMVNNGSLSYDHSKDGRWTELAGCTADFRNRDHDTFLAVRYSRGRLTVMTDLEDKNEWKNCIDITGVRLPTGYYFGASAGTGDLSDNHDIISMKLFQLMVEHTPDEESIDWTKIEPSVNFLKSPKDNVDDPTGNFRSGPLTGWRVFLLLLCALLGIVVCAVVGAVVFQKRQERNKRFY

SEQ ID NO: 7925 - protein, 325 aa, Homo Sapiens
MAAEGWIWRWGWGRRCLGRPGLLGPGPGPTTPLFLLLLLGSVTADITDGNSEHLKREHSLIKPYQGVGSSSMPLWDFQGSTMLTSQYVRLTPDERSKEGSIWNHQPCFLKDWEMHVHFKVHGTGKKNLHGDGIALWYTRDRLVPGPVFGSKDNFHGLAIFLDTYPNDETTERVFPYISVMVNNGSLSYDHSKDGRWTELAGCTADFRNRDHDTFLAVRYSRGRLTVMTDLEDKNEWKNCIDITGVRLPTGYYFGASAGTGDLSDNHDIISMKLFQLMVEHTPDEESIDWTKIEPSVNFLKSPKAPPFLLPQTTWTTPRGTSAAGP

SEQ ID NO: 7926 - protein, 192 aa, Homo Sapiens
MPLWDFQGSTMLTSQYVRLTPDERSKEGSIWNHQPCFLKDWEMHVHFKVHGTGKKNLHGDGIALWYTRDRLVPGPVFGSKDNFHGLAIFLDTYPNDETTERVFPYISVMVNNGSLSYDHSKDGRWTELAGCTADFRNRDHDTFLAVRYSRGRLTVMTDLEDKNEWKNCIDITGVRLPTGYYFGASAGTGDLS

SEQ ID NO: 7927 - protein, 144 aa, Homo Sapiens
MAIGDHILQQNVNGQTISLYRFLPNIVMQANSTVTVWAAASEAKHQPPSDFLWKEQDKFRASPDCITILCKPNGQAIAWYTPIHWKQAWEKLDADVEFNRCSVVSPTFRKRVFQWTASTATITKEKQDQPKKDISNYQVEQAQV

SEQ ID NO: 7928 - protein, 291 aa, Homo Sapiens
MIGDGEDYFLSLFGDSKKLTAHSNYTQKTLKYFSMILEEVGQFTSSSLGDVEIAEVNVKGLFVKLINSSLDKEMAIGDHILQQNVNGQTISLYRFLPNIVMQANSTVTVWAAASEAKHQPPSDFLWKEQDKFRASPDCITILCKPNGQAIAWYTPIHWKQAWEKLDADVEFNRCSVVSPTFRKRVFQWTASTATITKEKQDQPKKDISNYQVEQAQVLLKREKEIPPTVFPNRSPWCQNPYVSAHPYCPLIEPHNTSTAGGRLDRQPRTRSTRPNRASGSKKKKTSESQKQ

SEQ ID NO: 7929 - protein, 369 aa, Homo Sapiens
MKDTQDIQEASKAMQNKVHEQEDKNEKQKQREDKLGVYSLVHFSPKMLGSVATTLPLSSSNSSGMPLGYYLSSPQISRVTISTTGQLTSKATVGSCSRVENSLDASPFSVPKKQDESPMIGDGEDYFLSLFGDSKKLTAHSNYTQKTLKYFSMILEEVGQFTSSSLGDVEIAEVNVKGLFVKLINSSLDKEMAIGDHILQQNVNGQTISLYRFLPNIVMQANSTVTAIAWYTPIHWKQAWEKLDADVEFNRCSVVSPTFRKRVFQWTASTATITKEKQDQPKKDISNYQVEQAQVLLKREKEIPPTVFPNRSPWCQNPYVSAHPYCPLIEPHNTSTAGGRLDRQPRTRSTRPNRASGSKKKKTSESQKQ

SEQ ID NO: 7930 - protein, 409 aa, Homo Sapiens
MKDTQDIQEASKAMQNKVHEQEDKNEKQKQREDKLGVYSLVHFSPKMLGSVATTLPLSSSNSSGMPLGYYLSSPQISRVTISTTGQLTSKATVGSCSRVENSLDASPFSVPKKQDESPMIGDGEDYFLSLFGDSKKLTAHSNYTQKTLKYFSMILEEVGQFTSSSLGDVEIAEVNVKGLFVKLINSSLDKEMAIGDHILQQNVNGQTISLYRFLPNIVMQANSTVTVWAAASEAKHQPPSDFLWKEQDKFRASPDCITILCKPNGQAIAWYTPIHWKQAWEKLDADVEFNRCSVVSPTFRKRVFQWTASTATITKEKQDQPKKDISNYQVEQAQVLLKREKEIPPTVFPNRSPWCQNPYVSAHPYCPLIEPHNTSTAGGRLDRQPRTRSTRPNRASGSKKKKTSESQKQ

SEQ ID NO: 7931 - protein, 388 aa, Homo Sapiens
MLEGSWINRREDKLGVYSLVHFSPKMLGSVATTLPLSSSNSSGMPLGYYLSSPQISRVTISTTGQLTSKATVGSCSRVENSLDASPFSVPKKQDESPMIGDGEDYFLSLFGDSKKLTAHSNYTQKTLKYFSMILEEVGQFTSSSLGDVEIAEVNVKGLFVKLINSSLDKEMAIGDHILQQNVNGQTISLYRFLPNIVMQANSTVTVWAAASEAKHQPPSDFLWKEQDKFRASPDCITILCKPNGQAIAWYTPIHWKQAWEKLDADVEFNRCSVVSPTFRKRVFQWTASTATITKEKQDQPKKDISNYQVEQAQVLLKREKEIPPTVFPNRSPWCQNPYVSAHPYCPLIEPHNTSTAGGRLDRQPRTRSTRPNRASGSKKKKTSESQKQ

SEQ ID NO: 7932 - protein, 72 aa, Homo Sapiens
MLGSVATTLPLSSSNSSGMPLGYYLSSPQISRVTISTTGQLTSKATVGSCSRVENSLDASPFSVPKKQDESP

SEQ ID NO: 7933 - protein, 166 aa, Homo Sapiens
MLGSVATTLPLSSSNSSGMPLGYYLSSPQISRVTISTTGQLTSKATVGSCSRVENSLDASPFSVPKKQDESPMIGDGEDYFLSLFGDSKKLTAHSNYTQKTLKYFSMILEEVGQFTSSSLGDVEIAEVNVKGLFVKLINSSLDKEMAIGDHILQQNVNGQTISLYR

SEQ ID NO: 7934 - protein, 170 aa, Homo Sapiens
MLGSVATTLPLSSSNSSGMPLGYYLSSPQISRVTISTTGQLTSKATVGSCSRVENSLDASPFSVPKKQDESPMIGDGEDYFLSLFGDSKKLTAHSNYTQKTLKYFSMILEEVGQFTSSSLGDVEIAEVNVKGLFVKLINSSLDKEMAIGDHILQQNVNGQTISLYRFLPN

SEQ ID NO: 7935 - protein, 325 aa, Homo Sapiens
MQQPVRAGDIGVSRVQTHHNASPFSVPKKQDESPMIGDGEDYFLSLFGDSKKLTAHSNYTQKTLKYFSMILEEVGQFTSSSLGDVEIAEVNVKGLFVKLINSSLDKEMAIGDHILQQNVNGQTISLYRFLPNIVMQANSTVTVWAAASEAKHQPPSDFLWKEQDKFRASPDCITILCKPNGQAIAWYTPIHWKQAWEKLDADVEFNRCSVVSPTFRKRVFQWTASTATITKEKQDQPKKDISNYQVEQAQVLLKREKEIPPTVFPNRSPWCQNPYVSAHPYCPLIEPHNTSTAGGRLDRQPRTRSTRPNRASGSKKKKTSESQKQ

SEQ ID NO: 7936 - protein, 105 aa, Homo Sapiens
QWTASTATITKEKQDQPKKDISNYQVEQAQVLLKREKEIPPTVFPNRSPWCQNPYVSAHPYCPLIEPHNTSTAGGRLDRQPRTRSTRPNRASGSKKKKTSESQKQ

SEQ ID NO: 7937 - protein, 163 aa, Homo Sapiens
  misc_feature (1)..(1): Xaa can be any naturally occurring amino acid
XDKFRASPDCITILCKPNGQAIAWYTPIHWKQAWEKLDADVEFNRCSVVSPTFRKRVFQWTASTATITKEKQDQPKKDISNYQVEQAQVLLKREKEIPPTVFPNRSPWCQNPYVSAHPYCPLIEPHNTSTAGGRLDRQPRTRSTRPNRASGSKKKKTSESQKQ

SEQ ID NO: 7938 - protein, 632 aa, Homo Sapiens
MKALLLLVLPWLSPANYIDNVGNLHFLYSELCKGASHYGLTKDRKRRSQDGCPDGCASLTATAPSPEVSAAATISLMTDEPGLDNPAYVSSAEDGQPAISPVDSGRSNRTRARPFERSTIRSRSFKKINRALSVLRRTKSGSAVANHADQGRENSENTTAPEVFPRLYHLIPDGEITSIKINRVDPSESLSIRLVGGSETPLVHIIIQHIYRDGVIARDGRLLPGDIILKVNGMDISNVPHNYAVRLLRQPCQVLWLTVMREQKFRSRNNGQAPDAYRPRDDSFHVILNKSSPEEQLGIKLVRKVDEPGVFIFNVLDGGVAYRHGQLEENDRVLAINGHDLRYGSPESAAHLIQASERRVHLVVSRQVRQRSPDIFQEAGWNSNGSWSPGPGERSNTPKPLHPTITCHEKVVNIQKDPGESLGMTVAGGASHREWDLPIYVISVEPGGVISRDGRIKTGDILLNVDGVELTEVSRSEAVALLKRTSSSIVLKALEVKEYEPQEDCSSPAALDSNHNMAPPSDWSPSWVMWLELPRCLYNCKDIVLRRNTAGSLGFCIVGGYEEYNGNKPFFIKSIVEGTPAYNDGRIRCGDILLAVNGRSTSGMIHACLARLLKELKGRITLTIVSWPGTFL

SEQ ID NO: 7939 - protein, 6 aa, Homo Sapiens
MNQPES

SEQ ID NO: 7940 - protein, 16 aa, Homo Sapiens
MNQPESANDPEPLCAV

SEQ ID NO: 7941 - protein, 90 aa, Homo Sapiens
MNQPESANDPEPLCAVCGQAHSLEENHFYSYPEEVDDDLICHICLQALLDPLDTPCGHTYCTLCLTNFLVEKDFCPMDRKPLVLQHCKKS

SEQ ID NO: 7942 - protein, 99 aa, Homo Sapiens
MNQPESANDPEPLCAVCGQAHSLEENHFYSYPEEVDDDLICHICLQALLDPLDTPCGHTYCTLCLTNFLVEKDFCPMDRKPLVLQHCKKSSILVNKLLN

SEQ ID NO: 7943 - protein, 126 aa, Homo Sapiens
MNQPESANDPEPLCAVCGQAHSLEENHFYSYPEEVDDDLICHICLQALLDPLDTPCGHTYCTLCLTNFLVEKDFCPMDRKPLVLQHCKKSSILVNKLLNKLLVTCPFREHCTQVLQRCDLEHHFQT

SEQ ID NO: 7944 - protein, 728 aa, Homo Sapiens
MNQPESANDPEPLCAVCGQAHSLEENHFYSYPEEVDDDLICHICLQALLDPLDTPCGHTYCTLCLTNFLVEKDFCPMDRKPLVLQHCKKSSILVNKLLNKLLVTCPFREHCTQVLQRCDLEHHFQTSCKGASHYGLTKDRKRRSQDGCPDGCASLTATAPSPEVSAAATISLMTDEPGLDNPAYVSSAEDGQPAISPVDSGRSNRTRARPFERSTIRSRSFKKINRALSVLRRTKSGSAVANHADQGRENSENTTAPEVFPRLYHLIPDGEITSIKINRVDPSESLSIRLVGGSETPLVHIIIQHIYRDGVIARDGRLLPGDIILKVNGMDISNVPHNYAVRLLRQPCQVLWLTVMREQKFRSRNNGQAPDAYRPRDDSFHVILNKSSPEEQLGIKLVRKVDEPGVFIFNVLDGGVAYRHGQLEENDRVLAINGHDLRYGSPESAAHLIQASERRVHLVVSRQVRQRSPDIFQEAGWNSNGSWSPGPGERSNTPKPLHPTITCHEKVVNIQKDPGESLGMTVAGGASHREWDLPIYVISVEPGGVISRDGRIKTGDILLNVDGVELTEVSRSEAVALLKRTSSSIVLKALEVKEYEPQEDCSSPAALDSNHNMAPPSDWSPSWVMWLELPRCLYNCKDIVLRRNTAGSLGFCIVGGYEEYNGNKPFFIKSIVEGTPAYNDGRIRCGDILLAVNGRSTSGMIHACLARLLKELKGRITLTIVSWPGTFL

SEQ ID NO: 7945 - protein, 417 aa, Homo Sapiens
MRFAWTVLLLGPLQLCALVHCAPPAAGQQQPPREPPAAPGAWRQQIQWENNGQVFSLLSLGSQYQPQRRRDPGAAVPGAANASAQQPRTPILLIRDNRTAAARTRTAGSSGVTAGRPRPTARHWFQAGYSTSRAREAGASRAENQTAPGEVPALSNLRPPSRVDGMVGDDPYNPYKYSDDNPYYNYYDTYERPRPGGRYRPGYGTGYFQYGLPDLVADPYYIQASTYVQKMSMYNLRCAAEENCLASTAYRADVRDYDHRVLLRFPQRVKNQGTSDFLPSRPRYSWEWHSCHQHYHSMDEFSHYDLLDANTQRRVAEGHKASFCLEDTSCDYGYHRRFACTAHTQGLSPGCYDTYGADIDCQWIDITDVKPGNYILKVSVNPSYLVPESDYTNNVVRCDIRYTGHHAYASGCTISPY

SEQ ID NO: 7946 - protein, 417 aa, Homo Sapiens; identical to SEQ ID NO: 7945

SEQ ID NO: 7947 - protein, 61 aa, Homo Sapiens
YNPYKYSDDNPYYNYYDTYERPRPGGRYRPGYGTGYFQYVQHTGQMSEIMITGCCSDFPKE

SEQ ID NO: 7948 - protein, 574 aa, Homo Sapiens
MALARGSRQLGALVWGACLCVLVHGQQAQPGQGSDPARWRQLIQWENNGQVYSLLNSGSEYVPAGPQRSESSSRVLLAGAPQAQQRRSHGSPRRRQAPSLPLPGRVGSDTVRGQARHPFGFGQVPDNWREVAVGDSTGMARARTSVSQQRHGGSASSVSASAFASTYRQQPSYPQQFPYPQAPFVSQYENYDPASRTYDQGFVYYRPAGGGVGAGAAAVASAGVIYPYQPRARYEEYGGGEELPEYPPQGFYPAPERPYVPPPPPPPDGLDRRYSHSLYSEGTPGFEQAYPDPGPEAAQAHGGDPRLGWYPPYANPPPEAYGPPRALEPPYLPVRSSDTPPPGGERNGAQQGRLSVGSVYRPNQNGRGLPDLVPDPNYVQASTYVQRAHLYSLRCAAEEKCLASTAYAPEATDYDVRVLLRFPQRVKNQGTADFLPNRPRHTWEWHSCHQHYHSMDEFSHYDLLDAATGKKVAEGHKASFCLEDSTCDFGNLKRYACTSHTQGLSPGCYDTYNADIDCQWIDITDVQPGNYILKVHVNPKYIVLESDFTNNVVRCNIHYTGRYVSATNCKIVQS

SEQ ID NO: 7949 - protein, 431 aa, Homo Sapiens
MALARGSRQLGALVWGACLCVLVHGQQAQPGQGSDPARWRQLIQWENNGQVYSLLNSGSEYVPAGPQRSESSSRVLLAGAPQAQQRRSHGSPRRRQAPSLPLPGRVGSDTVRGQARHPFGFGQVPDNWREVAVGDSTGMARARTSVSQQRHGGSASSVSASAFASTYRQQPSYPQQFPYPQAPFVSQYENYDPASRTYDQGFVYYRPAGGGVGAGAAAVASAGVIYPYQPRARYEEYGGGEELPEYPPQGFYPAPERPYVPPPPPPPDGLDRRYSHSLYSEGTPGFEQAYPDPGPEAAQAHGGDPRLGWYPPYANPPPEAYGPPRALEPPYLPVRSSDTPPPGGERNGAQQGRLSVGSVYRPNQNGRVTPAQTPACPGRKVEGQEQDGQAPGSGTSWGTRDHKDGGSLQTSPGRLTPGLAGERARASLRSP

SEQ ID NO: 7950 - protein, 258 aa, Homo Sapiens
MEASKVLDKSKAAAIGDQSRPLCSRKGLSGGGSGGGPPWRARSQPGHCGSLKPKSSCCFCTPPVPPSCAGPLRGIISPKTGMERPLCSHLCSCLAMLALLSPLSLAQYDSWPHYPEYFQQPAPEYHQPQAPANVAKIQLRLAGQKRKHSEGRVEVYYDGQWGTVCDDDFSIHAAHVVCRELGYVEAKSWTASSSYGKGEGPIWLDNLHCTGNEATLAACTSNGWGVTDCKHTEDVGVVCSDKRIPGFKFDNSLINQIE

SEQ ID NO: 7951 - protein, 218 aa, Homo Sapiens
MEASKVLDKSKAAESSCCFCTPPVPPSCAGPLRGIISPKTGMERPLCSHLCSCLAMLALLSPLSLAQYDSWPHYPEYFQQPAPEYHQPQAPANVAKIQLRLAGQKRKHSEGRVEVYYDGQWGTVCDDDFSIHAAHVVCRELGYVEAKSWTASSSYGKGEGPIWLDNLHCTGNEATLAACTSNGWGVTDCKHTEDVGVVCSDKRIPGFKFDNSLINQIE

SEQ ID NO: 7952 - protein, 101 aa, Homo Sapiens
MERPLCSHLCSCLAMLALLSPLSLAQYDSWPHYPEYFQQPAPEYHQPQAPANVAKIQLHLVLARRCQQQQSGHEWSEVLGNGAVPGALPPRRGGRGLPPGR

SEQ ID NO: 7953 - protein, 96 aa, Homo Sapiens
MERPLCSHLCSCLAMLALLSPLSLAQYDSWPHYPEYFQQPAPEYHQPQAPANVAKIQLRLAGQKRKHSEGRVEVYYDGQWGTVCDDDFSIHAAHVV

SEQ ID NO: 7954 - protein, 139 aa, Homo Sapiens
MERPLCSHLCSCLAMLALLSPLSLAQYDSWPHYPEYFQQPAPEYHQPQAPANVAKIQLRLAGQKRKHSEGRVEVYYDGQWGTVCDDDFSIHAAHVVCRELGYVEAKSWTASSSYGKGEGPIWLDNLHCTGNEATLAACT

SEQ ID NO: 7955 - protein, 151 aa, Homo Sapiens
MERPLCSHLCSCLAMLALLSPLSLAQYDSWPHYPEYFQQPAPEYHQPQAPANVAKIQLRLAGQKRKHSEGRVEVYYDGQWGTVCDDDFSIHAAHVVCRELGYVEAKSWTASSSYGKGEGPIWLDNLHCTGNEATLAACTSNGWGVTDCKHT

SEQ ID NO: 7956 - protein, 774 aa, Homo Sapiens
MERPLCSHLCSCLAMLALLSPLSLAQYDSWPHYPEYFQQPAPEYHQPQAPANVAKIQLRLAGQKRKHSEGRVEVYYDGQWGTVCDDDFSIHAAHVVCRELGYVEAKSWTASSSYGKGEGPIWLDNLHCTGNEATLAACTSNGWGVTDCKHTEDVGVVCSDKRIPGFKFDNSLINQIENLNIQVEDIRIRAILSTYRKRTPVMEGYVEVKEGKTWKQICDKHWTAKNSRVVCGMFGFPGERTYNTKVYKMFASRRKQRYWPFSMDCTGTEAHISSCKLGPQVSLDPMKNVTCENGLPAVVSCVPGQVFSPDGPSRFRKAYKPEQPLVRLRGGAYIGEGRVEVLKNGEWGTVCDDKWDLVSASVVCRELGFGSAKEAVTGSRLGQGIGPIHLNEIQCTGNEKSIIDCKFNAESQGCNHEEDAGVRCNTPAMGLQKKLRLNGGRNPYEGRVEVLVERNGSLVWGMVCGQNWGIVEAMVVCRQLGLGFASNAFQETWYWHGDVNSNKVVMSGVKCSGTELSLAHCRHDGEDVACPQGGVQYGAGVACSETAPDLVLNAEMVQQTTYLEDRPMFMLQCAMEENCLSASAAQTDPTTGYRRLLRFSSQIHNNGQSDFRPKNGRHAWIWHDCHRHYHSMEVFTHYDLLNLNGTKVAEGHKASFCLEDTECEGDIQKNYECANFGDQGITMGCWDMYRHDIDCQWVDITDVPPGDYLFQVVINPNFEVAESDYSNNIMKCRSRYDGHRIWMYNCHIGGSFSEETEKKFEHFSGLLNNQLSPQ

SEQ ID NO: 7957 - protein, 67 aa, Homo Sapiens
RIRAILSTYRKRTPVMEGYVEVKEGKTWKQICDKHWTAKNSRVVCGMFGFPGERTYNTKVYNNPWCD

SEQ ID NO: 7958 - protein, 207 aa, Homo Sapiens
  misc_feature (1)..(1): Xaa can be any naturally occurring amino acid
XENGLPAVVSCVPGQVFSPDGPSRFRKAYKPEQDRVSLQQPLVRLRGGAYIGEGRVEVLKNGEWGTVCDDKWDLVSASVVCRELGFGSAKEAVTGSRLGQGIGPIHLNEIQCTGNEKSIIDCKFNAESQGCNHEEDAGVRCNTPAMGLQKKLRLNGGRNPYEGRVEVLVERNGSLVWGMVCGQNWGIVEAMVVCRQLGLGFASNAFQ

SEQ ID NO: 7959 - protein, 586 aa, Homo Sapiens
MRPVSVWQWSPWGLLLCLLCSSCLGSPSPSTGPEKKAGSQGLRFRLAGFPRKPYEGRVEIQRAGEWGTICDDDFTLQAAHILCRELGFTEATGWTHSAKYGPGTGRIWLDNLSCSGTEQSVTECASRGWGNSDCTHDEDAGVICKDQRLPGFSDSNVIEARVRLKGGAHPGEGRVEVLKASTWGTVCDRKWDLHAASVVCRELGFGSAREALSGARMGQGMGAIHLSEVRCSGQELSLWKCPHKNITAEDCSHSQDAGVRCNLPYTGAETRIRLSGGRSQHEGRVEVQIGGPGPLRWGLICGDDWGTLEAMVACRQLGLGYANHGLQETWYWDSGNITEVVMSGVRCTGTELSLDQCAHHGTHITCKRTGTRFTAGVICSETASDLLLHSALVQETAYIEDRPLHMLYCAAEENCLASSARSANWPYGHRRLLRFSSQIHNLGRADFRPKAGRHSWVWHECHGHYHSMDIFTHYDILTPNGTKVAEGHKASFCLEDTECQEDVSKRYECANFGEQGITVGCWDLYRHDIDCQWIDITDVKPGNYILQVVINPNFEVAESDFTNNAMKCNCKYDGHRIWVHNCHIGI

SEQ ID NO: 7960 - protein, 608 aa, Homo Sapiens
MRPVSVWQWSPWGLLLCLLCSSCLGSPSPSTGPEKKAGSQGLRFRLAGFPRKPYEGRVEIQRAGEWGTICDDDFTLQAAHILCRELGFTEATGWTHSAKYGPGTGRIWLDNLSCSGTEQSVTECASRGWGNSDCTHDEDAGVICKDQRLPGFSDSNVIEARVRLKGGAHPGEGRVEVLKASTWGTVCDRKWDLHAASVVCRELGFGSAREALSGARMGQGMGAIHLSEVRCSGQELSLWKCPHKNITAEDCSHSQDAGVRCNLPYTGAETRIRLSGGRSQHEGRVEVQIGGPGPLRWGLICGDDWGTLEAMVACRQLGLGYANHGLQETWYWDSGNITEVVMSGVRCTGTELSLDQCAHHGTHITCKRTGTRFTAGVICSETASDLLLHSALVQETAYIEDRPLHMLYCAAEENCLASSARSANWPYGHRRLLRFSSQIHNLGRADFRPKAGRHSWVWHECHGHYHSMDIFTHYDILTPNGTKVAEGHKASFCLEDTECQEDVSKRYECANFGEQGITVGCWDLYRHDIDCQWIDITDVKPGNYILQVVINPNFEVAESDFTNNAMKCNCKYDGHRIWVHNCHIGDAFSEEANRRFERYPGQTSNQII

SEQ ID NO: 7961 - protein, 753 aa, Homo Sapiens
MRPVSVWQWSPWGLLLCLLCSSCLGSPSPSTGPEKKAGSQGLRFRLAGFPRKPYEGRVEIQRAGEWGTICDDDFTLQAAHILCRELGFTEATGWTHSAKYGPGTGRIWLDNLSCSGTEQSVTECASRGWGNSDCTHDEDAGVICKDQRLPGFSDSNVIEVEHHLQVEEVRIRPAVGWGRRPLPVTEGLVEVRLPDGWSQVCDKGWSAHNSHVVCGMLGFPSEKRVNAAFYRLLAQRQQHSFGLHGVACVGTEAHLSLCSLEFYRANDTARCPGGGPAVVSCVPGPVYAASSGQKKQQQSKPQGEARVRLKGGAHPGEGRVEVLKASTWGTVCDRKWDLHAASVVCRELGFGSAREALSGARMGQGMGAIHLSEVRCSGQELSLWKCPHKNITAEDCSHSQDAGVRCNLPYTGAETRIRLSGGRSQHEGRVEVQIGGPGPLRWGLICGDDWGTLEAMVACRQLGLGYANHGLQETWYWDSGNITEVVMSGVRCTGTELSLDQCAHHGTHITCKRTGTRFTAGVICSETASDLLLHSALVQETAYIEDRPLHMLYCAAEENCLASSARSANWPYGHRRLLRFSSQIHNLGRADFRPKAGRHSWVWHECHGHYHSMDIFTHYDILTPNGTKVAEGHKASFCLEDTECQEDVSKRYECANFGEQGITVGCWDLYRHDIDCQWIDITDVKPGNYILQVVINPNFEVAESDFTNNAMKCNCKYDGHRIWVHNCHIGDAFSEEANRRFERYPGQTSNQII

SEQ ID NO: 7962 - protein, 303 aa, Homo Sapiens
MRPVSVWQWSPWGLLLCLLCSSCLGSPSPSTGPEKKAGSQGLRFRLAGFPRKPYEGRVEIQRAGEWGTICDDDFTLQAAHILCRELGFTEATGWTHSAKYGPGTGRIWLDNLSCSGTEQSVTECASRGWGNSDCTHDEDAGVICKDQRLPGFSDSNVIEVEHHLQVEEVRIRPAVGWGRRPLPVTEGLVEVRLPDGWSQVCDKGWSAHNSHVVCGMLGFPSEKRVNAAFYRLLAQRQQHSFGLHGVACVGTEAHLSLCSLEFYRANDTARCPGGGPAVVSCVPGPVYAASSGQKKQQQSKPQG

SEQ ID NO: 7963 - protein, 471 aa, Homo Sapiens
MRPVSVWQWSPWGLLLCLLCSSCLGSPSPSTGPEKKAGSQGLRFRLAGFPRKPYEGRVEIQRAGEWGTICDDDFTLQAAHILCRELGFTEATGWTHSAKYGPGTGRIWLDNLSCSGTEQSVTECASRGWGNSDCTHDEDAGVICKDQRLPGFSDSNVIEVEHHLQVEEVRIRPAVGWGRRPLPVTEGLVEVRLPDGWSQVCDKGWSAHNSHVVCGMLGFPSEKRVNAAFYRLLAQRQQHSFGLHGVACVGTEAHLSLCSLEFYRANDTARCPGGGPAVVSCVPGPVYAASSGQKKQQQSKPQGEARVRLKGGAHPGEGRVEVLKASTWGTVCDRKWDLHAASVVCRELGFGSAREALSGARMGQDVSKRYECANFGEQGITVGCWDLYRHDIDCQWIDITDVKPGNYILQVVINPNFEVAESDFTNNAMKCNCKYDGHRIWVHNCHIGDAFSEEANRRFERYPGQTSNQII

SEQ ID NO: 7964 - protein, 697 aa, Homo Sapiens
MRPVSVWQWSPWGLLLCLLCSSCLGSPSPSTGPEKKAGSQGLRFRLAGFPRKPYEGRVEIQRAGEWGTICDDDFTLQAAHILCRELGFTEATGWTHSAKYGPGTGRIWLDNLSCSGTEQSVTECASRGWGNSDCTHDEDAGVICKDQRLPGFSDSNVIEVEHHLQVEEVRIRPAVGWGRRPLPVTEGLVEVRLPDGWSQVCDKGWSAHNSHVVCGMLGFPSEKRVNAAFYRLLAQRQQHSFGLHGVACVGTEAHLSLCSLEFYRANDTARCPGGGPAVVSCVPGPVYAASSGQKKQQQSKPQGEARVRLKGGAHPGEGRVEVLKASTWGTVCDRKWDLHAASVVCRELGFGSAREALSGARMGQGMGAIHLSEVRCSGQELSLWKCPHKNITAEDCSHSQDAGVRCNLPYTGAETRETWYWDSGNITEVVMSGVRCTGTELSLDQCAHHGTHITCKRTGTRFTAGVICSETASDLLLHSALVQETAYIEDRPLHMLYCAAEENCLASSARSANWPYGHRRLLRFSSQIHNLGRADFRPKAGRHSWVWHECHGHYHSMDIFTHYDILTPNGTKVAEGHKASFCLEDTECQEDVSKRYECANFGEQGITVGCWDLYRHDIDCQWIDITDVKPGNYILQVVINPNFEVAESDFTNNAMKCNCKYDGHRIWVHNCHIGDAFSEEANRRFERYPGQTSNQII

SEQ ID NO: 7965 - protein, 180 aa, Homo Sapiens
  misc_feature (1)..(1): Xaa can be any naturally occurring amino acid
XRQRLERPQQPRGLRDAGLPQRKEGQRGLLQARVRLKGGAHPGEGRVEVLKASTWGTVCDRKWDLHAASVVCRELGFGSAREALSGARMGQGMGAIHLSEVRCSGQELSLWKCPHKNITAEDCSHSQDAGVRCNLPYTGAETRIRLSGGRSQHEGRVEVQIGGPGPLRWGLICGDDWGTL

SEQ ID NO: 7966 - protein, 756 aa, Homo Sapiens
MAWSPPATLFLFLLLLGQPPPSRPQSLGTTKLRLVGPESKPEEGRLEVLHQGQWGTVCDDNFAIQEATVACRQLGFEAALTWAHSAKYGQGEGPIWLDNVRCVGTESSLDQCGSNGWGVSDCSHSEDVGVICHPRRHRGYLSETVSNALGPQGRRLEEVRLKPILASAKQHSPVTEGAVEVKYEGHWRQVCDQGWTMNNSRVVCGMLGFPSEVPVDSHYYRKVWDLKMRDPKSRLKSLTNKNSFWIHQVTCLGTEPHMANCQVQVAPARGKLRPACPGGMHAVVSCVAGPHFRPPKTKPQRKGSWAEEPRVRLRSGAQVGEGRVEVLMNRQWGTVCDHRWNLISASVVCRQLGFGSAREALFGARLGQGLGPIHLSEVRCRGYERTLSDCPALEGSQNGCQHENDAAVRCNVPNMGFQNQVRLAGGRIPEEGLLEVQVEVNGVPRWGSVCSENWGLTEAMVACRQLGLGFAIHAYKETWFWSGTPRAQEVVMSGVRCSGTELALQQCQRHGPVHCSHGGGRFLAGVSCMDSAPDLVMNAQLVQETAYLEDRPLSQLYCAHEENCLSKSADHMDWPYGYRRLLRFSTQIYNLGRTDFRPKTGRDSWVWHQCHRHYHSIEVFTHYDLLTLNGSKVAEGHKASFCLEDTNCPTGLQRRYACANFGEQGVTVGCWDTYRHDIDCQWVDITDVGPGNYIFQVIVNPHYEVAESDFSNNMLQCRCKYDGHRVWLHNCHTGNSYPANAELSLEQEQRLRNNLI

SEQ ID NO: 7967 - protein, 2040 aa, Homo Sapiens
MEHKEVVLLLLLFLKSAAPEQSHVVQDCYHGDGQSYRGTYSTTVTGRTCQAWSSMTPHQHNRTTENYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDPVAAPYCYTRDPSVRWEYCNLTQCSDAEGTAVAPPTITPIPSLEAPSEQAPTEQRPGVQECYHGNGQSYQGTYFITVTGRTCQAWSSMTPHSHSRTPAYYPNAGLIKNYCRNPDPVAAPWCYTTDPSVRWEYCNLTRCSDAEWTAFVPPNVILAPSLEAFFEQALTEETPGVQDCYYHYGQSYRGTYSTTVTGRTCQAWSSMTPHQHSRTPENYPNAGLTRNYCRNPDAEIRPWCYTMDPSVRWEYCNLTQCLVTESSVLATLTVVPDPSTEASSEEAPTEQSPGVQDCYHGDGQSYRGSFSTTVTGRTCQSWSSMTPHWHQRTTEYYPNGGLTRNYCRNPDAEISPWCYTMDPNVRWEYCNLTQCPVTESSVLATSTAVSEQAPTEQSPTVQDCYHGDGQSYRGSFSTTVTGRTCQSWSSMTPHWHQRTTEYYPNGGLTRNYCRNPDAEIRPWCYTMDPSVRWEYCNLTQCPVMESTLLTTPTVVPVPSTELPSEEAPTENSTGVQDCYRGDGQSYRGTLSTTITGRTCQSWSSMTPHWHRRIPLYYPNAGLTRNYCRNPDAEIRPWCYTMDPSVRWEYCNLTRCPVTESSVLTTPTVAPVPSTEAPSEQAPPEKSPVVQDCYHGDGRSYRGISSTTVTGRTCQSWSSMIPHWHQRTPENYPNAGLTENYCRNPDSGKQPWCYTTDPCVRWEYCNLTQCSETESGVLETPTVVPVPSMEAHSEAAPTEQTPVVRQCYHGNGQSYRGTFSTTVTGRTCQSWSSMTPHRHQRTPENYPNDGLTMNYCRNPDADTGPWCFTMDPSIRWEYCNLTRCSDTEGTVVAPPTVIQVPSLGPPSEQDCMFGNGKGYRGKKATTVTGTPCQEWAAQEPHRHSTFIPGTNKWAGLEKNYCRNPDGDINGPWCYTMNPRKLFDYCDIPLCASSSFDCGKPQVEPKKCPGSIVGGCVAHPHSWPWQVSLRTRFGKHFCGGTLISPEWVLTAAHCLKKSSRPSSYKVILGAHQEVNLESHVQEIEVSRLFLEPTQADIALLKLSRPAVITDKVMPACLPSPDYMVTARTECYITGWGETQGTFGTGLLKEAQLLVIENEVCNHYKYICAEHLARGTDSCQGDSGGPLVCFEKDKYILQGVTSWGLGCARPNKPGVYARVSRFVTWIEGMMRNN

SEQ ID NO: 7968 - protein, 571 aa, Homo Sapiens
SGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNA

SEQ ID NO: 7969 - protein, 613 aa, Homo Sapiens
SGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDPVAAPYCYTRDPSVRWEYCNLTQCSDAEGTAVAPPTITPIPSLEAPSEQAPTEQRPGVQECYHGNGQSYQGTYFITVTGRTCQAWSSMTPHSHSRTPAYYPNAGLIKNYCRNPDPVAAPWCYTTDPSVRWEYCNLTRCSDAEWTAFVPPNVILAPSLEAFFEQALTEETPGVQDCYYHYGQSYRGTYSTTVTGRTCQAWSSMTPHQHSRTPENYPNAGLTRNYCRNPDAEIRPWCYTMDPSVRWEYCNLTQCLVTESSVLATLTVVPDPSTEASSEEAPTEQSPGVQDCYHGDGQSYRGSFSTTVTGRTCQSWSSMTPHWHQRTTEYYPNGGLTRNYCRNPDAEISPWCYTMDPNVRWEYCNLTQCPVTESSVLATSTAVSEQAPTEQSPTVQDCYHGDGQSYRGSFSTTVTGRTCQSWSSMTPHWHQRTTEYYPNGGLTRNYCRNPDAEIRPWCYTMDPSVRWEYCNLTQCPVMESTLLTTPTVVP

SEQ ID NO: 7970 - protein, 39 aa, Homo Sapiens
MESKALLVLTLAVWLQSLTASRGGVAAADLILKLQIFKF

SEQ ID NO: 7971 - protein, 106 aa, Homo Sapiens
MESKALLVLTLAVWLQSLTASRGGVAAADQRRDFIDIESKFALRTPEDTAEDTCHLIPGVAESVATCHFNHSSKTFMVIHGWTVTGMYESWVPKLVAALYKREPDS

SEQ ID NO: 7972 - protein, 130 aa, Homo Sapiens
MESKALLVLTLAVWLQSLTASRGGVAAADQRRDFIDIESKFALRTPEDTAEDTCHLIPGVAESVATCHFNHSSKTFMVIHGWTVTGMYESWVPKLVAALYKREPDSNVIVVDWLSRAQEHYPVSAGYTKL

SEQ ID NO: 7973 - protein, 475 aa, Homo Sapiens
MESKALLVLTLAVWLQSLTASRGGVAAADQRRDFIDIESKFALRTPEDTAEDTCHLIPGVAESVATCHFNHSSKTFMVIHGWTVTGMYESWVPKLVAALYKREPDSNVIVVDWLSRAQEHYPVSAGYTKLVGQDVARFINWMEEEFNYPLDNVHLLGYSLGAHAAGIAGSLTNKKVNRITGLDPAGPNFEYAEAPSRLSPDDADFVDVLHTFTRGSPGRSIGIQKPVGHVDIYPNGGTFQPGCNIGEAIRVIAERGLGDVDQLVKCSHERSIHLFIDSLLNEENPSKAYRCSSKEAFEKGLCLSCRKNRCNNLGYEINKVRAKRSSKMYLKTRSQMPYKVFHYQVKIHFSGTESETHTNQAFEISLYGTVAESENIPFTLPEVSTNKTYSFLIYTEVDIGELLMLKLKWKSDSYFSWSDWWSSPGFAIQKIRVKAGETQKKVIFCSREKVSHLQKGKAPAVFVKCHDKSLNKKSG

SEQ ID NO: 7974 - protein, 115 aa, Homo Sapiens
MVIHGWTVTGMYESWVPKLVAALYKREPDSNVIVVDWLSRAQEHYPVSAGYTKLVGQDVARFINWMEEEFNYPLDNVHLLGYSLGAHAAGIAGSLTNKKVNRITGLDPAGPNFEY

SEQ ID NO: 7975 - protein, 117 aa, Homo Sapiens
FPPNDPKAGTQGKCMPFFRAGFVCPTPPYKSLAREQINALTSFLDASFVYSSEPSLASRLRNLSSPLGLMAVNQEVSDHGLPYLPYDSKKPSPCEFINTTARVPCFLAGKETEAQKC

SEQ ID NO: 7976 - protein, 95 aa, Homo Sapiens
GCGAPAPVVRCDPCSPYRTITGDCNNRRKPALGAANRALARWLPAEYEDGLSLPFGWTPGKTRNGFPLPLAREVSNKIVGYLNEEGVLDQNRSTL

SEQ ID NO: 7977 - protein, 712 aa, Homo Sapiens
MRVLLHLPALLASLILLQAAASTTRAQTTRTSAISDTVSQAKVQVNKAFLDSRTRLKTAMSSETPTSRQLSEYLKHAKGRTRTAIRNGQVWEESLKRLRQKASLTNVTDPSLDLTSLSLEVGCGAPAPVVRCDPCSPYRTITGDCNNRRKPALGAANRALARWLPAEYEDGLSLPFGWTPGKTRNGFPLPLAREVSNKIVGYLNEEGVLDQNRSLLFMQWGQIVDHDLDFAPDTELGSSEYSKAQCDEYCIQGDNCFPIMFPPNDPKAGTQGKCMPFFRAGFVCPTPPYKSLAREQINALTSFLDASFVYSSEPSLASRLRNLSSPLGLMAVNQEVSDHGLPYLPYDSKKPSPCEFINTTARVPCFLAGDSRASEHILLATSHTLFLREHNRLARELKRLNPQWDGEKLYQEARKILGAFVQIITFRDYLPILLGDHMQKWIPPYQGYSESVDPRISNVFTFAFRFGHLEVPSSMFRLDENYQPWGPEPELPLHTLFFNTWRMVKDGGIDPLVRGLLAKKSKLMKQNKMMTGELRNKLFQPTHRIHGFDLAAINTQRCRDHGQPGYNSWRAFCDLSQPQTLEELNTVLKSKMLAKKLLGLYGTPDNIDIWIGAIAEPLVERGRVGPLLACLLGKQFQQIRDGDRFWWENPGVFTNEQKDSLQKMSFSRLVCDNTRITKVPRDPFWANSYPYDFVDCSAIDKLDLSPWASVKN

SEQ ID NO: 7978 - protein, 629 aa, Homo Sapiens
MRVLLHLPALLASLILLQAAASTTRDPSLDLTSLSLEVGCGAPAPVVRCDPCSPYRTITGDCNNRRKPALGAANRALARWLPAEYEDGLSLPFGWTPGKTRNGFPLPLAREVSNKIVGYLNEEGVLDQNRSLLFMQWGQIVDHDLDFAPDTELGSSEYSKAQCDEYCIQGDNCFPIMFPPNDPKAGTQGKCMPFFRAGFVCPTPPYKSLAREQINALTSFLDASFVYSSEPSLASRLRNLSSPLGLMAVNQEVSDHGLPYLPYDSKKPSPCEFINTTARVPCFLAGDSRASEHILLATSHTLFLREHNRLARELKRLNPQWDGEKLYQEARKILGAFVQIITFRDYLPILLGDHMQKWIPPYQGYSESVDPRISNVFTFAFRFGHLEVPSSMFRLDENYQPWGPEPELPLHTLFFNTWRMVKDGGIDPLVRGLLAKKSKLMKQNKMMTGELRNKLFQPTHRIHGFDLAAINTQRCRDHGQPGYNSWRAFCDLSQPQTLEELNTVLKSKMLAKKLLGLYGTPDNIDIWIGAIAEPLVERGRVGPLLACLLGKQFQQIRDGDRFWWENPGVFTNEQKDSLQKMSFSRLVCDNTRITKVPRDPFWANSYPYDFVDCSAIDKLDLSPWASVKN

SEQ ID NO: 7979 - protein, 629 aa, Homo Sapiens; identical to SEQ ID NO: 7978

SEQ ID NO: 7980 - protein, 123 aa, Homo Sapiens
MSSETPTSRQLSEYLKHAKGRTRTAIRNGQVWEESLKRLRQKASLTNVTDPSLDLTSLSLEVGCGAPAPVVRCDPCSPYRTITGDCNNRRKPALGAANRALARWLPAEYEDGLSLPFGWTPGK

SEQ ID NO: 7981 - protein, 653 aa, Homo Sapiens
MSSETPTSRQLSEYLKHAKGRTRTAIRNGQVWEESLKRLRQKASLTNVTDPSLDLTSLSLEVGCGAPAPVVRCDPCSPYRTITGDCNNRRKPALGAANRALARWLPAEYEDGLSLPFGWTPGKTRNGFPLPLAREVSNKIVGYLNEEGVLDQNRSLLFMQWGQIVDHDLDFAPDTELGSSEYSKAQCDEYCIQGDNCFPIMFPPNDPKAGTQGKCMPFFRAGFVCPTPPYKSLAREQINALTSFLDASFVYSSEPSLASRLRNLSSPLGLMAVNQEVSDHGLPYLPYDSKKPSPCEFINTTARVPCFLAGDSRASEHILLATSHTLFLREHNRLARELKRLNPQWDGEKLYQEARKILGAFVQIITFRDYLPILLGDHMQKWIPPYQGYSESVDPRISNVFTFAFRFGHLEVPSSMFRLDENYQPWGPEPELPLHTLFFNTWRMVKDGGIDPLVRGLLAKKSKLMKQNKMMTGELRNKLFQPTHRIHGFDLAAINTQRCRDHGQPGYNSWRAFCDLSQPQTLEELNTVLKSKMLAKKLLGLYGTPDNIDIWIGAIAEPLVERGRVGPLLACLLGKQFQQIRDGDRFWWENPGVFTNEQKDSLQKMSFSRLVCDNTRITKVPRDPFWANSYPYDFVDCSAIDKLDLSPWASVKN

SEQ ID NO: 7982 - protein, 69 aa, Homo Sapiens
MKNPMLEVVSLLLEKLLLISNFTLFSSGAAGEDKGRNSFYETSSFHRGDVLEVPRTHLTHYGIYLGDNR

SEQ ID NO: 7983 - protein, 230 aa, Homo Sapiens
MKNPMLEVVSLLLEKLLLISNFTLFSSGAAGEDKGRNSFYETSSFHRGDVLEVPRTHLTHYGIYLGDNRVAHMMPDILLALTDDMGRTQKVVSNKRLILGVIVKVASIRVDTVEDFAYGANILVNHLDESLQKKALLNEEVARRAEKLLGFTPYSLLWNNCEHFVTYCRYGTPISPQSDKFCETVKIIIRDQRSVLASAVLGLASIVCTGLVSYTTLPAIFIPFFLWMAG

SEQ ID NO: 7984 - protein, 230 aa, Homo Sapiens; identical to SEQ ID NO: 7983

SEQ ID NO: 7985 - protein, 214 aa, Homo Sapiens
AVLDFVKQKASQSPQKQHPLLDGVDGECPFPSRRSQHTDDSALCMSDDRPNALLSSPATETGHASPLPPSAAPTTDSTDSITGQNSRQREEELELIDQLRKHIEYRLKVSLPCDLGAALTDGVVLCHLANHVRPRSVPSIHVPSPAVPKLTMAKCRRNVENFLEACRKIGVPQEQLCLPLHILEEKGLSQVAVTVQALLELAPPKQQQHQLSAV

SEQ ID NO: 7986 - protein, 712 aa, Homo Sapiens
MAAAGLVAVAAAAEYSGTVASGGNLPGVHCGPSSGAGPGFGPGSWSRSLDRALEEAAVTGVLSLSGRKLREFPRGAANHDLTDTTRADLSRNRLSEIPIEACHFVSLENLNLYQNCIRYIPEAILNLQALTFLNISRNQLSTLPVHLCNLPLKVLIASNNKLVSLPEEIGHLRHLMELDVSCNEIQTIPSQIGNLEALRDLNVRRNHLVHLPEELAELPLIRLDFSCNKITTIPVCYRNLRHLQTITLDNNPLQSPPAQICIKGKVHIFKYLNIQACKIAPDLPDYDRRPLGFGSCHEELYSSRPYGALDSGFNSVDSGDKRWSGNEPTDEFSDLPLRVAEITKEQRLRRESQYQENRGSLVVTNGGVEHDLDQIDYIDSCTAEEEEAEVRQPKGPDPDSLSSQFMAYIEQRRISHEGSPVKPVAIREFQKTEDMRRYLHQNRVPAEPSSLLSLSASHNQLSHTDLELHQRREQLVERTRREAQLAALQYEEEKIRTKQIQRDAVLDFVKQKASQSPQKQHPLLDGVDGECPFPSRRSQHTDDSALCMSLSGLNQVGCAATLPHSSAFTPLKSDDRPNALLSSPATETVHHSPAYSFPAAIQRNQPQRPESFLFRAGVRAETNKGHASPLPPSAAPTTDSTDSITGQNSRQREEELELIDQLRKHIEYRLKVSLPCDLGAALTDGVVLCHLANHVRPRSVPSIHVPSPAVVS

SEQ ID NO: 7987 - protein, 725 aa, Homo Sapiens
MAAAGLVAVAAAAEYSGTVASGGNLPGVHCGPSSGAGPGFGPGSWSRSLDRALEEAAVTGVLSLSGRKLREFPRGAANHDLTDTTRADLSRNRLSEIPIEACHFVSLENLNLYQNCIRYIPEAILNLQALTFLNISRNQLSTLPVHLCNLPLKVLIASNNKLVSLPEEIGHLRHLMELDVSCNEIQTIPSQIGNLEALRDLNVRRNHLVHLPEELAELPLIRLDFSCNKITTIPVCYRNLRHLQTITLDNNPLQSPPAQICIKGKVHIFKYLNIQACKIAPDLPDYDRRPLGFGSCHEELYSSRPYGALDSGFNSVDSGDKRWSGNEPTDEFSDLPLRVAEITKEQRLRRESQYQENRGSLVVTNGGVEHDLDQIDYIDSCTAEEEEAEGSPVKPVAIREFQKTEDMRRYLHQNRVPAEPSSLLSLSASHNQLSHTDLELHQRREQLVERTRREAQLAALQYEEEKIRTKQIQRDAVLDFVKQKASQSPQKQHPLLDGVDGECPFPSRRSQHTDDSALCMSDDRPNALLSSPATETVHHSPAYSFPAAIQRNQPQRPESFLFRAGVRAETNKGHASPLPPSAAPTTDSTDSITGQNSRQREEELELIDQLRKHIEYRLKVSLPCDLGAALTDGVVLCHLANHVRPRSVPSIHVPSPAVPKLTMAKCRRNVENFLEACRKIGVPQEQLCLPLHILEEKGLSQVAVTVQALLELAPPKQQQHQLSAV

SEQ ID NO: 7988 - protein, 803 aa, Homo Sapiens
MAAAGLVAVAAAAEYSGTVASGGNLPGVHCGPSSGAGPGFGPGSWSRSLDRALEEAAVTGVLSLSGRKLREFPRGAANHDLTDTTRADLSRNRLSEIPIEACHFVSLENLNLYQNCIRYIPEAILNLQALTFLNISRNQLSTLPVHLCNLPLKVLIASNNKLVSLPEEIGHLRHLMELDVSCNEIQTIPSQIGNLEALRDLNVRRNHLVHLPEELAELPLIRLDFSCNKITTIPVCYRNLRHLQTITLDNNPLQSPPAQICIKGKVHIFKYLNIQACKIAPDLPDYDRRPLGFGSCHEELYSSRPYGALDSGFNSVDSGDKRWSGNEPTDEFSDLPLRVAEITKEQRLRRESQYQENRGSLVVTNGGVEHDLDQIDYIDSCTAEEEEAEVRQPKGPDPDSLSSQFMAYIEQRRISHEGSPVKPVAIREFQKTEDMRRYLHQNRVPAEPSSLLSLSASHNQLSHTDLELHQRREQLVERTRREAQLAALQYEEEKIRTKQIQRDAVLDFVKQKASQSPQKQHPLLDGVDGECPFPSRRSQHTDDSALCMSLSGLNQVGCAATLPHSSAFTPLKSDDRPNALLSSPATETVHHSPAYSFPAAIQRNQPQRPESFLFRAGVRAETNKGHASPLPPSAAPTTDSTDSITGQNSRQREEELELIDQLRKHIEYRLKVSLPCDLGAALTDGVVLCHLANHVRPRSVPSIHVPSPAVPKLTMAKCRRNVENFLEACRKIGVPQDNLCSPSDILQLNLSVKRTVETLLSLGAHSEESSFVCLSLQLLGFVAFYCTVMLTLCVLYYWLFPAR

SEQ ID NO: 7989 - protein, 777 aa, Homo Sapiens
MAAAGLVAVAAAAEYSGTVASGGNLPGVHCGPSSGAGPGFGPGSWSRSLDRALEEAAVTGVLSLSGRKLREFPRGAANHDLTDTTRADLSRNRLSEIPIEACHFVSLENLNLYQNCIRYIPEAILNLQALTFLNISRNQLSTLPVHLCNLPLKVLIASNNKLVSLPEEIGHLRHLMELDVSCNEIQTIPSQIGNLEALRDLNVRRNHLVHLPEELAELPLIRLDFSCNKITTIPVCYRNLRHLQTITLDNNPLQSPPAQICIKGKVHIFKYLNIQACKIAPDLPDYDRRPLGFGSCHEELYSSRPYGALDSGFNSVDSGDKRWSGNEPTDEFSDLPLRVAEITKEQRLRRESQYQENRGSLVVTNGGVEHDLDQIDYIDSCTAEEEEAEVRQPKGPDPDSLSSQFMAYIEQRRISHEGSPVKPVAIREFQKTEDMRRYLHQNRVPAEPSSLLSLSASHNQLSHTDLELHQRREQLVERTRREAQLAALQYEEEKIRTKQIQRDAVLDFVKQKASQSPQKQHPLLDGVDGECPFPSRRSQHTDDSALCMSLSGLNQVGCAATLPHSSAFTPLKSDDRPNALLSSPATETVHHSPAYSFPAAIQRNQPQRPESFLFRAGVRAETNKGHASPLPPSAAPTTDSTDSITGQNSRQREEELELIDQLRKHIEYRLKVSLPCDLGAALTDGVVLCHLANHVRPRSVPSIHVPSPAVPKLTMAKCRRNVENFLEACRKIGVPQEQLCLPLHILEEKGLSQVAVTVQALLELAPPKQQQHQLSAV

SEQ ID NO: 7990 - protein, 803 aa, Homo Sapiens; identical to SEQ ID NO: 7988

SEQ ID NO: 7991 - protein, 623 aa, Homo Sapiens
MAAAGLVAVAAAAEYSGTVASGGNLPGVHCGPSSGAGPGFGPGSWSRSLDRALEEAAVTGVLSLSGRKLREFPRGAANHDLTDTTRAELAELPLIRLDFSCNKITTIPVCYRNLRHLQTITLDNNPLQSPPAQICIKGKVHIFKYLNIQACKIAPDLPDYDRRPLGFGSCHEELYSSRPYGALDSGFNSVDSGDKRWSGNEPTDEFSDLPLRVAEITKEQRLRRESQYQENRGSLVVTNGGVEHDLDQIDYIDSCTAEEEEAEGSPVKPVAIREFQKTEDMRRYLHQNRVPAEPSSLLSLSASHNQLSHTDLELHQRREQLVERTRREAQLAALQYEEEKIRTKQIQRDAVLDFVKQKASQSPQKQHPLLDGVDGECPFPSRRSQHTDDSALCMSLSGLNQVGCAATLPHSSAFTPLKSDDRPNALLSSPATETVHHSPAYSFPAAIQRNQPQRPESFLFRAGVRAETNKGHASPLPPSAAPTTDSTDSITGQNSRQREEELELIDQLRKHIEYRLKVSLPCDLGAALTDGVVLCHLANHVRPRSVPSIHVPSPAVPKLTMAKCRRNVENFLEACRKIGVPQEQLCLPLHILEEKGLSQVAVTVQALLELAPPKQQQHQLSAV

SEQ ID NO: 7992 - protein, 92 aa, Homo Sapiens
MAAAGLVAVAAAAEYSGTVASGGNLPGVHCGPSSGAGPGFGPGSWSRSLDRALEEAAVTGVLSLSGRKLREFPRGAANHDLTDTTRAGCELQ

SEQ ID NO: 7993 - protein, 227 aa, Homo Sapiens
YEEEKIRTKQIQRDAVLDFVKQKASQSPQKQHPLLDGVDGECPFPSRRSQHTDDSALCMSLSGLNQVGCAATLPHSSAFTPLKSDDRPNALLSSPATETGHASPLPPSAAPTTDSTDSITGQNSRQREEELELIDQLRKHIEYRLKVSLPCDLGAALTDGVVLCHLANHVRPRSVPSIHVPSPAVPKLTMAKCRRNVENFLEACRKIGVPQDNLCSPSDILQLNLSV

SEQ ID NO: 7994 - protein, 159 aa, Homo Sapiens
MAGPGWTLLLLLLLLLLLGSMAGYGPQKKLNLSHKGIGEPCRRHEECQSNCCTINSLAPHTLCTPKTIFLQCLPWRKPNGYRCSHDSECQSSCCVRNNSPQELCTPQSVFLQCVPWRKPNGDFCSSHQECHSQCCIQLREYSPFRCIPRTGILAQCLPL

SEQ ID NO: 7995 - protein, 139 aa, Homo Sapiens
MAGPGWTLLLLLLLLLLLGSMAGYGPQKKLNLSHKGIGEPCRRHEECQSNCCTINSLAPHTLCTPKTIFLQCLPWRKVSPMGTDARTTQSARAAAASATTARRSCARPKASSCSVCPGASPTATSAAAIRSVTASAASS

SEQ ID NO: 7996 - protein, 46 aa, Homo Sapiens
MAGPGWTLLLLLLLLLLLGSMAGYGPQKKLNLSHKKLLRKPKFEGW

SEQ ID NO: 7997 - protein, 61 aa, Homo Sapiens
MAGPGWTLLLLLLLLLLLGSMAGYGPQKKLNLSHKPRAPSTDLPEPRQSGFVPETSQETQV

SEQ ID NO: 7998 - protein, 635 aa, Homo Sapiens
MAPPLLLLLLASGAAACPLPCVCQNLSESLSTLCAHRGLLFVPPNVDRRTVELRLADNFIQALGPPDFRNMTGLVDLTLSRNAITRIGARAFGDLESLRSLHLDGNRLVELGTGSLRGPVNLQHLILSGNQLGRIAPGAFDDFLESLEDLDLSYNNLRQVPWAGIGAMPALHTLNLDHNLIDALPPGAFAQLGQLSRLDLTSNRLATLAPDPLFSRGRDAEASPAPLVLSFSGNPLHCNCELLWLRRLARPDDLETCASPPGLAGRYFWAVPEGEFSCEPPLIARHTQRLWVLEGQRATLRCRALGDPAPTMHWVGPDDRLVGNSSRARAFPNGTLEIGVTGAGDAGGYTCIATNPAGEATARVELRVLALPHGGNSSAEGGRPGPSDIAASARTAAEGEGTLESEPAVQVTEVTATSGLVSWGPGRPADPVWMFQIQYNSSEDETLIYRIVPASSHHFLLKHLVPGADYDLCLLALSPAAGPSDLTATRLLGCAHFSTLPASPLCHALQAHVLGGTLTVAVGGVLVAALLVFTVALLVRGRGAGNGRLPLKLSHVQSQTNGGPSPTPKAHPPRSPPPRPQRSCSLDLGDAGCYGYARRLGGAWARRSHSVHGGLLGAGCRGVGGSAERLEESVV

SEQ ID NO: 7999 - protein, 418 aa, Homo Sapiens
MAPPLLLLLLASGAAACPLPCVCQNLSESLSTLCAHRGLLFVPPNVDRRTVELRLADNFIQALGPPDFRNMTGLVDLTLSRNAITRIGARAFGDLESLRSLHLDGNRLVELGTGSLRGPVNLQHLILSGNQLGRIAPGAFDDFLESLEDLDLSYNNLRQVPWAGIGAMPALHTLNLDHNLIDALPPGAFAQLGQLSRLDLTSNRLATLAPDPLFSRGRDAEASPAPLVLSFSGNPLHCNCELLWLRRLARPDDLETCASPPGLAGRYFWAVPEGEFSCEPPLIARHTQRLWVLEGQRATLRCRALGDPAPTMHWVGPDDRLVGNSSRARAFPNGTLEIGVTGAGDAGGYTCIATNPAGEATARVELRVLALPHGGNSRPGAAAWPGSPSLVFILSTSGSPVYLEGQGALSSVLASRPG

SEQ ID NO: 8000 - protein, 719 aa, Homo Sapiens
MEKILFYLFLIGIAVKAQICPKRCVCQILSPNLATLCAKKGLLFVPPNIDRRTVELRLADNFVTNIKRKDFANMTSLVDLTLSRNTISFITPHAFADLRNLRALHLNSNRLTKITNDMFSGLSNLHHLILNNNQLTLISSTAFDDVFALEELDLSYNNLETIPWDAVEKMVSLHTLSLDHNMIDNIPKGTFSHLHKMTRLDVTSNKLQKLPPDPLFQRAQVLATSGIISPSTFALSFGGNPLHCNCELLWLRRLSREDDLETCASPPLLTGRYFWSIPEEEFLCEPPLITRHTHEMRVLEGQRATLRCKARGDPEPAIHWISPEGKLISNATRSLVYDNGTLDILITTVKDTGAFTCIASNPAGEATQIVDLHIIKLPHLLNSTNHIHEPDPGSSDISTSTKSGSNTSSSNGDTKLSQDKIVVAEATSSTALLKFNFQRNIPGIRMFQIQYNGTYDDTLVYRMIPPTSKTFLVNNLAAGTMYDLCVLAIYDDGITSLTATRVVGCIQFTTEQDYVRCHFMQSQFLGGTMIIIIGGIIVASVLVFIIILMIRYKVCNNNGQHKVTKVSNVYSQTNGAQIQGCSVTLPQSVSKQAVGHEENAQCCKATSDNVIQSSETCSSQDSSTTTSALPPSWTSSTSVSQKQKRKTGTKPSTEPQNEAVTNVESQNTNRNNSTALQLASRPPDSVTEGPTSKRAHIKPNALLTNVDQIVQETQRLELI

SEQ ID NO: 8001 - protein, 466 aa, Homo Sapiens
MEKILFYLFLIGIAVKAQICPKRCVCQILSPNLATLCAKKGLLFVPPNIDRRTVELRLADNFVTNIKRKDFANMTSLVDLTLSRNTISFITPHAFADLRNLRALHLNSNRLTKITNDMFSGLSNLHHLILNNNQLTLISSTAFDDVFALEELDLSYNNLETIPWDAVEKMVSLHTLSLDHNMIDNIPKGTFSHLHKMTRLDVTSNKLQKLPPDPLFQRAQVLATSGIISPSTFALSFGGNPLHCNCELLWLRRLSREDDLETCASPPLLTGRYFWSIPEEEFLCEPPLITRHTHEMRVLEGQRATLRCKARGDPEPAIHWISPEGKLISNATRSLVYDNGTLDILITTVKDTGAFTCIASNPAGEATQIVDLHIIKLPHLLNSTNHIHEPDPGSSDISTSTKSGSNTSSSNGDTKLSQDKIVVAEATSSTALLKFNFQRNIPGIRMFQIQYNGTYDDTLVYRCFAD

SEQ ID NO: 8002 - protein, 465 aa, Homo Sapiens
MEKILFYLFLIGIAVKAQICPKRCVCQILSPNLATLCAKKGLLFVPPNIDRRTVELRLADNFVTNIKRKDFANMTSLVDLTLSRNTISFITPHAFADLRNLRALHLNSNRLTKITNDMFSGLSNLHHLILNNNQLTLISSTAFDDVFALEELDLSYNNLETIPWDAVEKMVSLHTLSLDHNMIDNIPKGTFSHLHKMTRLDVTSNKLQKLPPDPLFQRAQVLATSGIISPSTFALSFGGNPLHCNCELLWLRRLSREDDLETCASPPLLTGRYFWSIPEEEFLCEPPLITRHTHEMRVLEGQRATLRCKARGDPEPAIHWISPEGKLISNATRSLVYDNGTLDILITTVKDTGAFTCIASNPAGEATQIVDLHIIKLPHLLNSTNHIHEPDPGSSDISTSTKSGSNTSSSNGDTKLSQDKIVVAEATSSTALLKFNFQRNIPGIRMFQIQYNGTYDDTLVYRGWS

SEQ ID NO: 8003 - protein, 347 aa, Homo Sapiens
MSSWSRQRPKSPGGIQPHVSRTLFLLLLLAASAWGVTLSPKDCQVFRSDHGSSISCQPPAEIPGYLPADTVHLAVEFFNLTHLPANLLQGASKLQELHLSSNGLESLSPEFLRPVPQLRVLDLTRNALTGLPPGLFQASATLDTLVLKENQLEVLEVSWLHGLKALGHLDLSGNRLRKLPPGLLANFTLLRTLDLGENQLETLPPDLLRGPLQLERLHLEGNKLQVLGKDLLLPQPDLRYLFLNGNKLARVAAGAFQGLRQLDMLDLSNNSLASVPEGLWASLGQPNWDMRDGFDISGNPWICDQNLSDLYRWLQAQKDKMFSQNDTRCAGPEAVKGQTLLAVAKSQ

SEQ ID NO: 8004 - protein, 4544 aa, Homo Sapiens
MLTPPLLLLLPLLSALVAAAIDAPKTCSPKQFACRDQITCISKGWRCDGERDCPDGSDEAPEICPQSKAQRCQPNEHNCLGTELCVPMSRLCNGVQDCMDGSDEGPHCRELQGNCSRLGCQHHCVPTLDGPTCYCNSSFQLQADGKTCKDFDECSVYGTCSQLCTNTDGSFICGCVEGYLLQPDNRSCKAKNEPVDRPPVLLIANSQNILATYLSGAQVSTITPTSTRQTTAMDFSYANETVCWVHVGDSAAQTQLKCARMPGLKGFVDEHTINISLSLHHVEQMAIDWLTGNFYFVDDIDDRIFVCNRNGDTCVTLLDLELYNPKGIALDPAMGKVFFTDYGQIPKVERCDMDGQNRTKLVDSKIVFPHGITLDLVSRLVYWADAYLDYIEVVDYEGKGRQTIIQGILIEHLYGLTVFENYLYATNSDNANAQQKTSVIRVNRFNSTEYQVVTRVDKGGALHIYHQRRQPRVRSHACENDQYGKPGGCSDICLLANSHKARTCRCRSGFSLGSDGKSCKKPEHELFLVYGKGRPGIIRGMDMGAKVPDEHMIPIENLMNPRALDFHAETGFIYFADTTSYLIGRQKIDGTERETILKDGIHNVEGVAVDWMGDNLYWTDDGPKKTISVARLEKAAQTRKTLIEGKMTHPRAIVVDPLNGWMYWTDWEEDPKDSRRGRLERAWMDGSHRDIFVTSKTVLWPNGLSLDIPAGRLYWVDAFYDRIETILLNGTDRKIVYEGPELNHAFGLCHHGNYLFWTEYRSGSVYRLERGVGGAPPTVTLLRSERPPIFEIRMYDAQQQQVGTNKCRVNNGGCSSLCLATPGSRQCACAEDQVLDADGVTCLANPSYVPPPQCQPGEFACANSRCIQERWKCDGDNDCLDNSDEAPALCHQHTCPSDRFKCENNRCIPNRWLCDGDNDCGNSEDESNATCSARTCPPNQFSCASGRCIPISWTCDLDDDCGDRSDESASCAYPTCFPLTQFTCNNGRCININWRCDNDNDCGDNSDEAGCSHSCSSTQFKCNSGRCIPEHWTCDGDNDCGDYSDETHANCTNQATRPPGGCHTDEFQCRLDGLCIPLRWRCDGDTDCMDSSDEKSCEGVTHVCDPSVKFGCKDSARCISKAWVCDGDNDCEDNSDEENCESLACRPPSHPCANNTSVCLPPDKLCDGNDDCGDGSDEGELCDQCSLNNGGCSHNCSVAPGEGIVCSCPLGMELGPDNHTCQIQSYCAKHLKCSQKCDQNKFSVKCSCYEGWVLEPDGESCRSLDPFKPFIIFSNRHEIRRIDLHKGDYSVLVPGLRNTIALDFHLSQSALYWTDVVEDKIYRGKLLDNGALTSFEVVIQYGLATPEGLAVDWIAGNIYWVESNLDQIEVAKLDGTLRTTLLAGDIEHPRAIALDPRDGILFWTDWDASLPRIEAASMSGAGRRTVHRETGSGGWPNGLTVDYLEKRILWIDARSDAIYSARYDGSGHMEVLRGHEFLSHPFAVTLYGGEVYWTDWRTNTLAKANKWTGHNVTVVQRTNTQPFDLQVYHPSRQPMAPNPCEANGGQGPCSHLCLINYNRTVSCACPHLMKLHKDNTTCYEFKKFLLYARQMEIRGVDLDAPYYNYIISFTVPDIDNVTVLDYDAREQRVYWSDVRTQAIKRAFINGTGVETVVSADLPNAHGLAVDWVSRNLFWTSYDTNKKQINVARLDGSFKNAVVQGLEQPHGLVVHPLRGKLYWTDGDNISMANMDGSNRTLLFSGQKGPVGLAIDFPESKLYWISSGNHTINRCNLDGSGLEVIDAMRSQLGKATALAIMGDKLWWADQVSEKMGTCSKADGSGSVVLRNSTTLVMHMKVYDESIQLDHKGTNPCSVNNGDCSQLCLPTSETTRSCMCTAGYSLRSGQQACEGVGSFLLYSVHEGIRGIPLDPNDKSDALVPVSGTSLAVGIDFHAENDTIYWVDMGLSTISRAKRDQTWREDVVTNGIGRVEGIAVDWIAGNIYWTDQGFDVIEVARLNGSFRYVVISQGLDKPRAITVHPEKGYLFWTEWGQYPRIERSRLDGTERVVLVNVSISWPNGISVDYQDGKLYWCDARTDKIERIDLETGENREVVLSSNNMDMFSVSVFEDFIYWSDRTHANGSIKRGSKDNATDSVPLRTGIGVQLKDIKVFNRDRQKGTNVCAVANGGCQQLCLYRGRGQRACACAHGMLAEDGASCREYAGYLLYSERTILKSIHLSDERNLNAPVQPFEDPEHMKNVIALAFDYRAGTSPGTPNRIFFSDIHFGNIQQINDDGSRRITIVENVGSVEGLAYHRGWDTLYWTSYTTSTITRHTVDQTRPGAFERETVITMSGDDHPRAFVLDECQNLMFWTNWNEQHPSIMRAALSGANVLTLIEKDIRTPNGLAIDHRAEKLYFSDATLDKIERCEYDGSHRYVILKSEPVHPFGLAVYGEHIFWTDWVRRAVQRANKHVGSNMKLLRVDIPQQPMGIIAVANDTNSCELSPCRINNGGCQDLCLLTHQGHVNCSCRGGRILQDDLTCRAVNSSCRAQDEFECANGECINFSLTCDGVPHCKDKSDEKPSYCNSRRCKKTFRQCSNGRCVSNMLWCNGADDCGDGSDEIPCNKTACGVGEFRCRDGTCIGNSSRCNQFVDCEDASDEMNCSATDCSSYFRLGVKGVLFQPCERTSLCYAPSWVCDGANDCGDYSDERDCPGVKRPRCPLNYFACPSGRCIPMSWTCDKEDDCEHGEDETHCNKFCSEAQFECQNHRCISKQWLCDGSDDCGDGSDEAAHCEGKTCGPSSFSCPGTHVCVPERWLCDGDKDCADGADESIAAGCLYNSTCDDREFMCQNRQCIPKHFVCDHDRDCADGSDESPECEYPTCGPSEFRCANGRCLSSRQWECDGENDCHDQSDEAPKNPHCTSQEHKCNASSQFLCSSGRCVAEALLCNGQDDCGDSSDERGCHINECLSRKLSGCSQDCEDLKIGFKCRCRPGFRLKDDGRTCADVDECSTTFPCSQRCINTHGSYKCLCVEGYAPRGGDPHSCKAVTDEEPFLIFANRYYLRKLNLDGSNYTLLKQGLNNAVALDFDYREQMIYWTDVTTQGSMIRRMHLNGSNVQVLHRTGLSNPDGLAVDWVGGNLYWCDKGRDTIEVSKLNGAYRTVLVSSGLREPRALVVDVQNGYLYWTDWGDHSLIGRIGMDGSSRSVIVDTKITWPNGLTLDYVTERIYWADAREDYIEFASLDGSNRHVVLSQDIPHIFALTLFEDYVYWTDWETKSINRAHKTTGTNKTLLISTLHRPMDLHVFHALRQPDVPNHPCKVNNGGCSNLCLLSPGGGHKCACPTNFYLGSDGRTCVSNCTASQFVCKNDKCIPFWWKCDTEDDCGDHSDEPPDCPEFKCRPGQFQCSTGICTNPAFICDGDNDCQDNSDEANCDIHVCLPSQFKCTNTNRCIPGIFRCNGQDNCGDGEDERDCPEVTCAPNQFQCSITKRCIPRVWVCDRDNDCVDGSDEPANCTQMTCGVDEFRCKDSGRCIPARWKCDGEDDCGDGSDEPKEECDERTCEPYQFRCKNNRCVPGRWQCDYDNDCGDNSDEESCTPRPCSESEFSCANGRCIAGRWKCDGDHDCADGSDEKDCTPRCDMDQFQCKSGHCIPLRWRCDADADCMDGSDEEACGTGVRTCPLDEFQCNNTLCKPLAWKCDGEDDCGDNSDENPEECARFVCPPNRPFRCKNDRVCLWIGRQCDGTDNCGDGTDEEDCEPPTAHTTHCKDKKEFLCRNQRCLSSSLRCNMFDDCGDGSDEEDCSIDPKLTSCATNASICGDEARCVRTEKAAYCACRSGFHTVPGQPGCQDINECLRFGTCSQLCNNTKGGHLCSCARNFMKTHNTCKAEGSEYQVLYIADDNEIRSLFPGHPHSAYEQAFQGDESVRIDAMDVHVKAGRVYWTNWHTGTISYRSLPPAAPPTTSNRHRRQIDRGVTHLNISGLKMPRGIAIDWVAGNVYWTDSGRDVIEVAQMKGENRKTLISGMIDEPHAIVVDPLRGTMYWSDWGNHPKIETAAMDGTLRETLVQDNIQWPTGLAVDYHNERLYWADAKLSVIGSIRLNGTDPIVAADSKRGLSHPFSIDVFEDYIYGVTYINNRVFKIHKFGHSPLVNLTGGLSHASDVVLYHQHKQPEVTNPCDRKKCEWLCLLSPSGPVCTCPNGKRLDNGTCVPVPSPTPPPDAPRPGTCNLQCFNGGSCFLNARRQPKCRCQPRYTGDKCELDQCWEHCRNGGTCAASPSGMPTCRCPTGFTGPKCTQQVCAGYCANNSTCTVNQGNQPQCRCLPGFLGDRCQYRQCSGYCENFGTCQMAADGSRQCRCTAYFEGSRCEVNKCSRCLEGACVVNKQSGDVTCNCTDGRVAPSCLTCVGHCSNGGSCTMNSKMMPECQCPPHMTGPRCEEHVFSQQQPGHIASILIPLLLLLLLVLVAGVVFWYKRRVQGAKGFQHQRMTNGAMNVEIGNPTYKMYEGGEPDDVGGLLDADFALDPDKPTNFTNPVYATLYMGGHGSRHSLASTDEKRELLGRGPEDEIGDPLA

SEQ ID NO: 8005 - protein, 292 aa, Homo Sapiens
MLTPPLLLLLPLLSALVAAAIDAPKTCSPKQFACRDQITCISKGWRCDGERDCPDGSDEAPEICPQSKAQRCQPNEHNCLGTELCVPMSRLCNGVQDCMDGSDEGPHCRELQGNCSRLGCQHHCVPTLDGPTCYCNSSFQLQADGKTCKDFDECSVYGTCSQLCTNTDGSFICGCVEGYLLQPDNRSCKAKNEPVDRPPVLLIANSQNILATYLSGAQVSTITPTSTRQTTAMDFSYANETVCWVHVGDSAAQTQLKCARMPGLKGFVDEHTINISLSLHLCVFSKSQQEMG

SEQ ID NO: 8006 - protein, 296 aa, Homo Sapiens
MLTPPLLLLLPLLSALVAAAIDAPKTCSPKQFACRDQITCISKGWRCDGERDCPDGSDEAPEICPQSKAQRCQPNEHNCLGTELCVPMSRLCNGVQDCMDGSDEGPHCRELQGNCSRLGCQHHCVPTLDGPTCYCNSSFQLQADGKTCKDFDECSVYGTCSQLCTNTDGSFICGCVEGYLLQPDNRSCKAKNEPVDRPPVLLIANSQNILATYLSGAQVSTITPTSTRQTTAMDFSYANETVCWVHVGDSAAQTQLKCARMPGLKGFVDEHTINISLSLHRRSRKRAQENEVTQHG

SEQ ID NO: 8007 - protein, 439 aa, Homo Sapiens
MLTPPLLLLLPLLSALVAAAIDAPKTCSPKQFACRDQITCISKGWRCDGERDCPDGSDEAPEICPQSKAQRCQPNEHNCLGTELCVPMSRLCNGVQDCMDGSDEGPHCRELQGNCSRLGCQHHCVPTLDGPTCYCNSSFQLQADGKTCKDFDECSVYGTCSQLCTNTDGSFICGCVEGYLLQPDNRSCKAKNEPVDRPPVLLIANSQNILATYLSGAQVSTITPTSTRQTTAMDFSYANETVCWVHVGDSAAQTQLKCARMPGLKGFVDEHTINISLSLHHVEQMAIDWLTGNFYFVDDIDDRIFVCNRNGDTCVTLLDLELYNPKGIALDPAMGKVFFTDYGQIPKVERCDMDGQNRTKLVDSKIVFPHGITLDLVSRLVYWADAYLDYIEVVDYEGKGRQTIIQGILVRELLSEVLWGNHDPGPSGEGGSLCRGTVL

SEQ ID NO: 8008 - protein, 183 aa, Homo Sapiens
NGQDNCGDGEDERDCPEVTCAPNQFQCSITKRCIPRVWVCDRDNDCVDGSDEPANCTQMTCGVDEFRCKDSGRCIPARWKCDGEDDCGDGSDEPKEECGEPRPHSRRKTVYLDERTCEPYQFRCKNNRCVPGRWQCDYDNDCGDNSDEESCTPRPCSESEFSCANGRCIAGRWKCDGDHDCAD

SEQ ID NO: 8009 - protein, 139 aa, Homo Sapiens
  misc_feature (1)..(1): Xaa can be any naturally occurring amino acid
XRPGAFERETVITMSGDDHPRAFVLDECQNLMFWTNWNEQHPSIMRAALSGANVLTLIEKDIRTPNGLAIDHRAEKLYFSDATLDKIERCEYDGSHRYVNSLHAESTTVAARTCVCSLTRAMSTAHAEGAESSRMTSPA

SEQ ID NO: 8010 - protein, 500 aa, Homo Sapiens
MASVAQESAGSQRRLPPRHGALRGLLLLCLWLPSGRAALPPAAPLSELHAQLSGVEQLLEEFRRQLQQERPQEELELELRAGGGPQEDCPGPGSGGYSAMPDAIIRTKDSLAAGASFLRAPAAVRGWRQCVAACCSEPRCSVAVVELPRRPAPPAAVLGCYLFNCTARGRNVCKFALHSGYSSYSLSRAPDGAALATARASPRQEKDAPPLSKAGQDVVLHLPTDGVVLDGRESTDDHAIVQYEWALLQGDPSVDMKVPQSGTLKLSHLQEGTYTFQLTVTDTAGQRSSDNVSVTVLRAAYSTGGCLHTCSRYHFFCDDGCCIDITLACDGVQQCPDGSDEDFCQNLGLDRKMVTHTAASPALPRTTGPSEDAGGDSLVEKSQKATAPNKPPALSNTEKRNHSAFWGPESQIIPVMPDSSSSGKNRKEESYIFESKGDGGGGEHPAPETGAVLPLALGLAITALLLLMVACRLRLVKQKLKKARPITSEESDYLINGMYL

SEQ ID NO: 8011 - protein, 325 aa, Homo Sapiens
MASVAQESAGSQRRLPPRHGALRGLLLLCLWLPSGRAALPPAAPLSELHAQLSGVEQLLEEFRRQLQQERPQEELELELRAGGGPQEDCPGPGSGGYSAMPDAIIRTKDSLAAGASFLRAPAAVRGWRQCVAACCSEPRCSVAVVELPRRPAPPAAVLGCYLFNCTARGRNVCKFALHSGYSSYSLSRAPDGAALATARASPRQEKDAPPLSKAGQDVVLHLPTDGVVLDGRESTDDHAIVQYEWALLQGDPSVDMKVPQSGTLKLSHLQEGTYTFQLTVTDTAGQRSSDNVSVTVLRAAYSTGDGWSICCICSKREAKEFSETS

SEQ ID NO: 8012 - protein, 4599 aa, Homo Sapiens
MSEFLLALLTLSGLLPIARVLTVGADRDQQLCDPGEFLCHDHVTCVSQSWLCDGDPDCPDDSDESLDTCPEEVEIKCPLNHIACLGTNKCVHLSQLCNGVLDCPDGYDEGVHCQELLSNCQQLNCQYKCTMVRNSTRCYCEDGFEITEDGRSCKDQDECAVYGTCSQTCRNTHGSYTCSCVEGYLMQPDNRSCKAKIEPTDRPPILLIANFETIEVFYLNGSKMATLSSVNGNEIHTLDFIYNEDMICWIESRESSNQLKCIQITKAGGLTDEWTINILQSFHNVQQMAIDWLTRNLYFVDHVGDRIFVCNSNGSVCVTLIDLELHNPKAIAVDPIAGKLFFTDYGNVAKVERCDMDGMNRTRIIDSKTEQPAALALDLVNKLVYWVDLYLDYVGVVDYQGKNRHTVIQGRQVRHLYGITVFEDYLYATNSDNYNIVRINRFNGTDIHSLIKIENAWGIRIYQKRTQPTVRSHACEVDPYGMPGGCSHICLLSSSYKTRTCRCRTGFNLGSDGRSCKRPKNELFLFYGKGRPGIVRGMDLNTKIADEYMIPIENLVNPRALDFHAETNYIYFADTTSFLIGRQKIDGTERETILKDDLDNVEGIAVDWIGNNLYWTNDGHRKTINVARLEKASQSRKTLLEGEMSHPRGIVVDPVNGWMYWTDWEEDEIDDSVGRIEKAWMDGFNRQIFVTSKMLWPNGLTLDFHTNTLYWCDAYYDHIEKVFLNGTHRKIVYSGRELNHPFGLSHHGNYVFWTDYMNGSIFQLDLITSEVTLLRHERPPLFGLQIYDPRKQQGDNMCRVNNGGCSTLCLAIPGGRVCACADNQLLDENGTTCTFNPGEALPHICKAGEFRCKNRHCIQARWKCDGDDDCLDGSDEDSVNCFNHSCPDDQFKCQNNRCIPKRWLCDGANDCGSNEDESNQTCTARTCQVDQFSCGNGRCIPRAWLCDREDDCGDQTDEMASCEFPTCEPLTQFVCKSGRCISSKWHCDSDDDCGDGSDEVGCVHSCFDNQFRCSSGRCIPGHWACDGDNDCGDFSDEAQINCTKEEIHSPAGCNGNEFQCHPDGNCVPDLWRCDGEKDCEDGSDEKGCNGTIRLCDHKTKFSCWSTGRCINKAWVCDGDIDCEDQSDEDDCDSFLCGPPKHPCANDTSVCLQPEKLCNGKKDCPDGSDEGYLCDECSLNNGGCSNHCSVVPGRGIVCSCPEGLQLNKDNKTCEIVDYCSNHLKCSQVCEQHKHTVKCSCYEGWKLDVDGESCTSVDPFEAFIIFSIRHEIRRIDLHKRDYSLLVPGLRNTIALDFHFNQSLLYWTDVVEDRIYRGKLSESGGVSAIEVVVEHGLATPEGLTVDWIAGNIYWIDSNLDQIEVAKLDGSLRTTLIAGAMEHPRAIALDPRYGILFWTDWDANFPRIESASMSGAGRKTIYKDMKTGAWPNGLTVDHFEKRIVWTDARSDAIYSALYDGTNMIEIIRGHEYLSHPFAVSLYGSEVYWTDWRTNTLSKANKWTGQNVSVIQKTSAQPFDLQIYHPSRQPQAPNPCAANDGKGPCSHMCLINHNRSAACACPHLMKLSSDKKTCYEMKKFLLYARRSEIRGVDIDNPYFNFITAFTVPDIDDVTVIDFDASEERLYWTDIKTQTIKRAFINGTGLETVISRDIQSIRGLAVDWVSRNLYWISSEFDETQINVARLDGSLKTSIIHGIDKPQCLAAHPVRGKLYWTDGNTINMANMDGSNSKILFQNQKEPVGLSIDYVENKLYWISSGNGTINRCNLDGGNLEVIESMKEELTKATALTIMDKKLWWADQNLAQLGTCSKRDGRNPTILRNKTSGVVHMKVYDKEAQQGSNSCQLNNGGCSQLCLPTSETTRTCMCTVGYYLQKNRMSCQGIESFLMYSVHEGIRGIPLEPSDKMDALMPISGTSFAVGIDFHAENDTIYWTDMGFNKISRAKRDQTWKEDIITNGLGRVEGIAVDWIAGNIYWTDHGFNLIEVARLNGSFRYVIISQGLDQPRSIAVHPEKGLLFWTEWGQMPCIGKARLDGSEKVVLVSMGIAWPNGISIDYEENKLYWCDARTDKIERIDLETGGNREMVLSGSNVDMFSVAVFGAYIYWSDRAHANGSVRRGHKNDATETITMRTGLGVNLKEVKIFNRVREKGTNVCARDNGGCKQLCLYRGNSRRTCACAHGYLAEDGVTCLRHEGYLLYSGRTILKSIHLSDETNLNSPIRPYENPRYFKNVIALAFDYNQRRKGTNRIFYSDAHFGNIQLIKDNWEDRQVIVENVGSVEGLAYHRAWDTLYWTSSTTSSITRHTVDQTRPGAFDREAVITMSEDDHPHVLALDECQNLMFWTNWNEQHPSIMRSTLTGKNAQVVVSTDILTPNGLTIDYRAEKLYFSDGSLGKIERCEYDGSQRHVIVKSGPGTFLSLAVYDNYIFWSDWGRRAILRSNKYTGGDTKILRSDIPHQPMGIIAVANDTNSCELSPCALLNGGCHDLCLLTPNGRVNCSCRGDRILLEDNRCVTKNSSCNAYSEFECGNGECIDYQLTCDGIPHCKDKSDEKLLYCENRSCRRGFKPCYNRRCIPHGKLCDGENDCGDNSDELDCKVSTCATVEFRCADGTCIPRSARCNQNIDCADASDEKNCNNTDCTHFYKLGVKTTGFIRCNSTSLCVLPTWICDGSNDCGDYSDELKCPVQNKHKCEENYFSCPSGRCILNTWICDGQKDCEDGRDEFHCDSSCSWNQFACSAQKCISKHWICDGEDDCGDGLDESDSICGAITCAADMFSCQGSRACVPRHWLCDGERDCPDGSDELSTAGCAPNNTCDENAFMCHNKVCIPKQFVCDHDDDCGDGSDESPQCGYRQCGTEEFSCADGRCLLNTQWQCDGDFDCPDHSDEAPLNPKCKSAEQSCNSSFFMCKNGRCIPSGGLCDNKDDCGDGSDERNCHINECLSKKVSGCSQDCQDLPVSYKCKCWPGFQLKDDGKTCVDIDECSSGFPCSQQCINTYGTYKCLCTDGYEIQPDNPNGCKSLSDEEPFLILADHHEIRKISTDGSNYTLLKQGLNNVIAIDFDYREEFIYWIDSSRPNGSRINRMCLNGSDIKVVHNTAVPNALAVDWIGKNLYWSDTEKRIIEVSKLNGLYPTILVSKRLKFPRDLSLDPQAGYLYWIDCCEYPHIGRVGMDGTNQSVVIETKISRPMALTIDYVNRRLYWADENHIEFSNMDGSHRHKVPNQDIPGVIALTLFEDYIYWTDGKTKSLSRAHKTSGADRLSLIYSWHAITDIQVYHSYRQPDVSKHLCMINNGGCSHLCLLAPGKTHTCACPTNFYLAADNRTCLSNCTASQFRCKTDKCIPFWWKCDTVDDCGDGSDEPDDCPEFRCQPGRFQCGTGLCALPAFICDGENDCGDNSDELNCDTHVCLSGQFKCTKNQKCIPVNLRCNGQDDCGDEEDERDCPENSCSPDYFQCKTTKHCISKLWVCDEDPDCADASDEANCDKKTCGPHEFQCKNNNCIPDHWRCDSQNDCSDNSDEENCKPQTCTLKDFLCANGDCVSSRFWCDGDFDCADGSDERNCETSCSKDQFRCSNGQCIPAKWKCDGHEDCKYGEDEKSCEPASPTCSSREYICASDGCISASLKCNGEYDCADGSDEMDCVTECKEDQFRCKNKAHCIPIRWLCDGIHDCVDGSDEENCERGGNICRADEFLCNNSLCKLHFWVCDGEDDCGDNSDEAPDMCVKFLCPSTRPHRCRNNRICLQSEQMCNGIDECGDNSDEDHCGGKLTYKARPCKKDEFACSNKKCIPMDLQCDRLDDCGDGSDEQGCRIAPTEYTCEDNVNPCGDDAYCNQIKTSVFCRCKPGFQRNMKNRQCEDLNECLVFGTCSHQCINVEGSYKCVCDQNFQERNNTCIAEGSEDQVLYIANDTDILGFIYPFNYSGDHQQISHIEHNSRITGMDVYYQRDMIIWSTQFNPGGIFYKRIHGREKRQANSGLICPEFKRPRDIAVDWVAGNIYWTDHSRMHWFSYYTTHWTSLRYSINVGQLNGPNCTRLLTNMAGEPYAIAVNPKRGMMYWTVVGDHSHIEEAAMDGTLRRILVQKNLQRPTGLAVDYFSERIYWADFELSIIGSVLYDGSNSVVSVSSKQGLLHPHRIDIFEDYIYGAGPKNGVFRVQKFGHGSVEYLALNIDKTKGVLISHRYKQLDLPNPCLDLACEFLCLLNPSGATCVCPEGKYLINGTCNDDSLLDDSCKLTCENGGRCILNEKGDLRCHCWPSYSGERCEVNHCSNYCQNGGTCVPSVLGRPTCSCALGFTGPNCGKTVCEDFCQNGGTCIVTAGNQPYCHCQPEYTGDRCQYYVCHHYCVNSESCTIGDDGSVECVCPTRYEGPKCEVDKCVRCHGGHCIINKDSEDIFCNCTNGKIASSCQLCDGYCYNGGTCQLDPETNVPVCLCSTNWSGTQCERPAPKSSKSDHISTRSIAIIVPLVLLVTLITTLVIGLVLCKRKRRTKTIRRQPIINGGINVEIGNPSYNMYEVDHDHNDGGLLDPGFMIDPTKARYIGGGPSAFKLPHTAPPIYLNSDLKGPLTAGPTNYSNPVYAKLYMDGQNCRNSLGSVDERKELLPKKIEIGIRETVA

SEQ ID NO: 8013 - protein, 782 aa, Homo Sapiens [sequence omitted]

SEQ ID NO: 8014 - protein, 280 aa, Homo Sapiens
  misc_feature (1)..(1): Xaa can be any naturally occurring amino acid
XRPTCSCALGFTGPNCGKTVCEDFCQNGGTCIVTAGNQPYCHCQPEYTGDRCQYYVCHHYCVNSESCTIGDDGSVECVCPTRYEGPKCEVDKCVRCHGGHCIINKDSEDIFCNCTNGKIASSCQLCDGYCYNGGTCQLDPETNVPVCLCSVGFKSQRCDQKENPCDHYCQNEGICTLTAFNEPRCKCSTNWSGTQCERPAPKSSKSDHISTRSIAIIVPLVLLVTLITTLVIGLVLCKRKRRTKTIRRQPIINGGINVEIGNPSYNMYEVDHDHNDGGLL

SEQ ID NO: 8015 - protein, 798 aa, Homo Sapiens
  misc_feature (1)..(1): Xaa can be any naturally occurring amino acid
XSNKKCIPMDLQCDRLDDCGDGSDEQGCRIAPTEYTCEDNVNPCGDDAYCNQIKTSVFCRCKPGFQRNMKNRQCEDLNECLVFGTCSHQCINVEGSYKCVCDQNFQERNNTCIAEGSEDQVLYIANDTDILGFIYPFNYSGDHQQISHIEHNSRITGMDVYYQRDMIIWSTQFNPGGIFYKRIHGREKRQANSGLICPEFKRPRDIAVDWVAGNIYWTDHSRMHWFSYYTTHWTSLRYSINVGQLNGPNCTRLLTNMAGEPYAIAVNPKRGMMYWTVVGDHSHIEEAAMDGTLRRILVQKNLQRPTGLAVDYFSERIYWADFELSIIGSVLYDGSNSVVSVSSKQGLLHPHRIDIFEDYIYGAGPKNGVFRVQKFGHGSVEYLALNIDKTKGVLISHRYKQLDLPNPCLDLACEFLCLLNPSGATCVCPEGKYLINGTCNDDSLLDDSCKLTCENGGRCILNEKGDLRCHCWPSYSGERCEVNHCSNYCQNGGTCVPSVLGRPTCSCALGFTGPNCGKTVCEDFCQNGGTCIVTAGNQPYCHCQPEYTGDRCQYYVCHHYCVNSESCTIGDDGSVECVCPTRYEGPKCEVDKCVRCHGGHCIINKDSEDIFCNCTNGKIASSCQLCDGYCYNGGTCQLDPETNVPVCLCSTNWSGTQCERPAPKSSKSDHISTRSIAIIVPLVLLVTLITTLVIGLVLCKRKRRTKTIRRQPIINGGINVEIGNPSYNMYEVDHDHNDGGLLDPGFMIDPTKPTNYSNPVYAKLYMDGQNCRNSLGSVDERKELLPKKIEIGIRETVA

SEQ ID NO: 8016 - protein, 4655 aa, Homo Sapiens
MDRGPAAVACTLLLALVACLAPASGQECDSAHFRCGSGHCIPADWRCDGTKDCSDDADEIGCAVVTCQQGYFKCQSEGQCIPNSWVCDQDQDCDDGSDERQDCSQSTCSSHQITCSNGQCIPSEYRCDHVRDCPDGADENDCQYPTCEQLTCDNGACYNTSQKCDWKVDCRDSSDEINCTEICLHNEFSCGNGECIPRAYVCDHDNDCQDGSDEHACNYPTCGGYQFTCPSGRCIYQNWVCDGEDDCKDNGDEDGCESGPHDVHKCSPREWSCPESGRCISIYKVCDGILDCPGREDENNTSTGKYCSMTLCSALNCQYQCHETPYGGACFCPPGYIINHNDSRTCVEFDDCQIWGICDQKCESRPGRHLCHCEEGYILERGQYCKANDSFGEASIIFSNGRDLLIGDIHGRSFRILVESQNRGVAVGVAFHYHLQRVFWTDTVQNKVFSVDINGLNIQEVLNVSVETPENLAVDWVNNKIYLVETKVNRIDMVNLDGSYRVTLITENLGHPRGIAVDPTVGYLFFSDWESLSGEPKLERAFMDGSNRKDLVKTKLGWPAGVTLDMISKRVYWVDSRFDYIETVTYDGIQRKTVVHGGSLIPHPFGVSLFEGQVFFTDWTKMAVLKANKFTETNPQVYYQASLRPYGVTVYHSLRQPYATNPCKDNNGGCEQVCVLSHRTDNDGLGFRCKCTFGFQLDTDERHCIAVQNFLIFSSQVAIRGIPFTLSTQEDVMVPVSGNPSFFVGIDFDAQDSTIFFSDMSKHMIFKQKIDGTGREILAANRVENVESLAFDWISKNLYWTDSHYKSISVMRLADKTRRTVVQYLNNPRSVVVHPFAGYLFFTDWFRPAKIMRAWSDGSHLLPVINTTLGWPNGLAIDWAASRLYWVDAYFDKIEHSTFDGLDRRRLGHIEQMTHPFGLAIFGEHLFFTDWRLGAIIRVRKADGGEMTVIRSGIAYILHLKSYDVNIQTGSNACNQPTHPNGDCSHFCFPVPNFQRVCGCPYGMRLASNHLTCEGDPTNEPPTEQCGLFSFPCKNGRCVPNYYLCDGVDDCHDNSDEQLCGTLNNTCSSSAFTCGHGECIPAHWRCDKRNDCVDGSDEHNCPTHAPASCLDTQYTCDNHQCISKNWVCDTDNDCGDGSDEKNCNSTETCQPSQFNCPNHRCIDLSFVCDGDKDCVDGSDEVGCVLNCTASQFKCASGDKCIGVTNRCDGVFDCSDNSDEAGCPTRPPGMCHSDEFQCQEDGICIPNFWECDGHPDCLYGSDEHNACVPKTCPSSYFHCDNGNCIHRAWLCDRDNDCGDMSDEKDCPTQPFRCPSWQWQCLGHNICVNLSVVCDGIFDCPNGTDESPLCNGNSCSDFNGGCTHECVQEPFGAKCLCPLGFLLANDSKTCEDIDECDILGSCSQHCYNMRGSFRCSCDTGYMLESDGRTCKVTASESLLLLVASQNKIIADSVTSQVHNIYSLVENGSYIVAVDFDSISGRIFWSDATQGKTWSAFQNGTDRRVVFDSSIILTETIAIDWVGRNLYWTDYALETIEVSKIDGSHRTVLISKNLTNPRGLALDPRMNEHLLFWSDWGHHPRIERASMDGSMRTVIVQDKIFWPCGLTIDYPNRLLYFMDSYLDYMDFCDYNGHHRRQVIASDLIIRHPYALTLFEDSVYWTDRATRRVMRANKWHGGNQSVVMYNIQWPLGIVAVHPSKQPNSVNPCAFSRCSHLCLLSSQGPHFYSCVCPSGWSLSPDLLNCLRDDQPFLITVRQHIIFGISLNPEVKSNDAMVPIAGIQNGLDVEFDDAEQYIYWVENPGEIHRVKTDGTNRTVFASISMVGPSMNLALDWISRNLYSTNPRTQSIEVLTLHGDIRYRKTLIANDGTALGVGFPIGITVDPARGKLYWSDQGTDSGVPAKIASANMDGTSVKTLFTGNLEHLECVTLDIEEQKLYWAVTGRGVIERGNVDGTDRMILVHQLSHPWGIAVHDSFLYYTDEQYEVIERVDKATGANKIVLRDNVPNLRGLQVYHRRNAAESSNGCSNNMNACQQICLPVPGGLFSCACATGFKLNPDNRSCSPYNSFIVVSMLSAIRGFSLELSDHSETMVPVAGQGRNALHVDVDVSSGFIYWCDFSSSVASDNAIRRIKPDGSSLMNIVTHGIGENGVRGIAVDWVAGNLYFTNAFVSETLIEVLRINTTYRRVLLKVTVDMPRHIVVDPKNRYLFWADYGQRPKIERSFLDCTNRTVLVSEGIVTPRGLAVDRSDGYVYWVDDSLDIIARIRINGENSEVIRYGSRYPTPYGITVFENSIIWVDRNLKKIFQASKEPENTEPPTVIRDNINWLRDVTIFDKQVQPRSPAEVNNNPCLENNGGCSHLCFALPGLHTPKCDCAFGTLQSDGKNCAISTENFLIFALSNSLRSLHLDPENHSPPFQTINVERTVMSLDYDSVSDRIYFTQNLASGVGQISYATLSSGIHTPTVIASGIGTADGIAFDWITRRIYYSDYLNQMINSMAEDGSNRTVIARVPKPRAIVLDPCQGYLYWADWDTHAKIERATLGGNFRVPIVNSSLVMPSGLTLDYEEDLLYWVDASLQRIERSTLTGVDREVIVNAAVHAFGLTLYGQYIYWTDLYTQRIYRANKYDGSGQIAMTTNLLSQPRGINTVVKNQKQQCNNPCEQFNGGCSHICAPGPNGAECQCPHEGNWYLANNRKHCIVDNGERCGASSFTCSNGRCISEEWKCDNDNDCGDGSDEMESVCALHTCSPTAFTCANGRCVQYSYRCDYYNDCGDGSDEAGCLFRDCNATTEFMCNNRRCIPREFICNGVDNCHDNNTSDEKNCPDRTCQSGYTKCHNSNICIPRVYLCDGDNDCGDNSDENPTYCTTHTCSSSEFQCASGRCIPQHWYCDQETDCFDASDEPASCGHSERTCLADEFKCDGGRCIPSEWICDGDNDCGDMSDEDKRHQCQNQNCSDSEFLCVNDRPPDRRCIPQSWVCDGDVDCTDGYDENQNCTRRTCSENEFTCGYGLCIPKIFRCDRHNDCGDYSDERGCLYQTCQQNQFTCQNGRCISKTFVCDEDNDCGDGSDELMHLCHTPEPTCPPHEFKCDNGRCIEMMKLCNHLDDCLDNSDEKGCGINECHDPSISGCDHNCTDTLTSFYCSCRPGYKLMSDKRTCVDIDECTEMPFVCSQKCENVIGSYICKCAPGYLREPDGKTCRQNSNIEPYLIFSNRYYLRNLTIDGYFYSLILEGLDNVVALDFDRVEKRLYWIDTQRQVIERMFLNKTNKETIINHRLPAAESLAVDWVSRKLYWLDARLDGLFVSDLNGGHRRMLAQHCVDANNTFCFDNPRGLALHPQYGYLYWADWGHRAYIGRVGMDGTNKSVIISTKLEWPNGITIDYTNDLLYWADAHLGYIEYSDLEGHHRHTVYDGALPHPFAITIFEDTIYWTDWNTRTVEKGNKYDGSNRQTLVNTTHRPFDIHVYHPYRQPIVSNPCGTNNGGCSHLCLIKPGGKGFTCECPDDFRTLQLSGSTYCMPMCSSTQFLCANNEKCIPIWWKCDGQKDCSDGSDELALCPQRFCRLGQFQCSDGNCTSPQTLCNAHQNCPDGSDEDRLLCENHHCDSNEWQCANKRCIPESWQCDTFNDCEDNSDEDSSHCASRTCRPGQFRCANGRCIPQAWKCDVDNDCGDHSDEPIEECMSSAHLCDNFTEFSCKTNYRCIPKWAVCNGVDDCRDNSDEQGCEERTCHPVGDFRCKNHHCIPLRWQCDGQNDCGDNSDEENCAPRECTESEFRCVNQQCIPSRWICDHYNDCGDNSDERDCEMRTCHPEYFQCTSGHCVHSELKCDGSADCLDASDEADCPTRFPDGAYCQATMFECKNHVCIPPYWKCDGDDDCGDGSDEELHLCLDVPCNSPNRFRCDNNRCIYSHEVCNGVDDCGDGTDETEEHCRKPTPKPCTEYEYKCGNGHCIPHDNVCDDADDCGDWSDELGCNKGKERTCAENICEQNCTQLNEGGFICSCTAGFETNVFDRTSCLDINECEQFGTCPQHCRNTKGSYECVCADGFTSMSDRPGKRCAAEGSSPLLLLPDNVRIRKYNLSSERFSEYLQDEEYIQAVDYDWDPKDIGLSVVYYTVRGEGSRFGAIKRAYIPNFESGRNNLVQEVDLKLKYVMQPDGIAVDWVGRHIYWSDVKNKRIEVAKLDGRYRKWLISTDLDQPAAIAVNPKLGLMFWTDWGKEPKIESAWMNGEDRNILVFEDLGWPTGLSIDYLNNDRIYWSDFKEDVIETIKYDGTDRRVIAKEAMNPYSLDIFEDQLYWISKEKGEVWKQNKFGQGKKEKTLVVNPWLTQVRIFHQLRYNKSVPNLCKQICSHLCLLRPGGYSCACPQGSSFIEGSTTECDAAIELPINLPPPCRCMHGGNCYFDETDLPKCKCPSGYTGKYCEMAFSKGISPGTTAVAVLLTILLIVVIGALAIAGFFHYRRTGSLLPALPKLPSLSSLVKPSENGNGVTFRSGADLNMDIGVSGFGPETAIDRSMAMSEDFVMEMGKQPIIFENPMYSARDSAVKVVQPIQVTVSENVDNKNYGSPINPSEIVPETNPTSPAADGTQVTKWNLFKRKSKQTTNFENPIYAQMENEQKESVAATPPPSPSLPAKPKPPSRRDPTPTYSATEDTFKDTANLVKEDSEV

SEQ ID NO: 8017 - protein, 1225 aa, Homo Sapiens
MDRGPAAVACTLLLALVACLAPASGQECDSAHFRCGSGHCIPADWRCDGTKDCSDDADEIGCAVVTCQQGYFKCQSEGQCIPNSWVCDQDQDCDDGSDERQDCSQSTCSSHQITCSNGQCIPSEYRCDHVRDCPDGADENDCQYPTCEQLTCDNGACYNTSQKCDWKVDCRDSSDEINCTEICLHNEFSCGNGECIPRAYVCDHDNDCQDGSDEHACNYPTCGGYQFTCPSGRCIYQNWVCDGEDDCKDNGDEDGCESGPHDVHKCSPREWSCPESGRCISIYKVCDGILDCPGREDENNTSTGKYCSMTLCSALNCQYQCHETPYGGACFCPPGYIINHNDSRTCVEFDDCQIWGICDQKCESRPGRHLCHCEEGYILERGQYCKANDSFGEASIIFSNGRDLLIGDIHGRSFRILVESQNRGVAVGVAFHYHLQRVFWTDTVQNKVFSVDINGLNIQEVLNVSVETPENLAVDWVNNKIYLVETKVNRIDMVNLDGSYRVTLITENLGHPRGIAVDPTVGKTVVHGGSLIPHPFGVSLFEGQVFFTDWTKMAVLKANKFTETNPQVYYQASLRPYGVTVYHSLRQPYATNPCKDNNGGCEQVCVLSHRTDNDGLGFRCKCTFGFQLDTDERHCIGREILAANRVENVESLAFDWISKNLYWTDSHYKSISVMRLADKTRRTVVQYLNNPRSVVVHPFAGYLFFTDWFRPAKIMRAWSDGSHLLPVINTTLGWPNGLAIDWAASRLYWVDAYFDKIEHSTFDGLDRRRLGHIEQMTHPFGLAIFGEHLFFTDWRLGAIIRVRKADGGEMTVIRSGIAYILHLKSYDVNIQTGSNACNQPTHPNGDCSHFCFPVPNFQRVCGCPYGMRLASNHLTCEGDPTNEPPTEQCGLFSFPCKNGRCVPNYYLCDGVDDCHDNSDEQLCGTLNNTCSSSAFTCGHGECIPAHWRCDKRNDCVDGSDEHNCPTHAPASCLDTQYTCDNHQCISKNWVCDTDNDCGDGSDEKNCNSTETCQPSQFNCPNHRCIDLSFVCDGDKDCVDGSDEVGCVLNCTASQFKCASGDKCIGVTNRCDGVFDCSDNSDEAGCPTRPPGMCHSDEFQCQEDGICIPNFWECDGHPDCLYGSDEHNACVPKTCPSSYFHCDNGNCIHRAWLCDRDNDCGDMSDEKDCPTQPFRCPSWQWQCLGHNICVNLSVVCDGIFDCPNGTDESPLCSKFPDHSLLAINSF

SEQ ID NO: 8018 - protein, 1905 aa, Homo Sapiens
MRRQWGALLLGALLCAHGLASSPECACGRSHFTCAVSALGECTCIPAQWQCDGDNDCGDHSDEDGCILPTCSPLDFHCDNGKCIRRSWVCDGDNDCEDDSDEQDCPPRECEEDEFPCQNGYCIRSLWHCDGDNDCGDNSDEQCDMRKCSDKEFRCSDGSCIAEHWYCDGDTDCKDGSDEENCPSAVPAPPCNLEEFQCAYGRCILDIYHCDGDDDCGDWSDESDCSSHQPCRSGEFMCDSGLCINAGWRCDGDADCDDQSDERNCTTSMCTAEQFRCHSGRCVRLSWRCDGEDDCADNSDEENCENTGSPQCALDQFLCWNGRCIGQRKLCNGVNDCGDNSDESPQQNCRPRTGEENCNVNNGGCAQKCQMVRGAVQCTCHTGYRLTEDGHTCQDVNECAEEGYCSQGCTNSEGAFQCWCETGYELRPDRRSCKALGPEPVLLFANRIDIRQVLPHRSEYTLLLNNLENAIALDFHHRRELVFWSDVTLDRILRANLNGSNVEEVVSTGLESPGGLAVDWVHDKLYWTDSGTSRIEVANLDGAHRKVLLWQNLEKPRAIALHPMEGTIYWTDWGNTPRIEASSMDGSGRRIIADTHLFWPNGLTIDYAGRRMYWVDAKHHVIERANLDGSHRKAVISQGLPHPFAITVFEDSLYWTDWHTKSINSANKFTGKNQEIIRNKLHFPMDIHTLHPQRQPAGKNRCGDNNGGCTHLCLPSGQNYTCACPTGFRKISSHACAQSLDKFLLFARRMDIRRISFDTEDLSDDVIPLADVRSAVALDWDSRDDHVYWTDVSTDTISRAKWDGTGQEVVVDTSLESPAGLAIDWVTNKLYWTDAGTDRIEVANTDGSMRTVLIWENLDRPRDIVVEPMGGYMYWTDWGASPKIERAGMDASGRQVIISSNLTWPNGLAIDYGSQRLYWADAGMKTIEFAGLDGSKRKVLIGSQLPHPFGLTLYGERIYWTDWQTKSIQSADRLTGLDRETLQENLENLMDIHVFHRRRPPVSTPCAMENGGCSHLCLRSPNPSGFSCTCPTGINLLSDGKTCSPGMNSFLIFARRIDIRMVSLDIPYFADVVVPINITMKNTIAIGVDPQEGKVYWSDSTLHRISRANLDGSQHEDIITTGLQTTDGLAVDAIGRKVYWTDTGTNRIEVGNLDGSMRKVLVWQNLDSPRAIVLYHEMGFMYWTDWGENAKLERSGMDGSDRAVLINNNLGWPNGLTVDKASSQLLWADAHTERIEAADLNGANRHTLVSPVQHPYGLTLLDSYIYWTDWQTRSIHRADKGTGSNVILVRSNLPGLMDMQAVDRAQPLGFNKCGSRNGGCSHLCLPRPSGFSCACPTGIQLKGDGKTCDPSPETYLLFSSRGSIRRISLDTSDHTDVHVPVPELNNVISLDYDSVDGKVYYTDVFLDVIRRADLNGSNMETVIGRGLKTTDGLAVDWVARNLYWTDTGRNTIEASRLDGSCRKVLINNSLDEPRAIAVFPRKGYLFWTDWGHIAKIERANLDGSERKVLINTDLGWPNGLTLDYDTRRIYWVDAHLDRIESADLNGKLRQVLVSHVSHPFALTQQDRWIYWTDWQTKSIQRVDKYSGRNKETVLANVEGLMDIIVVSPQRQTGTNACGVNNGGCTHLCFARASDFVCACPDEPDSRPCSLVPGLVPPAPRATGMSEKSPVLPNTPPTTLYSSTTRTRTSLEEVEGRCSERDARLGLCARSNDAVPAAPGEGLHISYAIGGLLSILLILVVIAALMLYRHKKSKFTDPGMGNLTYSNPSYRTSTQEVKIEAIPKPAMYNQLCYKKEGGPDHNYTKEKIKIVEGICLLSGDDAEWDDLKQLRSSRGGLLRDHVCMKTDTVSIQASSGSLDDTETEQLLQEEQSECSSVHTAATPERRGSLPDTGWKHERKLSSESQV

SEQ ID NO: 8019 - protein, 133 aa, Homo Sapiens
MRRQWGALLLGALLCAHVLPTCSPLDFHCDNGKCIRRSWVCDGDNDCEDDSDEQDCPPRECEEDEFPCQNGYCIRSLWHCDGDNDCGDNSDEQCDMRKCSDKEFRCSDGSCIAEHWYCDGDTDCKDGSDEENC

SEQ ID NO: 8020 - protein, 357 aa, Homo Sapiens
MAPRRVRSFLRGLPALLLLLLFLGPWPAASHGGKYSREKNQPKPSPKRESGEEFRMEKLNQLWEKAQRLHLPPVRLAELHADLKIQERDELAWKKLKLDGLDEDGEKEARLIRNLNVILAKYGLDGKKDARQVTSNSLSGTQEDGLDDPRLEKLWHKAKTSGKFSGEELDKLWREFLHHKEKVHEYNVLLETLSRTEEIHENVISPSDLSDIKGSVLHSRHTELKEKLRSINQGLDRLRRVSHQGYSTEAEFEEPRVIDLWDLAQSANLTDKELEAFREELKHFEAKIEKHNHYQKQLEIAHEKLRHAESVGDGERVSRSREKHALLEGRTKELGYTVKKHLQDLSGRISRARHNEL

SEQ ID NO: 8021 - protein, 105 aa, Homo Sapiens
MAPRRVRSFLRGLPALLLLLLFLGPWPAASHGGKYSREKNQPKPSPKRESGEEFRMEKLNQLWEKAQRNLPVASLLRGQFLAVSWSVLLVAHRLLPFVRSCIFLP

SEQ ID NO: 8022 - protein, 104 aa, Homo Sapiens
MRVVTIVILLCFCKAAELRKASPGSVRSRVNHGRAGGGRRGSNPVKRYAPGLPCDVYTYLHEKYLDCQERKLVYVLPGWPQDLLHMLLARNKIRTLKNNMFSKF

SEQ ID NO: 8023 - protein, 313 aa, Homo Sapiens
MRVVTIVILLCFCKAAELRKASPGSVRSRVNHGRAGGGRRGSNPVKRYAPGLPCDVYTYLHEKYLDCQERKLVYVLPGWPQDLLHMLLARNKIRTLKNNMFSKFKKLKSLDLQQNEISKIESEAFFGLNKLTTLLLQHNQIKVLTEEVFIYTPLLSYLRLYDNPWHCTCEIETLISMLQIPRNRNLGNYAKCESPQEQKNKKLRQIKSEQLCNEEEKEQLDPKPQVSGRPPVIKPEVDSTFCHNYVFPIQTLDCKRKELKKVPNNIPPDIVKLDLSYNKINQLRPKEFEDVHELKKLNLSSNGIEFIDPGSLR

SEQ ID NO: 8024 - protein, 441 aa, Homo Sapiens
MRVVTIVILLCFCKAAELRKASPGSVRSRVNHGRAGGGRRGSNPVKRYAPGLPCDVYTYLHEKYLDCQERKLVYVLPGWPQDLLHMLLARNKIRTLKNNMFSKFKKLKSLDLQQNEISKIESEAFFGLNKLTTLLLQHNQIKVLTEEVFIYTPLLSYLRLYDNPWHCTCEIETLISMLQIPRNRNLGNYAKCESPQEQKNKKLRQIKSEQLCNEEEKEQLDPKPQVSGRPPVIKPEVDSTFCHNYVFPIQTLDCKRKELKKVPNNIPPDIVKLDLSYNKINQLRPKEFEDVHELKKLNLSSNGIEFIDPAAFLGLTHLEELDLSNNSLQNFDYGVLEDLYFLKLLWLRDNPWRCDYNIHYLYYWLKHHYNVHFNGLECKTPEEYKGWSVGKYIRSYYEECPKDKLPAYPESFDQDTEDDEWEKKHRDHTAKKQSVIITIVG

SEQ ID NO: 8025 - protein, 186 aa, Homo Sapiens
MRPQILLLLALLTLGLAAQHQDKVPCKMVDKKVSCQVLGLLQVPSVLPPDTETLDLSGNQLRSILASPLGFYTALRHLDLSTNEISFLQPGAFQALTHLEHLSLAHNRLAMATALSAGGLGPLPRVTSLDLSGNSLYSGLLERLLGEAPSLHTLSLAENSLTRLTRHTFRDMPALEQLDLHSNVLM

SEQ ID NO: 8026 - protein, 662 aa, Homo Sapiens
MRPQILLLLALLTLGLAAQHQDKVPCKMVDKKVSCQVLGLLQVPSVLPPDTETLDLSGNQLRSILASPLGFYTALRHLDLSTNEISFLQPGAFQALTHLEHLSLAHNRLAMATALSAGGLGPLPRVTSLDLSGNSLYSGLLERLLGEAPSLHTLSLAENSLTRLTRHTFRDMPALEQLDLHSNVLMDIEDGAFEGLPRLTHLNLSRNSLTCISDFSLQQLRVLDLSCNSIEAFQTASQPQAEFQLTWLDLRENKLLHFPDLAALPRLIYLNLSNNLIRLPTGPPQDSKGIHAPSEGWSALPLSAPSGNASGRPLSQLLNLDLSYNEIELIPDSFLEHLTSLCFLNLSRNCLRTFEARRLGSLPCLMLLDLSHNALETLELGARALGSLRTLLLQGNALRDLPPYTFANLASLQRLNLQGNRVSPCGGPDEPGPSGCVAFSGITSLRSLSLVDNEIELLRAGAFLHTPLTELDLSSNPGLEVATGALGGLEASLEVLALQGNGLMVLQVDLPCFICLKRLNLAENRLSHLPAWTQAVSLEVLDLRNNSFSLLPGSAMGGLETSLRRLYLQGNPLSCCGNGWLAAQLHQGRVDVDATQDLICRFSSQEEVSLSHVRPEDCEKGGLKNINLIIILTFILVSAILLTTLAACCCVRRQKFNQQYKA

SEQ ID NO: 8027 - protein, 662 aa, Homo Sapiens; identical to SEQ ID NO: 8026

SEQ ID NO: 8028 - protein, 662 aa, Homo Sapiens; identical to SEQ ID NO: 8026

SEQ ID NO: 8029 - protein, 55 aa, Homo Sapiens
MNLVDLWLTRSLSMCLLLQSFVLMILCFHSASMCPKGCLCSSSGGLNVTCSNANL

SEQ ID NO: 8030 - protein, 163 aa, Homo Sapiens
MNLVDLWLTRSLSMCLLLQSFVLMILCFHSASMCPKGCLCSSSGGLNVTCSNANLKEIPRDLPPETVLLYLDSNQITSIPNEIFKDLHQLRVLNLSKNGIEFIDEHAFKGVAETLQTLDLSDNRIQSVHKNAFNNLKARARIANNPWHCDCTLQQVLRSMASN

SEQ ID NO: 8031 - protein, 259 aa, Homo Sapiens
MNLVDLWLTRSLSMCLLLQSFVLMILCFHSASMCPKGCLCSSSGGLNVTCSNANLKEIPRDLPPETVLLYLDSNQITSIPNEIFKDLHQLRVLNLSKNGIEFIDEHAFKGVAETLQTLDLSDNRIQSVHKNAFNNLKARARIANNPWHCDCTLQQVLRSMASNHETAHNVICKTSVLDEHAGRPFLNAANDADLCNLPKKTTDYAMLVTMFGWFTMVISYVVYYVRQNQEDARRHLEYLKSLPSRQKKADEPDDISTVV

SEQ ID NO: 8032 - protein, 259 aa, Homo Sapiens; identical to SEQ ID NO: 8031

SEQ ID NO: 8033 - protein, 259 aa, Homo Sapiens; identical to SEQ ID NO: 8031

SEQ ID NO: 8034 - protein, 238 aa, Homo Sapiens
MARARGSPCPPLPPGRMSWPHGALLFLWLFSPPLGAGGGGVAVTSAAGGGSPPATSCPVACSCSNQASRVICTRRDLAEVPASIPVNTRYLNLQENGIQVIRTDTFKHLRHLEILQLSKNLVRKIEVGAFNGLPSLNTLELFDNRLTTVPTQAFEYLSKLRELWLRNNPIESIPSYAFNRVPSLRRLDLGELKRLEYISEAAFEGLVNLRYLNLGMCNLKDIPNLTALVRLEELELSG

SEQ ID NO: 8035 - protein, 713 aa, Homo Sapiens
MARARGSPCPPLPPGRMSWPHGALLFLWLFSPPLGAGGGGVAVTSAAGGGSPPATSCPVACSCSNQASRVICTRRDLAEVPASIPVNTRYLNLQENGIQVIRTDTFKHLRHLEILQLSKNLVRKIEVGAFNGLPSLNTLELFDNRLTTVPTQAFEYLSKLRELWLRNNPIESIPSYAFNRVPSLRRLDLGELKRLEYISEAAFEGLVNLRYLNLGMCNLKDIPNLTALVRLEELELSGNRLDLIRPGSFQGLTSLRKLWLMHAQVATIERNAFDDLKSLEELNLSHNNLMSLPHDLFTPLHRLERVHLNHNPWHCNCDVLWLSWWLKETVPSNTTCCARCHAPAGLKGRYIGELDQSHFTCYAPVIVEPPTDLNVTEGMAAELKCRTGTSMTSVNWLTPNGTLMTHGSYRVRISVLHDGTLNFTNVTVQDTGQYTCMVTNSAGNTTASATLNVSAVDPVAAGGTGSGGGGPGGSGGVGGGSGGYTYFTTVTVETLETQPGEEALQPRGTEKEPPGPTTDGVWGGGRPGDAAGPASSSTTAPAPRSSRPTEKAFTVPITDVTENALKDLDDVMKTTKIIIGCFVAITFMAAVMLVAFYKLRKQHQLHKHHGPTRTVEIINVEDELPAASAVSVAAAAAVASGGGVGGDSHLALPALERDHLNHHHYVAAAFKAHYSSNPSGGGCGGKGPPGLNSIHEPLLFKSGSKENVQETQI

SEQ ID NO: 8036 - protein, 713 aa, Homo Sapiens; identical to SEQ ID NO: 8035

SEQ ID NO: 8037 - protein, 71 aa, Homo Sapiens
MCGLQFSLPCLRLFLVVTCYLLLLLHKEILGCSSVCQLCTGRQINCRNLGLSSIPKNFPESTVFLLASKGP

SEQ ID NO: 8038 - protein, 622 aa, Homo Sapiens
MCGLQFSLPCLRLFLVVTCYLLLLLHKEILGCSSVCQLCTGRQINCRNLGLSSIPKNFPESTVFLYLTGNNISYINESELTGLHSLVALYLDNSNILYVYPKAFVQLRHLYFLFLNNNFIKRLDPGIFKGLLNLRNLYLQYNQVSFVPRGVFNDLVSVQYLNLQRNRLTVLGSGTFVGMVALRILDLSNNNILRISESGFQHLENLACLYLGSNNLTKVPSNAFEVLKSLRRLSLSHNPIEAIQPFAFKGLANLEYLLLKNSRIRNVTRDGFSGINNLKHLILSHNDLENLNSDTFSLLKNLIYLKLDRNRIISIDNDTFENMGASLKILNLSFNNLTALHPRVLKPLSSLIHLQANSNPWECNCKLLGLRDWLASSAITLNIYCQNPPSMRGRALRYINITNCVTSSINVSRAWAVVKSPHIHHKTTALMMAWHKVTTNGSPLENTETENITFWERIPTSPAGRFFQENAFGNPLETTAVLPVQIQLTTSVTLNLEKNSALPNDAASMSGKTSLICTQEVEKLNEAFDILLAFFILACVLIIFLIYKVVQFKQKLKASENSRENRLEYYSFYQSARYNVTASICNTSPNSLESPGLEQIRLHKQIVPENEAQVILFEHSAL

SEQ ID NO: 8039 - protein, 708 aa, Homo Sapiens
MKDMPLRIHVLLGLAITTLVQAVDKKVDCPRLCTCEIRPWFTPRSIYMEASTVDCNDLGLLTFPARLPANTQILLLQTNNIAKIEYSTDFPVNLTGLDLSQNNLSSVTNINVKKMPQLLSVYLEENKLTELPEKCLSELSNLQELYINHNLLSTISPGAFIGLHNLLRLHLNSNRLQMINSKWFDALPNLEILMIGENPIIRIKDMNFKPLINLRSLVIAGINLTEIPDNALVGLENLESISFYDNRLIKVPHVALQKVVNLKFLDLNKNPINRIRRGDFSNMLHLKELGINNMPELISIDSLAVDNLPDLRKIEATNNPRLSYIHPNAFFRLPKLESLMLNSNALSALYHGTIESLPNLKEISIHSNPIRCDCVIRWMNMNKTNIRFMEPDSLFCVDPPEFQGQNVRQVHFRDMMEICLPLIAPESFPSNLNVEAGSYVSFHCRATAEPQPEIYWITPSGQKLLPNTLTDKFYVHSEGTLDINGVTPKEGGLYTCIATNLVGADLKSVMIKVDGSFPQDNNGSLNIKIRDIQANSVLVSWKASSKILKSSVKWTAFVKTENSHAAQSARIPSDVKVYNLTHLNPSTEYKICIDIPTIYQKNRKKCVNVTTKGLHPDQKEYEKNNTTTLMACLGGLLGIIGVICLISCLSPEMNCDGGHSYVRNYLQKPTFALGELYPPLINLWEAGKEKSTSLKVKATVIGLPTNMS

SEQ ID NO: 8040 - protein, 708 aa, Homo Sapiens; identical to SEQ ID NO: 8039

SEQ ID NO: 8041 - protein, 273 aa, Homo Sapiens
MKDMPLRIHVLLGLAITTLVQAVDKKVDCPRLCTCEIRPWFTPRSIYMEASTVDCNDLGLLTFPARLPANTQILLLQTNNIAKIEYSTDFPVNLTGLDLSQNNLSSVTNINVKKMPQLLSVYLEENKLTELPEKCLSELSNLQELYINHNLLSTISPGAFIGLHNLLRLHLNSNRLQMINSKWFDALPNLEILMIGENPIIRIKDMNFKPLINLRSLVIAGINLTEIPDNALVGLENLESISFYDNRLIKVPHVALQKVVNLKFLDLNKNPIN

SEQ ID NO: 8042 - protein, 708 aa, Homo Sapiens; identical to SEQ ID NO: 8039

SEQ ID NO: 8043 - protein, 109 aa, Homo Sapiens
MDFLLLGLCLYWLLRRPSGVVLCLLGACFQMLPAAPSGCPQLCRCEGRLLYCEALNLTEAPHNLSGLLGLSLRYNSLSELRAGQFTGLMQLTWLYLDHNHICSVQGDAF

SEQ ID NO: 8044 - protein, 183 aa, Homo Sapiens
MDFLLLGLCLYWLLRRPSGVVLCLLGACFQMLPAAPSGCPQLCRCEGRLLYCEALNLTEAPHNLSGLLGLSLRYNSLSELRAGQFTGLMQLTWLYLDHNHICSVQGDAFQKLRRVKELTLSSNQITQLPNTTFRPMPNLRSVDLSYNKLQALAPDLFHGLRKLTTLHMRANAIQFVPVRIFQD

SEQ ID NO: 8045 - protein, 223 aa, Homo Sapiens
MDFLLLGLCLYWLLRRPSGVVLCLLGACFQMLPAAPSGCPQLCRCEGRLLYCEALNLTEAPHNLSGLLGLSLRYNSLSELRAGQFTGLMQLTWLYLDHNHICSVQGDAFQKLRRVKELTLSSNQITQLPNTTFRPMPNLRSVDLSYNKLQALAPDLFHGLRKLTTLHMRANAIQFVPVRIFQDCRSLKFLDIGYNQLKSLARNSFAGLFKLTELHLEHNDLVK

SEQ ID NO: 8046 - protein, 522 aa, Homo Sapiens
MDFLLLGLCLYWLLRRPSGVVLCLLGACFQMLPAAPSGCPQLCRCEGRLLYCEALNLTEAPHNLSGLLGLSLRYNSLSELRAGQFTGLMQLTWLYLDHNHICSVQGDAFQKLRRVKELTLSSNQITQLPNTTFRPMPNLRSVDLSYNKLQALAPDLFHGLRKLTTLHMRANAIQFVPVRIFQDCRSLKFLDIGYNQLKSLARNSFAGLFKLTELHLEHNDLVKVNFAHFPRLISLHSLCLRRNKVAIVVSSLDWVWNLEKMDLSGNEIEYMEPHVFETVPHLQSLQLDSNRLTYIEPRILNSWKSLTSITLAGNLWDCGRNVCALASWLNNFQGRYDGNLQCASPEYAQGEDVLDAVYAFHLCEDGAEPTSGHLLSAVTNRSDLGPPASSATTLADGGEGQHDGTFEPATVALPGGEHAENAVQIHKVVTGTMALIFSFLIVVLVLYVSWKCFPASLRQLRQCFVTQRRKQKQKQTMHQMAAMSAQEYYVDYKPNHIEGALVIINEYGSCTCHQQPARECEV

SEQ ID NO: 8047 - protein, 522 aa, Homo Sapiens; identical to SEQ ID NO: 8046

SEQ ID NO: 8048 - protein, 522 aa, Homo Sapiens; identical to SEQ ID NO: 8046

SEQ ID NO: 8049 - protein, 522 aa, Homo Sapiens; identical to SEQ ID NO: 8046

SEQ ID NO: 8050 - protein, 38 aa, Homo Sapiens
MAVISAPRALLWPSEAADLAFTFQLPADYPSTPVLGLS

SEQ ID NO: 8051 - protein, 516 aa, Homo Sapiens
MGLHFKWPLGAPMLAAIYAMSMVLKMLPALGMACPPKCRCEKLLFYCDSQGFHSVPNATDKGSLGLSLRHNHITELERDQFASFSQLTWLHLDHNQISTVKEDAFQGLYKLKELILSSNKIFYLPNTTFTQLINLQNLDLSFNQLSSLHPELFYGLRKLQTLHLRSNSLRTIPVRLFWDCRSLEFLDLSTNRLRSLARNGFAGLIKLRELHLEHNQLTKINFAHFLRLSSLHTLFLQWNKISNLTCGMEWTWGTLEKLDLTGNEIKAIDLTVFETMPNLKILLMDNNKLNSLDSKILNSLRSLTTVGLSGNLWECSARICALASWLGSFQGRWEHSILCHSPDHTQGEDILDAVHGFQLCWNLSTTVTVMATTYRDPTTEYTKRISSSSYHVGDKEIPTTAGIAVTTEEHFPEPDNAIFTQRVITGTMALLFSFFFIIFIVFISRKCCPPTLRRIRQCSMVQNHRQLRSQTRLHMSNMSDQGPYNEYEPTHEGPFIIINGYGQCKCQQLPYKECEV

SEQ ID NO: 8052 - protein, 77 aa, Homo Sapiens
MVFISRKCCPPTLRRIRQCSMVQNHRQLRSQTRLHMSNMSDQGPYNEYEPTHEGPFIIINGYGQCKCQQLPYKECEV

SEQ ID NO: 8053 - protein, 590 aa, Homo Sapiens
MGFHLITQLKGMSVVLVLLPTLLLVMLTGAQRACPKNCRCDGKIVYCESHAFADIPENISGGSQGLSLRFNSIQKLKSNQFAGLNQLIWLYLDHNYISSVDEDAFQGIRRLKELILSSNKITYLHNKTFHPVPNLRNLDLSYNKLQTLQSEQFKGLRKLIILHLRSNSLKTVPIRVFQDCRNLDFLDLGYNRLRSLSRNAFAGLLKLKELHLEHNQFSKINFAHFPRLFNLRSIYLQWNRIRSISQGLTWTWSSLHNLDLSGNDIQGIEPGTFKCLPNLQKLNLDSNKLTNISQETVNAWISLISITLSGNMWECSRSICPLFYWLKNFKGNKESTMICAGPKHIQGEKVSDAVETYNICSEVQVVNTERSHLVPQTPQKPLIIPRPTIFKPDVTQSTFETPSPSPGFQIPGAEQEYEHVSFHKIIAGSVALFLSVAMILLVIYVSWKRYPASMKQLQQHSLMKRRRKKARESERQMNSPLQEYYVDYKPTNSETMDISVNGSGPCTYTISGSRECEMPHHMKPLPYYSYDQPVIGYCQAHQPLHVTKGYETVSPEQDESPGLELGRDHSFIATIARSAAPAIYLERIAN

SEQ ID NO: 8054 - protein, 518 aa, Homo Sapiens
MGFHLITQLKGMSVVLVLLPTLLLVMLTGAQRACPKNCRCDGKIVYCESHAFADIPENISGGSQGLSLRFNSIQKLKSNQFAGLNQLIWLYLDHNYISSVDEDAFQGIRRLKELILSSNKITYLHNKTFHPVPNLRNLDLSYNKLQTLQSEQFKGLRKLIILHLRSNSLKTVPIRVFQDCRNLDFLDLGYNRLRSLSRNAFAGLLKLKELHLEHNQFSKINFAHFPRLFNLRSIYLQWNRIRSISQGLTWTWSSLHNLDLSGNDIQGIEPGTFKCLPNLQKLNLDSNKLTNISQETVNAWISLISITLSGNMWECSRSICPLFYWLKNFKGNKESTMICAGPKHIQGEKVSDAVETYNICSEVQVVNTERSHLVPQTPQKPLIIPRPTIFKPDVTQSTFETPSPSPGFQIPGAEQEYEHVSFHKIIAGSVALFLSVAMILLVIYVSWKRYPASMKQLQQHSLMKRRRKKARESERQMNSPLQEYYVDYKPTNSETMDISVNGSGPCTYTISGSRECEV

SEQ ID NO: 8055 - protein, 590 aa, Homo Sapiens; identical to SEQ ID NO: 8053

SEQ ID NO: 8056 - protein, 591 aa, Homo Sapiens
MPGFHLITQLKGMSVVLVLLPTLLLVMLTGAQRACPKNCRCDGKIVYCESHAFADIPENISGGSQGLSLRFNSIQKLKSNQFAGLNQLIWLYLDHNYISSVDEDAFQGIRRLKELILSSNKITYLHNKTFHPVPNLRNLDLSYNKLQTLQSEQFKGLRKLIILHLRSNSLKTVPIRVFQDCRNLDFLDLGYNRLRSLSRNAFAGLLKLKELHLEHNQFSKINFAHFPRLFNLRSIYLQWNRIRSISQGLTWTWSSLHNLDLSGNDIQGIEPGTFKCLPNLQKLNLDSNKLTNISQETVNAWISLISITLSGNMWECSRSICPLFYWLKNFKGNKESTMICAGPKHIQGEKVSDAVETYNICSEVQVVNTERSHLVPQTPQKPLIIPRPTIFKPDVTQSTFETPSPSPGFQIPGAEQEYEHVSFHKIIAGSVALFLSVAMILLVIYVSWKRYPASMKQLQQHSLMKRRRKKARESERQMNSPLQEYYVDYKPTNSETMDISVNGSGPCTYTISGSRECEMPHHMKPLPYYSYDQPVIGYCQAHQPLHVTKGYETVSPEQDESPGLELGRDHSFIATIARSAAPAIYLERIAN

SEQ ID NO: 8057 - protein, 519 aa, Homo Sapiens
MPGFHLITQLKGMSVVLVLLPTLLLVMLTGAQRACPKNCRCDGKIVYCESHAFADIPENISGGSQGLSLRFNSIQKLKSNQFAGLNQLIWLYLDHNYISSVDEDAFQGIRRLKELILSSNKITYLHNKTFHPVPNLRNLDLSYNKLQTLQSEQFKGLRKLIILHLRSNSLKTVPIRVFQDCRNLDFLDLGYNRLRSLSRNAFAGLLKLKELHLEHNQFSKINFAHFPRLFNLRSIYLQWNRIRSISQGLTWTWSSLHNLDLSGNDIQGIEPGTFKCLPNLQKLNLDSNKLTNISQETVNAWISLISITLSGNMWECSRSICPLFYWLKNFKGNKESTMICAGPKHIQGEKVSDAVETYNICSEVQVVNTERSHLVPQTPQKPLIIPRPTIFKPDVTQSTFETPSPSPGFQIPGAEQEYEHVSFHKIIAGSVALFLSVAMILLVIYVSWKRYPASMKQLQQHSLMKRRRKKARESERQMNSPLQEYYVDYKPTNSETMDISVNGSGPCTYTISGSRECEV

SEQ ID NO: 8058 - protein, 24 aa, Homo Sapiens
MSVVLVLLPTLLLVMLTGAQRACP

SEQ ID NO: 8059 - protein, 93 aa, Homo Sapiens
MLAPGSSPGQRGRLALQWRQVSWITCWIALYAVEALPTCPFSCKCDSRSLEVDCSGLGLTTVPPDVPAATRTLLLLNNKLSALPSWAFANLSS

SEQ ID NO: 8060 - protein, 96 aa, Homo Sapiens
MLAPGSSPGQRGRLALQWRQVSWITCWIALYAVEALPTCPFSCKCDSRSLEVDCSGLGLTTVPPDVPAATRTLLLLNNKLSALPSWAFANLSSLQR

SEQ ID NO: 8061 - protein, 370 aa, Homo Sapiens
MLAPGSSPGQRGRLALQWRQVSWITCWIALYAVEALPTCPFSCKCDSRSLEVDCSGLGLTTVPPDVPAATRTLLLLNNKLSALPSWAFANLSSLQRLDLSNNFLDRLPRSIFGDLTNLTELQLRNNSIRTLDRDLLRHSPLLRHLDLSINGLAQLPPGLFDGLLALRSLSLRSNRLQNLDRLTFEPLANLQLLQVGDNPWECDCNLREFKHWMEWFSYRGGRLDQLACTLPKELRGKDMRMVPMEMFNYCSQLEDENSSAGLDIPGPPCTKASPEPAKPKPGAEPEPEPSTACPQKQRHRPASVRRAMGTVIIAGVVCGVVCIMMVVAAAYGCIYASLMAKYHRELKKRQPLMGDPEGEHEDQKQISSVA

SEQ ID NO: 8062 - protein, 370 aa, Homo Sapiens; identical to SEQ ID NO: 8061

SEQ ID NO: 8063 - protein, 370 aa, Homo Sapiens; identical to SEQ ID NO: 8061

SEQ ID NO: 8064 - protein, 114 aa, Homo Sapiens
DSVRTVRVVATKQGNAVTLGDYYQGRRITITGNADLTFDQTAWGDSGVYYCSVVSAQDLQGNNEAYAELIVLGRTSGVAELLPGFQAGPIEVYAAGKAATSGVPSIYAPSTYAH

SEQ ID NO: 8065 - protein, 493 aa, Homo Sapiens
MALLAGGLSRGLGSHPAAAGRDAVVFVWLLLSTWCTAPARAIQVTVSNPYHVVILFQPVTLPCTYQMTSTPTQPIVIWKYKSFCRDRIADAFSPASVDNQLNAQLAAGNPGYNPYVECQDSVRTVRVVATKQGNAVTLGDYYQGRRITITGMYAAGKAATSGVPSIYAPSTYAHLSPAKTPPPPAMIPMGPAYNGYPGGYPGDVDRSSSAGGQGSYVPLLRDTDSSVASEVRSGYRIQASQQDDSMRVLYYMEKELANFDPSRPGPPSGRVERAMSEVTSLHEDDWRSRPSRGPALTPIRDEEWGGHSPRSPRGWDQEPAREQAGGGWRARRPRARSVDALDDLTPPSTAESGSRSPTSNGGRSRAYMPPRSRSRDDLYDQDDSRDFPRSRDPHYDDFRSRERPPADPRSHHHRTRDPRDNGSRSGDLPYDGRLLEEAVRKKGSEERRRPHKEEEEEAYYPPAPPPYSETDSQASRERRLKKNLALSRESLVV

SEQ ID NO: 8066 - protein, 601 aa, Homo Sapiens
MALLAGGLSRGLGSHPAAAGRDAVVFVWLLLSTWCTAPARAIQVTVSNPYHVVILFQPVTLPCTYQMTSTPTQPIVIWKYKSFCRDRIADAFSPASVDNQLNAQLAAGNPGYNPYVECQDSVRTVRVVATKQGNAVTLGDYYQGRRITITGNADLTFDQTAWGDSGVYYCSVVSAQDLQGNNEAYAELIVLGRTSGVAELLPGFQAGPIEDWLFVVVVCLAAFLIFLLLGICWCQCCPHTCCCYVRCPCCPDKCCCPEALYAAGKAATSGVPSIYAPSTYAHLSPAKTPPPPAMIPMGPAYNGYPGGYPGDVDRSSSAGGQGSYVPLLRDTDSSVASEVRSGYRIQASQQDDSMRVLYYMEKELANFDPSRPGPPSGRVERAMSEVTSLHEDDWRSRPSRGPALTPIRDEEWGGHSPRSPRGWDQEPAREQAGGGWRARRPRARSVDALDDLTPPSTAESGSRSPTSNGGRSRAYMPPRSRSRDDLYDQDDSRDFPRSRDPHYDDFRSRERPPADPRSHHHRTRDPRDNGSRSGDLPYDGRLLEEAVRKKGSEERRRPHKEEEEEAYYPPAPPPYSETDSQASRERRLKKNLALSRESLVV

SEQ ID NO: 8067 - protein, 591 aa, Homo Sapiens
MQQDGLGVGTRNGSGKGRSVHPSWPWCAPRPLRYFGRDARARRAQTAAMALAIQVTVSNPYHVVILFQPVTLPCTYQMTSTPTQPIVIWKYKSFCRDRIADAFSPASVDNQLNAQLAAGNPGYNPYVECQDSVRTVRVVATKQGNAVTLGDYYQGRRITITGNADLTFDQTAWGDSGVYYCSVVSAQDLQGNNEAYAELIVLGRTSGVAELLPGFQAGPIEDWLFVVVVCLAAFLIFLLLGICWCQCCPHTCCCYVRCPCCPDKCCCPEALYAAGKAATSGVPSIYAPSTYAHLSPAKTPPPPAMIPMGPAYNGYPGGYPGDVDRSSSVRSGYRIQASQQDDSMRVLYYMEKELANFDPSRPGPPSGRVERAMSEVTSLHEDDWRSRPSRGPALTPIRDEEWGGHSPRSPRGWDQEPAREQAGGGWRARRPRARSVDALDDLTPPSTAESGSRSPTSNGGRSRAYMPPRSRSRDDLYDQDDSRDFPRSRDPHYDDFRSRERPPADPRSHHHRTRDPRDNGSRSGDLPYDGRLLEEAVRKKGSEERRRPHKEEEEEAYYPPAPPPYSETDSQASRERRLKKNLALSRESLVV

SEQ ID NO: 8068 - protein, 630 aa, Homo Sapiens
MQQDGLGVGTRNGSGKGRSVHPSWPWCAPRPLRYFGRDARARRAQTAAMALLAGGLSRGLGSHPAAAGRDAVVFVWLLLSTWCTAPARAIQVTVSNPYHVVILFQPVTLPCTYQMTSTPTQPIVIWKYKSFCRDRIADAFSPASVDNQLNAQLAAGNPGYNPYVECQDSVRTVRVVATKQGNAVTLGDYYQGRRITITGNADLTFDQTAWGDSGVYYCSVVSAQDLQGNNEAYAELIVLDWLFVVVVCLAAFLIFLLLGICWCQCCPHTCCCYVRCPCCPDKCCCPEALYAAGKAATSGVPSIYAPSTYAHLSPAKTPPPPAMIPMGPAYNGYPGGYPGDVDRSSSAGGQGSYVPLLRDTDSSVASEVRSGYRIQASQQDDSMRVLYYMEKELANFDPSRPGPPSGRVERAMSEVTSLHEDDWRSRPSRGPALTPIRDEEWGGHSPRSPRGWDQEPAREQAGGGWRARRPRARSVDALDDLTPPSTAESGSRSPTSNGGRSRAYMPPRSRSRDDLYDQDDSRDFPRSRDPHYDDFRSRERPPADPRSHHHRTRDPRDNGSRSGDLPYDGRLLEEAVRKKGSEERRRPHKEEEEEAYYPPAPPPYSETDSQASRERRLKKNLALSRESLVV

SEQ ID NO: 8069 - protein, 629 aa, Homo Sapiens
MQQDGLGVGTRNGSGKGRSVHPSWPWCAPRPLRYFGRDARARRAQTAAMALLAGGLSRGLGSHPAAAGRDAVVFVWLLLSTWCTAPARAIQVTVSNPYHVVILFQPVTLPCTYQMTSTPTQPIVIWKYKSFCRDRIADAFSPASVDNQLNAQLAAGNPGYNPYVECQDSVRTVRVVATKQGNAVTLGDYYQGRRITITGNADLTFDQTAWGDSGVYYCSVVSAQDLQGNNEAYAELIVLDWLFVVVVCLAAFLIFLLLGICWCQCCPHTCCCYVRCPCCPDKCCCPEALYAAGKAATSGVPSIYAPSTYAHLSPAKTPPPPAMIPMGPAYNGYPGGYPGDVDRSSSAGGQGSYVPLLRDTDSSVASVRSGYRIQASQQDDSMRVLYYMEKELANFDPSRPGPPSGRVERAMSEVTSLHEDDWRSRPSRGPALTPIRDEEWGGHSPRSPRGWDQEPAREQAGGGWRARRPRARSVDALDDLTPPSTAESGSRSPTSNGGRSRAYMPPRSRSRDDLYDQDDSRDFPRSRDPHYDDFRSRERPPADPRSHHHRTRDPRDNGSRSGDLPYDGRLLEEAVRKKGSEERRRPHKEEEEEAYYPPAPPPYSETDSQASRERRLKKNLALSRESLVV

SEQ ID NO: 8070 - protein, 649 aa, Homo Sapiens
MQQDGLGVGTRNGSGKGRSVHPSWPWCAPRPLRYFGRDARARRAQTAAMALLAGGLSRGLGSHPAAAGRDAVVFVWLLLSTWCTAPARAIQVTVSNPYHVVILFQPVTLPCTYQMTSTPTQPIVIWKYKSFCRDRIADAFSPASVDNQLNAQLAAGNPGYNPYVECQDSVRTVRVVATKQGNAVTLGDYYQGRRITITGNADLTFDQTAWGDSGVYYCSVVSAQDLQGNNEAYAELIVLGRTSGVAELLPGFQAGPIEDWLFVVVVCLAAFLIFLLLGICWCQCCPHTCCCYVRCPCCPDKCCCPEALYAAGKAATSGVPSIYAPSTYAHLSPAKTPPPPAMIPMGPAYNGYPGGYPGDVDRSSSAGGQGSYVPLLRDTDSSVASEVRSGYRIQASQQDDSMRVLYYMEKELANFDPSRPGPPSGRVERAMSEVTSLHEDDWRSRPSRGPALTPIRDEEWGGHSPRSPRGWDQEPAREQAGGGWRARRPRARSVDALDDLTPPSTAESGSRSPTSNGGRSRAYMPPRSRSRDDLYDQDDSRDFPRSRDPHYDDFRSRERPPADPRSHHHRTRDPRDNGSRSGDLPYDGRLLEEAVRKKGSEERRRPHKEEEEEAYYPPAPPPYSETDSQASRERRLKKNLALSRESLVV

SEQ ID NO: 8071 - protein, 649 aa, Homo Sapiens; identical to SEQ ID NO: 8070

SEQ ID NO: 8072 - protein, 581 aa, Homo Sapiens
MQQDGLGVGTRNGSGKGRSVHPSWPWCAPRPLRYFGRDARARRAQTAAMALLAGGLSRGLGSHPAAAGRDAVVFVWLLLSTWCTAPARAIQVTVSNPYHVVILFQPVTLPCTYQMTSTPTQPIVIWKYKSFCRDRIADAFSPASVDNQLNAQLAAGNPGYNPYVECQDSVRTVRVVATKQGNAVTLGDYYQGRRITITGNADLTFDQTAWGDSGVYYCSVVSAQDLQGNNEAYAELIVLVYAAGKAATSGVPSIYAPSTYAHLSPAKTPPPPAMIPMGPAYNGYPGGYPGDVDRSSSAGGQGSYVPLLRDTDSSVASEVRSGYRIQASQQDDSMRVLYYMEKELANFDPSRPGPPSGRVERAMSEVTSLHEDDWRSRPSRGPALTPIRDEEWGGHSPRSPRGWDQEPAREQAGGGWRARRPRARSVDALDDLTPPSTAESGSRSPTSNGGRSRAYMPPRSRSRDDLYDQDDSRDFPRSRDPHYDDFRSRERPPADPRSHHHRTRDPRDNGSRSGDLPYDGRLLEEAVRKKGSEERRRPHKEEEEEAYYPPAPPPYSETDSQASRERRLKKNLALSRESLVV

SEQ ID NO: 8073 - protein, 51 aa, Homo Sapiens
MQQDGLGVGTRNGSGKGRSVHPSWPWCAPRPLSSCQGHPGDRVQPLPRGDP

SEQ ID NO: 8074 - protein, 139 aa, Homo Sapiens
MTSTPTQPIVIWKYKSFCRDRIADAFSPASVDNQLNAQLAAGNPGYNPYVECQDSVRTVRVVATKQGNAVTLGDYYQGRRITITGNADLTFDQTAWGDSGVYYCSVVSAQDLQGNNEAYAELIVLDWLFVVVVCLAAFL

SEQ ID NO: 8075 - protein, 35 aa, Homo Sapiens
MLSRNDAPSVLVPGPGLLRAGTPLCISAEAASAQQ

SEQ ID NO: 8076 - protein, 36 aa, Homo Sapiens
MLSRNDDICIYGGLGLGGLLLLAVVLLSACLCWLHR

SEQ ID NO: 8077 - protein, 66 aa, Homo Sapiens
MLSRNDDICIYGGLGLGGLLLLAVVLLSACLCWLHRRAPSVLVPGPGLLRAGTPLCISAEAASAQQ

SEQ ID NO: 8078 - protein, 44 aa, Homo Sapiens
MLSRNDDICIYGGLGLGGLLLLAVVLLSACLCWLHRREAASAQQ

SEQ ID NO: 8079 - protein, 59 aa, Homo Sapiens
MLSRNDDICIYGGLGLGGLLLLAVVLLSACLCWLHRRGPGLLRAGTPLCISAEAASAQQ

SEQ ID NO: 8080 - protein, 97 aa, Homo Sapiens
MLSRNDDICIYGGLGLGGLLLLAVVLLSACLCWLHRRVKRLERSWAQGSSEQELHYASLQRLPVPSSEGPDLRGRDKRGTKEDPRADYACIAENKPT

SEQ ID NO: 8081 - protein, 104 aa, Homo Sapiens
MLSRNDDICIYGGLGLGGLLLLAVVLLSACLCWLHRRVKRLERSWHLLSWSQAQGSSEQELHYASLQRLPVPSSEGPDLRGRDKRGTKEDPRADYACIAENKPT

SEQ ID NO: 8082 - protein, 66 aa, Homo Sapiens
MLSRNDDICIYGGLGLGGLLLLAVVLLSACLCWLHRRVKRLERSWRLPVPSSEGPDLRGRDKRGTK

SEQ ID NO: 8083 - protein, 13 aa, Homo Sapiens
MLSRNDEAASAQQ

SEQ ID NO: 8084 - protein, 28 aa, Homo Sapiens
MLSRNDGPGLLRAGTPLCISAEAASAQQ

SEQ ID NO: 8085 - protein, 28 aa, Homo Sapiens
MLSRNDGPGLLRAGTPLCISAEAASAQQ

SEQ ID NO: 8086 - protein, 28 aa, Homo Sapiens
MLSRNDGPGLLRAGTPLCISAEAASAQQ

SEQ ID NO: 8087 - protein, 66 aa, Homo Sapiens
MLSRNDVKRLERSWAQGSSEQELHYASLQRLPVPSSEGPDLRGRDKRGTKEDPRADYACIAENKPT

SEQ ID NO: 8088 - protein, 66 aa, Homo Sapiens; identical to SEQ ID NO: 8087

SEQ ID NO: 8089 - protein, 73 aa, Homo Sapiens
MLSRNDVKRLERSWHLLSWSQAQGSSEQELHYASLQRLPVPSSEGPDLRGRDKRGTKEDPRADYACIAENKPT

SEQ ID NO: 8090 - protein, 51 aa, Homo Sapiens
MLSRNDVKRLERSWRLPVPSSEGPDLRGRDKRGTKEDPRADYACIAENKPT

SEQ ID NO: 8091 - protein, 60 aa, Homo Sapiens
  misc_feature (1)..(1): Xaa can be any naturally occurring amino acid
XDICIYGGLGLGGLLLLAVVLLSACLCWLHRREAGEELGPGLLRAGTPLCISAEAASAQQ

SEQ ID NO: 8092 - protein, 35 aa, Homo Sapiens
  misc_feature (1)..(1): Xaa can be any naturally occurring amino acid
XGGLLLLAVVLLSACLCWLHRREAGEELEAASAQQ

SEQ ID NO: 8093 - protein, 205 aa, Homo Sapiens
MTPPERLFLPRVCGTTLHLLLLGLLLVLLPGAQGLPGVGLTPSAAQTARQHPKMHLAHSTLKPAAHLIGDPSKQNSLLWRANTDRAFLQDGFSLSNNSLLVPTSGIYFVYSQVVFSGKAYSPKATSSPLYLAHEVQLFSSQYPFHVPLLSSQKMVYPGLQEPWLHSMYHGAAFQLTQGDQLSTHTDGIPHLVLSPSTVFFGAFAL

SEQ ID NO: 8094 - protein, 205 aa, Homo Sapiens; identical to SEQ ID NO: 8093

SEQ ID NO: 8095 - protein, 270 aa, Homo Sapiens
ECQHRHLCAHGQCRNTEGSFQCVCDQGYRASGLGDHCEDINECLEDKSVCQRGDCINTAGSYDCTCPDGFQLDDNKTCQDINECEHPGLCGPQGECLNTEGSFHCVCQQGFSISADGRTCEDVNECELLSGVCGEAFCENVEGSFLCVCADENQEYSPMTGQCRSRTSTDLDVDVDQPKEEKKECYYNLNDASLCDNVLAPNVTKQECCCTSGVGWGDNCEIFPCPVLGTAEFTEMCPKGKGFVPAGESSSEAGGENYKDADECLLFGQE

SEQ ID NO: 8096 - protein, 1721 aa, Homo Sapiens
MAGAWLRWGLLLWAGLLASSAHGRLRRITYVVHPGPGLAAGALPLSGPPRSRTFNVALNARYSRSSAAAGAPSRASPGVPSERTRRTSKPGGAALQGLRPPPPPPPEPARPAVPGGQLHPNPGGHPAAAPFTKQGRQVVRSKVPQETQSGGGSRLQVHQKQQLQGVNVCGGRCCHGWSKAPGSQRCTKPSCVPPCQNGGMCLRPQLCVCKPGTKGKACETIAAQDTSSPVFGGQSPGAASSWGPPEQAAKHTSSKKADTLPRVSPVAQMTLTLKPKPSVGLPQQIHSQVTPLSSQSVVIHHGQTQEYVLKPKYFPAQKGISGEQSTEGSFPLRYVQDQVAAPFQLSNHTGRIKVVFTPSICKVTCTKGSCQNSCEKGNTTTLISENGHAADTLTATNFRVVICHLPCMNGGQCSSRDKCQCPPNFTGKLCQIPVHGASVPKLYQHSQQPGKALGTHVIHSTHTLPLTVTSQQGVKVKFPPNIVNIHVKHPPEASVQIHQVSRIDGPTGQKTKEAQPGQSQVSYQGLPVQKTQTIHSTYSHQQVIPHVYPVAAKTQLGRCFQETIGSQCGKALPGLSKQEDCCGTVGTSWGFNKCQKCPKKPSYHGYNQMMECLPGYKRVNNTFCQDINECQLQGVCPNGECLNTMGSYRCTCKIGFGPDPTFSSCVPDPPVISEEKGPCYRLVSSGRQCMHPLSVHLTKQLCCCSVGKAWGPHCEKCPLPGTAAFKEICPGGMGYTVSGVHRRRPIHHHVGKGPVFVKPKNTQPVAKSTHPPPLPAKEEPVEALTFSREHGPGVAEPEVATAPPEKEIPSLDQEKTKLEPGQPQLSPGISTIHLHPQFPVVIEKTSPPVPVEVAPEASTSSASQVIAPTQVTEINECTVNPDICGAGHCINLPVRYTCICYEGYRFSEQQRKCVDIDECTQVQHLCSQGRCENTEGSFLCICPAGFMASEEGTNCIDVDECLRPDVCGEGHCVNTVGAFRCEYCDSGYRMTQRGRCEDIDECLNPSTCPDEQCVNSPGSYQCVPCTEGFRGWNGQCLDVDECLEPNVCANGDCSNLEGSYMCSCHKGYTRTPDHKHCRDIDECQQGNLCVNGQCKNTEGSFRCTCGQGYQLSAAKDQCEDIDECQHRHLCAHGQCRNTEGSFQCVCDQGYRASGLGDHCEDINECLEDKSVCQRGDCINTAGSYDCTCPDGFQLDDNKTCQDINECEHPGLCGPQGECLNTEGSFHCVCQQGFSISADGRTCEDIDECVNNTVCDSHGFCDNTAGSFRCLCYQGFQAPQDGQGCVDVNECELLSGVCGEAFCENVEGSFLCVCADENQEYSPMTGQCRSRTSTDLDVDVDQPKEEKKECYYNLNDASLCDNVLAPNVTKQECCCTSGVGWGDNCEIFPCPVLGTAEFTEMCPKGKGFVPAGESSSEAGGENYKDADECLLFGQEICKNGFCLNTRPGYECYCKQGTYYDPVKLQCFDMDECQDPSSCIDGQCVNTEGSYNCFCTHPMVLDASEKRCIRPAESNEQIEETDVYQDLCWEHLSDEYVCSRPLVGKQTTYTECCCLYGEAWGMQCALCPLKDSDDYAQLCNIPVTGRRQPYGRDALVDFSEQYTPEADPYFIQDRFLNSFEELQAEECGILNGCENGRCVRVQEGYTCDCFDGYHLDTAKMTCVDVNECDELNNRMSLCKNAKCINTDGSYKCLCLPGYVPSDKPNYCTPLNTALNLEKDSDLE

SEQ ID NO: 8097 - protein, 1395 aa, Homo Sapiens
MDTKLMCLLFFFSLPPLLVSNHTGRIKVVFTPSICKVTCTKGSCQNSCEKGNTTTLISENGHAADTLTATNFRVVICHLPCMNGGQCSSRDKCQCPPNFTGKLCQIPVHGASVPKLYQHSQQPGKALGTHVIHSTHTLPLTVTSQQGVKVKFPPNIVNIHVKHPPEASVQIHQVSRIDGPTGQKTKEAQPGQSQVSYQGLPVQKTQTIHSTYSHQQVIPHVYPVAAKTQLGRCFQETIGSQCGKALPGLSKQEDCCGTVGTSWGFNKCQKCPKKPSYHGYNQMMECLPGYKRVNNTFCQDINECQLQGVCPNGECLNTMGSYRCTCKIGFGPDPTFSSCVPDPPVISEEKGPCYRLVSSGRQCMHPLSVHLTKQLCCCSVGKAWGPHCEKCPLPGTAAFKEICPGGMGYTVSGVHRRRPIHHHVGKGPVFVKPKNTQPVAKSTHPPPLPAKEEPVEALTFSREHGPGVAEPEVATAPPEKEIPSLDQEKTKLEPGQPQLSPGISTIHLHPQFPVVIEKTSPPVPVEVAPEASTSSASQVIAPTQVTEINECTVNPDICGAGHCINLPVRYTCICYEGYRFSEQQRKCVDIDECTQVQHLCSQGRCENTEGSFLCICPAGFMASEEGTNCIDVDECLRPDVCGEGHCVNTVGAFRCEYCDSGYRMTQRGRCEDIDECLNPSTCPDEQCVNSPGSYQCVPCTEGFRGWNGQCLDVDECLEPNVCANGDCSNLEGSYMCSCHKGYTRTPDHKHCRDIDECQQGNLCVNGQCKNTEGSFRCTCGQGYQLSAAKDQCEDIDECQHRHLCAHGQCRNTEGSFQCVCDQGYRASGLGDHCEDINECLEDKSVCQRGDCINTAGSYDCTCPDGFQLDDNKTCQDINECEHPGLCGPQGECLNTEGSFHCVCQQGFSISADGRTCEDIDECVNNTVCDSHGFCDNTAGSFRCLCYQGFQAPQDGQGCVDVNECELLSGVCGEAFCENVEGSFLCVCADENQEYSPMTGQCRSRTSTDLDVDVDQPKEEKKECYYNLNDASLCDNVLAPNVTKQECCCTSGVGWGDNCEIFPCPVLGTAEFTEMCPKGKGFVPAGESSSEAGGENYKDADECLLFGQEICKNGFCLNTRPGYECYCKQGTYYDPVKLQCFDMDECQDPSSCIDGQCVNTEGSYNCFCTHPMVLDASEKRCIRPAESNEQIEETDVYQDLCWEHLSDEYVCSRPLVGKQTTYTECCCLYGEAWGMQCALCPLKDSDDYAQLCNIPVTGRRQPYGRDALVDFSEQYTPEADPYFIQDRFLNSFEELQAEECGILNGCENGRCVRVQEGYTCDCFDGYHLDTAKMTCVDVNECDELNNRMSLCKNAKCINTDGSYKCLCLPGYVPSDKPNYCTPLNTALNLEKDSDLE

SEQ ID NO: 8098 - protein, 1353 aa, Homo Sapiens
MDTKLMCLLFFFSLPPLLVSNHTGRIKVVFTPSICKVTCTKGSCQNSCEKGNTTTLISENGHAADTLTATNFRVVICHLPCMNGGQCSSRDKCQCPPNFTGKLCQIPVHGASVPKLYQHSQQPGKALGTHVIHSTHTLPLTVTSQQGVKVKFPPNIVNIHVKHPPEASVQIHQVSRIDGPTGQKTKEAQPGQSQVSYQGLPVQKTQTIHSTYSHQQVIPHVYPVAAKTQLGRCFQETIGSQCGKALPGLSKQEDCCGTVGTSWGFNKCQKCPKKPSYHGYNQMMECLPGYKRVNNTFCQDINECQLQGVCPNGECLNTMGSYRCTCKIGFGPDPTFSSCVPDPPVISEEKGPCYRLVSSGRQCMHPLSVHLTKQLCCCSVGKAWGPHCEKCPLPGTAAFKEICPGGMGYTVSGVHRRRPIHHHVGKGPVFVKPKNTQPVAKSTHPPPLPAKEEPVEALTFSREHGPGVAEPEVATAPPEKEIPSLDQEKTKLEPGQPQLSPGISTIHLHPQFPVVIEKTSPPVPVEVAPEASTSSASQVIAPTQVTEINECTVNPDICGAGHCINLPVRYTCICYEGYRFSEQQRKCVDIDECTQVQHLCSQGRCENTEGSFLCICPAGFMASEEGTNCIDVDECLRPDVCGEGHCVNTVGAFRCEYCDSGYRMTQRGRCEDIDECLNPSTCPDEQCVNSPGSYQCVPCTEGFRGWNGQCLDVDECLEPNVCANGDCSNLEGSYMCSCHKGYTRTPDHKHCRDIDECQQGNLCVNGQCKNTEGSFRCTCGQGYQLSAAKDQCEDIDECQHRHLCAHGQCRNTEGSFQCVCDQGYRASGLGDHCEDINECLEDKSVCQRGDCINTAGSYDCTCPDGFQLDDNKTCQDINECEHPGLCGPQGECLNTEGSFHCVCQQGFSISADGRTCEDVNECELLSGVCGEAFCENVEGSFLCVCADENQEYSPMTGQCRSRTSTDLDVDVDQPKEEKKECYYNLNDASLCDNVLAPNVTKQECCCTSGVGWGDNCEIFPCPVLGTAEFTEMCPKGKGFVPAGESSSEAGGENYKDADECLLFGQEICKNGFCLNTRPGYECYCKQGTYYDPVKLQCFDMDECQDPSSCIDGQCVNTEGSYNCFCTHPMVLDASEKRCIRPAESNEQIEETDVYQDLCWEHLSDEYVCSRPLVGKQTTYTECCCLYGEAWGMQCALCPLKDSDDYAQLCNIPVTGRRQPYGRDALVDFSEQYTPEADPYFIQDRFLNSFEELQAEECGILNGCENGRCVRVQEGYTCDCFDGYHLDTAKMTCVDVNECDELNNRMSLCKNAKCINTDGSYKCLCLPGYVPSDKPNYCTPLNTALNLEKDSDLE

SEQ ID NO: 8099 - protein, 1342 aa, Homo Sapiens
MDTKLMCLLFFFSLPPLLVSNHTGRIKVVFTPSICKVTCTKGSCQNSCEKGNTTTLISENGHAADTLTATNFRVVICHLPCMNGGQCSSRDKCQCPPNFTGKLCQIPVHGASVPKLYQHSQQPGKALGTHVIHSTHTLPLTVTSQQGVKVKFPPNIVNIHVKHPPEASVQIHQVSRIDGPTGQKTKEAQPGQSQVSYQGLPVQKTQTIHSTYSHQQVIPHVYPVAAKTQLGRCFQETIGSQCGKALPGLSKQEDCCGTVGTSWGFNKCQKCPKKPSYHGYNQMMECLPGYKRVNNTFCQDINECQLQGVCPNGECLNTMGSYRCTCKIGFGPDPTFSSCVPDPPVISEEKGPCYRLVSSGRQCMHPLSVHLTKQLCCCSVGKAWGPHCEKCPLPGTAKEEPVEALTFSREHGPGVAEPEVATAPPEKEIPSLDQEKTKLEPGQPQLSPGISTIHLHPQFPVVIEKTSPPVPVEVAPEASTSSASQVIAPTQVTEINECTVNPDICGAGHCINLPVRYTCICYEGYRFSEQQRKCVDIDECTQVQHLCSQGRCENTEGSFLCICPAGFMASEEGTNCIDVDECLRPDVCGEGHCVNTVGAFRCEYCDSGYRMTQRGRCEDIDECLNPSTCPDEQCVNSPGSYQCVPCTEGFRGWNGQCLDVDECLEPNVCANGDCSNLEGSYMCSCHKGYTRTPDHKHCRDIDECQQGNLCVNGQCKNTEGSFRCTCGQGYQLSAAKDQCEDIDECQHRHLCAHGQCRNTEGSFQCVCDQGYRASGLGDHCEDINECLEDKSVCQRGDCINTAGSYDCTCPDGFQLDDNKTCQDINECEHPGLCGPQGECLNTEGSFHCVCQQGFSISADGRTCEDIDECVNNTVCDSHGFCDNTAGSFRCLCYQGFQAPQDGQGCVDVNECELLSGVCGEAFCENVEGSFLCVCADENQEYSPMTGQCRSRTSTDLDVDVDQPKEEKKECYYNLNDASLCDNVLAPNVTKQECCCTSGVGWGDNCEIFPCPVLGTAEFTEMCPKGKGFVPAGESSSEAGGENYKDADECLLFGQEICKNGFCLNTRPGYECYCKQGTYYDPVKLQCFDMDECQDPSSCIDGQCVNTEGSYNCFCTHPMVLDASEKRCIRPAESNEQIEETDVYQDLCWEHLSDEYVCSRPLVGKQTTYTECCCLYGEAWGMQCALCPLKDSDDYAQLCNIPVTGRRQPYGRDALVDFSEQYTPEADPYFIQDRFLNSFEELQAEECGILNGCENGRCVRVQEGYTCDCFDGYHLDTAKMTCVDVNECDELNNRMSLCKNAKCINTDGSYKCLCLPGYVPSDKPNYCTPLNTALNLEKDSDLE

SEQ ID NO: 8100 - protein, 1340 aa, Homo Sapiens
MDTKLMCLLFFFSLPPLLVSNHTGRIKVVFTPSICKVTCTKGSCQNSCEKGNTTTLISENGHAADTLTATNFRVVICHLPCMNGGQCSSRDKCQCPPNFTGKLCQIPVHGASVPKLYQHSQQPGKALGTHVIHSTHTLPLTVTSQQGVKVKFPPNIVNIHVKHPPEASVQIHQVSRIDGPTGQKTKEAQPGQSQVSYQGLPVQKTQTIHSTYSHQQVIPHVYPVAAKTQLGRCFQETIGSQCGKALPGLSKQEDCCGTVGTSWGFNKCQKCPKKPSYHGYNQMMECLPGYKRVNNTFCQDINECQLQGVCPNGECLNTMGSYRCTCKIGFGPDPTFSSCVPDPPVISEEKGPCYRLVSSGRQCMHPLSVHLTKQLCCCSVGKAWGPHCEKCPLPGTAKEEPVEALTFSREHGPGVAEPEVATAPPEKEIPSLDQEKTKLEPGQPQLSPGISTIHLHPQFPVVIEKTSPPVPVEVAPEASTSSASQVIAPTQVTEINECTVNPDICGAGHCINLPVRYTCICYEGYRFSEQQRKCVDIDECTQVQHLCSQGRCENTEGSFLCICPAGFMASEEGTNCIDVDECLRPDVCGEGHCVNTVGAFRCEYCDSGYRMTQRGRCEDIDECLNPSTCPDEQCVNSPGSYQCVPCTEGFRGWNGQCLDVDECLEPNVCANGDCSNLEGSYMCSCHKGYTRTPDHKHCRDIDECQQGNLCVNGQCKNTEGSFRCTCGQGYQLSAAKDQCEDIDECQHRHLCAHGQCRNTEGSFQCVCDQGYRASGLGDHCEDINECLEDKSVCQRGDCINTAGSYDCTCPDGFQLDDNKTCQDINECEHPGLCGPQGECLNTEGSFHCVCQQGFSISADGRTCEDIDECVNNTVCDSHGFCDNTAGSFRCLCYQGFQAPQDGQGCVDVNECELLSGVCGEAFCENVEGSFLCVCADENQEYSPMTGQCRSRTSTDVDVDQPKEEKKECYYNLNDASLCDNVLAPNVTKQECCCTSGVGWGDNCEIFPCPVLGTAEFTEMCPKGKGFVPAGESSSEAGGENYKDADECLLFGQEICKNGFCLNTRPGYECYCKQGTYYDPVKLQCFDMDECQDPSSCIDGQCVNTEGSYNCFCTHPMVLDASEKRCIRPAESNEQIEETDVYQDLCWEHLSDEYVCSRPLVGKQTTYTECCCLYGEAWGMQCALCPLKDSDDYAQLCNIPVTGRRQPYGRDALVDFSEQYTPEADPYFIQDRFLNSFEELQAEECGILNGCENGRCVRVQEGYTCDCFDGYHLDTAKMTCVDVNECDELNNRMSLCKNAKCINTDGSYKCLCLPGYVPSDKPNYCTPLNTALNLEKDSDLE

SEQ ID NO: 8101 - protein, 219 aa, Homo Sapiens
MGSYRCTCKIGFGPDPTFSSCVPDPPVISEEKGPCYRLVSSGRQCMHPLSVHLTKQLCCCSVGKAWGPHCEKCPLPGTGKGPVFVKPKNTQPVAKSTHPPPLPAKEEPVEALTFSREHGPGVAEPEVATAPPEKEIPSLDQEKTKLEPGQPQLSPGISTIHLHPQFPVVIEKTSPPVPVEVAPEASTSSASQVIAPTQVTEINECTVNPDICGAGHCIN

SEQ ID NO: 8102 - protein, 101 aa, Homo Sapiens
MNGGQCSSRDKCQCPPNFTGKLCQIPVHGASVPKLYQHSQQPGKALGTHVIHSTHTLPLTVTSQQGVKVKFPPNIVNIHVKHPPEASVQIHQVSRIDGPTG

SEQ ID NO: 8103 - protein, 221 aa, Homo Sapiens
SSGRQCMHPLSVHLTKQLCCCSVGKAWGPHCEKCPLPGTAAFKEICPGGMGYTVSGVHRRRPIHHHVGKGPVFVKPKNTQPVAKSTHPPPLPAKEEPVEALTFSREHGPGVAEPEVATAPPEKEIPSLDQEKTKLEPGQPQLSPGISTIHLHPQFPGIVIEKTSPPVPVEVAPEASTSSASQVIAPTQVTEINECTVNPDICGAGHCINLPVRYTCICYEG

SEQ ID NO: 8104 - protein, 267 aa, Homo Sapiens
  misc_feature (1)..(1): Xaa can be any naturally occurring amino acid
XGRCEDIDECLNPSTCPDEQCVNSPGSYQCVPCTEGFRGWNGQCLDIDECQQGNLCVNGQCKNTEGSFRCTCGQGYQLSAAKDQCEDIDECQHRHLCAHGQCRNTEGSFQCVCDQGYRASGLGDHCEDINECLEDKSVCQRGDCINTAGSYDCTCPDGFQLDDNKTCQDINECEHPGLCGPQGECLNTEGSFHCVCQQGFSISADGRTCEDIDECVNNTVCDSHGFCDNTAGSFRCLCYQGFQAPQDGQGCVDVNECELLSGVCGEA

SEQ ID NO: 8105 - protein, 1821 aa, Homo Sapiens
MRPRTKARSPGRALRNPWRGFLPLTLALFVGAGHAQRDPVGRYEPAGGDANRLRRPGGSYPAAAAAKVYSLFREQDAPVAGLQPVERAQPGWGSPRRPTEAEARRPSRAQQSRRVQPPAQTRRSTPLGQQQPAPRTRAAPALPRLGTPQRSGAAPPTPPRGRLTGRNVCGGQCCPGWTTANSTNHCIKPVCEPPCQNRGSCSRPQLCVCRSGFRGARCEEVIPDEEFDPQNSRLAPRRWAERSPNLRRSSAAGEGTLARAQPPAPQSPPAPQSPPAGTLSGLSQTHPSQQHVGLSRTVRLHPTATASSQLSSNALPPGPGLEQRDGTQQAVPLEHPSSPWGLNLTEKIKKIKIVFTPTICKQTCARGHCANSCERGDTTTLYSQGGHGHDPKSGFRIYFCQIPCLNGGRCIGRDECWCPANSTGKFCHLPIPQPDREPPGRGSRPRALLEAPLKQSTFTLPLSNQLASVNPSLVKVHIHHPPEASVQIHQVAQVRGGVEEALVENSVETRPPPWLPASPGHSLWDSNNIPARSGEPPRPLPPAAPRPRGLLGRCYLNTVNGQCANPLLELTTQEDCCGSVGAFWGVTLCAPCPPRPASPVIENGQLECPQGYKRLNLTHCQDINECLTLGLCKDAECVNTRGSYLCTCRPGLMLDPSRSRCVSDKAISMLQGLCYRSLGPGTCTLPLAQRITKQICCCSRVGKAWGSECEKCPLPGTEAFREICPAGHGYTYASSDIRLSMRKAEEEELARPPREQGQRSSGALPGPAERQPLRVVTDTWLEAGTIPDKGDSQAGQVTTSVTHAPAWVTGNATTPPMPEQGIAEIQEEQVTPSTDVLVTLSTPGIDRCAAGATNVCGPGTCVNLPDGYRCVCSPGYQLHPSQAYCTDDNECLRDPCKGKGRCINRVGSYSCFCYPGYTLATSGATQECQDINECEQPGVCSGGQCTNTEGSYHCECDQGYIMVRKGHCQDINECRHPGTCPDGRCVNSPGSYTCLACEEGYRGQSGSCVDVNECLTPGVCAHGKCTNLEGSFRCSCEQGYEVTSDEKGCQDVDECASRASCPTGLCLNTEGSFACSACENGYWVNEDGTACEDLDECAFPGVCPSGVCTNTAGSFSCKDCDGGYRPSPLGDSCEDVDECEDPQSSCLGGECKNTVGSYQCLCPQGFQLANGTVCEDVNECMGEEHCAPHGECLNSHGSFFCLCAPGFVSAEGGTSCQDVDECATTDPCVGGHCVNTEGSFNCLCETGFQPSPESGECVDIDECEDYGDPVCGTWKCENSPGSYRCVLGCQPGFHMAPNGDCIDIDECANDTMCGSHGFCDNTDGSFRCLCDQGFEISPSGWDCVDVNECELMLAVCGAALCENVEGSFLCLCASDLEEYDAQEGHCRPRGAGGQSMSEAPTGDHAPAPTRMDCYSGQKGHAPCSSVLGRNTTQAECCCTQGASWGDACDLCPSEDSAEFSEICPSGKGYIPVEGAWTFGQTMYTDADECVIFGPGLCPNGRCLNTVPGYVCLCNPGFHYDASHKKCEDHDECQDLACENGECVNTEGSFHCFCSPPLTLDLSQQRCMNSTSSTEDLPDHDIHMDICWKKVTNDVCSEPLRGHRTTYTECCCQDGEAWSQQCALCPPRSSEVYAQLCNVARIEAEREAGVHFRPGYEYGPGPDDLHYSIYGPDGAPFYNYLGPEDTVPEPAFPNTAGHSADRTPILESPLQPSELQPHYVASHPEPPAGFEGLQAEECGILNGCENGRCVRVREGYTCDCFEGFQLDAAHMACVDVNECDDLNGPAVLCVHGYCENTEGSYRCHCSPGYVAEAGPPHCTAKE

SEQ ID NO: 8106 - protein, 1769 aa, Homo Sapiens
MRPRTKARSPGRALRNPWRGFLPLTLALFVGAGHAQRDPVGRYEPAGGDANRLRRPGGSYPAAAAAKVYSLFREQDAPVAGLQPVERAQPGWGSPRRPTEAEARRPSRAQQSRRVQPPAQTRRSTPLGQQQPAPRTRAAPALPRLGTPQRSGAAPPTPPRGRLTGRNVCGGQCCPGWTTANSTNHCIKPVCEPPCQNRGSCSRPQLCVCRSGFRGARCEEVIPDEEFDPQNSRLAPRRWAERSPNLRRSSAAGEGTLARAQPPAPQSPPAPQSPPAGTLSGLSQTHPSQQHVGLSRTVRLHPTATASSQLSSNALPPGPGLEQRDGTQQAVPLEHPSSPWGLNLTEKIKKIKIVFTPTICKQTCARGHCANSCERGDTTTLYSQGGHGHDPKSGFRIYFCQIPCLNGGRCIGRDECWCPANSTGKFCHLPIPQPDREPPGRGSRPRALLEAPLKQSTFTLPLSNQLASVNPSLVKVHIHHPPEASVQIHQVAQVRGGVEEALVENSVETRPPPWLPASPGHSLWDSNNIPARSGEPPRPLPPAAPRPRGLLGRCYLNTVNGQCANPLLELTTQEDCCGSVGAFWGVTLCAPCPPRPASPVIENGQLECPQGYKRLNLTHCQDINECLTLGLCKDAECVNTRGSYLCTCRPGLMLDPSRSRCVSDKAISMLQGLCYRSLGPGTCTLPLAQRITKQICCCSRVGKAWGSECEKCPLPGTEAFREICPAGHGYTYASSDIRLSMRKAEEEELARPPREQGQRSSGALPGPAERQPLRVVTDTWLEAGTIPDKGDSQAGQVTTSVTHAPAWVTGNATTPPMPEQGIAEIQEEQVTPSTDVLVTLSTPGIDRCAAGATNVCGPGTCVNLPDGYRCVCSPGYQLHPSQAYCTDDNECLRDPCKGKGRCINRVGSYSCFCYPGYTLATSGATQECQDINECEQPGVCSGGQCTNTEGSYHCECDQGYIMVRKGHCQDINECRHPGTCPDGRCVNSPGSYTCLACEEGYRGQSGSCVDVNECLTPGVCAHGKCTNLEGSFRCSCEQGYEVTSDEKGCQDVDECASRASCPTGLCLNTEGSFACSACENGYWVNEDGTACEDLDECAFPGVCPSGVCTNTAGSFSCKDCDGGYRPSPLGDSCEDVDECEDPQSSCLGGECKNTVGSYQCLCPQGFQLANGTVCEDVNECMGEEHCAPHGECLNSHGSFFCLCAPGFVSAEGGTSCQDVDECATTDPCVGGHCVNTEGSFNCLCETGFQPSPESGECVDIDECEDYGDPVCGTWKCENSPGSYRCVLGCQPGFHMAPNGDCIDIDECANDTMCGSHGFCDNTDGSFRCLCDQGFEISPSGWDCVDVNECELMLAVCGAALCENVEGSFLCLCASDLEEYDAQEGHCRPRGAGGQSMSEAPTGDHAPAPTRMDCYSGQKGHAPCSSVLGRNTTQAECCCTQGASWGDACDLCPSEDSAEFSEICPSGKGYIPVEGAWTFGQTMYTDADECVIFGPGLCPNGRCLNTVPGYVCLCNPGFHYDASHKKCEDHDECQDLACENGECVNTEGSFHCFCSPPLTLDLSQQRCMNSTSSTEDLPDHDIHMDICWKKVTNDVCSEPLRGHRTTYTECCCQDGEAWSQQCALCPPRSSEVYAQLCNVARIEAEREAGVHFRPGYEYGPGPDDLHYSIYGPDGAPFYNYLGPEDTVPEPAFPNTAGHSADRTPILESPLQPSELQPHYVASHPGLCCCKTGEEVGTKAVSLPSPPPASHIASRSPQPASKGFRRRSAAS

SEQ ID NO: 8107 - protein, 1777 aa, Homo Sapiens
MRPRTKARSPGRALRNPWRGFLPLTLALFVGAGHAQRDPVGRYEPAGGDANRLRRPGGSYPAAAAAKVYSLFREQDAPVAGLQPVERAQPGWGSPRRPTEAEARRPSRAQQSRRVQPPAQTRRSTPLGQQQPAPRTRAAPALPRLGTPQRSGAAPPTPPRGRLTGRNVCGGQCCPGWTTANSTNHCIKPVCEPPCQNRGSCSRPQLCVCRSGFRGARCEEVIPDEEFDPQNSRLAPRRWAERSPNLRRSSAAGEGTLARAQPPAPQSPPAPQSPPAGTLSGLSQTHPSQQHVGLSRTVRLHPTATASSQLSSNALPPGPGLEQRDGTQQAVPLEHPSSPWGLNLTEKIKKIKIVFTPTICKQTCARGHCANSCERGDTTTLYSQGGHGHDPKSGFRIYFCQIPCLNGGRCIGRDECWCPANSTGKFCHLPIPQPDREPPGRGSRPRALLEAPLKQSTFTLPLSNQLASVNPSLVKVHIHHPPEASVQIHQVAQVRGGVEEALVENSVETRPPPWLPASPGHSLWDSNNIPARSGEPPRPLPPAAPRPRGLLGRCYLNTVNGQCANPLLELTTQEDCCGSVGAFWGVTLCAPCPPRPASPVIENGQLECPQGYKRLNLTHCQDINECLTLGLCKDAECVNTRGSYLCTCRPGLMLDPSRSRCVSDKAISMLQGLCYRSLGPGTCTLPLAQRITKQICCCSRVGKAWGSECEKCPLPGTEAFREICPAGHGYTYASSDIRLSMRKAEEEELARPPREQGQRSSGALPGPAERQPLRVVTDTWLEAGTIPDKGDSQAGQVTTSVTHAPAWVTGNATTPPMPEQGIAEIQEEQVTPSTDVLVTLSTPGIDRCAAGATNVCGPGTCVNLPDGYRCVCSPGYQLHPSQAYCTDDNECLRDPCKGKGRCINRVGSYSCFCYPGYTLATSGATQECQDINECEQPGVCSGGQCTNTEGSYHCECDQGYIMVRKGHCQDINECRHPGTCPDGRCVNSPGSYTCLACEEGYRGQSGSCVDVNECLTPGVCAHGKCTNLEGSFRCSCEQGYEVTSDEKGCQDVDECASRASCPTGLCLNTEGSFACSACENGYWVNEDGTACEDLDECAFPGVCPSGVCTNTAGSFSCKDCDGGYRPSPLGDSCEDVDECEDPQSSCLGGECKNTVGSYQCLCPQGFQLANGTVCEDVNECMGEEHCAPHGECLNSHGSFFCLCAPGFVSAEGGTSCQDVDECATTDPCVGGHCVNTEGSFNCLCETGFQPSPESGECVDIDECANDTMCGSHGFCDNTDGSFRCLCDQGFEISPSGWDCVDVNECELMLAVCGAALCENVEGSFLCLCASDLEEYDAQEGHCRPRGAGGQSMSEAPTGDHAPAPTRMDCYSGQKGHAPCSSVLGRNTTQAECCCTQGASWGDACDLCPSEDSAEFSEICPSGKGYIPVEGAWTFGQTMYTDADECVIFGPGLCPNGRCLNTVPGYVCLCNPGFHYDASHKKCEDHDECQDLACENGECVNTEGSFHCFCSPPLTLDLSQQRCMNSTSSTEDLPDHDIHMDICWKKVTNDVCSEPLRGHRTTYTECCCQDGEAWSQQCALCPPRSSEVYAQLCNVARIEAEREAGVHFRPGYEYGPGPDDLHYSIYGPDGAPFYNYLGPEDTVPEPAFPNTAGHSADRTPILESPLQPSELQPHYVASHPEPPAGFEGLQAEECGILNGCENGRCVRVREGYTCDCFEGFQLDAAHMACVDVNECDDLNGPAVLCVHGYCENTEGSYRCHCSPGYVAEAGPPHCTAKE

SEQ ID NO: 8108 - protein, 233 aa, Homo Sapiens
  misc_feature (1)..(1): Xaa can be any naturally occurring amino acid
XTEGSFACSACENGYWVNEDGTACEDLDECAFPGVCPSGVCTNTAGSFSCKDCDGGYRPSPLGDSCEDVDECEDPQSSCLGGECKNTVGSYQCLCPQGFQLANGTVCEDVNECMGEEHCAPHGECLNSHGSFFCLCAPGFVSAEGGTSCQDIDECEDYGDPVCGTWKCENSPGSYRCVLGCQPGFHMAPNGDCIDIDECANDTMCGSHGFCDNTDGSFRCLCDQGFEISPSGW

SEQ ID NO: 8109 - protein, 144 aa, Homo Sapiens
FQDTLPKQPCGSNPLPGLTKQEDCCGSIGTAWGQSKCHKCPQLQYTGVQKPGPVRGEVGADCPQGYKRLNSTHCQADKPEEKSLCFRLVSPEHQCQHPLTTRLTRQLCCCSVGKAWGARCQRCPTDGTAAFKEICPAGKGYHIL

SEQ ID NO: 8110 - protein, 140 aa, Homo Sapiens
LNECAKPHLCGDGGFCINFPGHYKCNCYPGYRLKASRPPVCEDIDECRDPSSCPDGKCENKPGSFKCIACQPGYRSQGGGACRDVNECAEGSPCSPGWCENLPGSFRCTCAQGYAPAPDGRSCLGERQHPRPGPPPPPTR

SEQ ID NO: 8111 - protein, 124 aa, Homo Sapiens
MERAPERRDVCWSQRGEDGMCAGPLAGPALTFDDCCCRQGRGWGAQCRPCPPRGAGSHCPTSQSESNSFWDTSPLLLGKPPRDEDSSEEDSDECRCVSGRCVPRPGGAVCECPGGFQLDASRAR

SEQ ID NO: 8112 - protein, 306 aa, Homo Sapiens
MLFGSEICKEGKCVNTQPGYECYCKQGFYYDGNLLECVDVDECLDESNCRNGVCENTRGGYRCACTPPAEYSPAQRQCLSPEEMDVDECQDPAACRPGRCVNLPGSYRCECRPPWVPGPSGRDCQLPESPAERAPERRDVCWSQRGEDGMCAGPLAGPALTFDDCCCRQGRGWGAQCRPCPPRGAGSHCPTSQSESNSFWDTSPLLLGKPPRDEDSSEEDSDECRCVSGRCVPRPGGAVCECPGGFQLDASRARCVDIDECRELNQRGLLCKSERCVNTSGSFRCVCKAGFARSRPHGACVPQRRR

SEQ ID NO: 8113 - protein, 222 aa, Homo Sapiens
MLFGSEICKEGKCVNTQPGYECYCKQGFYYDGNLLECVDVDECLDESNCRNGVCENTRGGYRCACTPPAEYSPAQRQCLSPEEMERAPERRDVCWSQRGEDGMCAGPLAGPALTFDDCCCRQGRGWGAQCRPCPPRGAGSHCPTSQSESNSFWDTSPLLLGKPPRDEDSSEEDSDECRCVSGRCVPRPGGAVCECPGGFQLDASRARCVDIDECRELNQRGL

SEQ ID NO: 8114 - protein, 259 aa, Homo Sapiens
MLFGSEICKEGKCVNTQPGYECYCKQGFYYDGNLLECVDVDECLDESNCRNGVCENTRGGYRCACTPPAEYSPAQRQCLSPEEMERAPERRDVCWSQRGEDGMCAGPLAGPALTFDDCCCRQGRGWGAQCRPCPPRGAGSHCPTSQSESNSFWDTSPLLLGKPPRDEDSSEEDSDECRCVSGRCVPRPGGAVCECPGGFQLDASRARCVDIDECRELNQRGLLCKSERCVNTSGSFRCVCKAGFARSRPHGACVPQRRR

SEQ ID NO: 8115 - protein, 733 aa, Homo Sapiens
MPAETDECRLNQNICGHGECVPGPPDYSCHCNPGYRSHPQHRYCVDVNECEAEPCGPGRGICMNTGGSYNCHCNRGYRLHVGAGGRSCVDLNECAKPHLCGDGGFCINFPGHYKCNCYPGYRLKASRPPVCEDIDECRDPSSCPDGKCENKPGSFKCIACQPGYRSQGGGACRDVNECAEGSPCSPGWCENLPGSFRCTCAQGYAPAPDGRSCLDVDECEAGDVCDNGICSNTPGSFQCQCLSGYHLSRDRSHCEDIDECDFPAACIGGDCINTNGSYRCLCPQGHRLVGGRKCQDIDECSQDPSLCLPHGACKNLQGSYVCVCDEGFTPTQDQHGCEEVEQPHHKKECYLNFDDTVFCDSVLATNVTQQECCCSLGAGWGDHCEIYPCPVYSSAEFHSLCPDGKGYTQDNNIVNYGIPAHRDIDECMLFGSEICKEGKCVNTQPGYECYCKQGFYYDGNLLECVDVDECLDESNCRNGVCENTRGGYRCACTPPAEYSPAQRQCLSPEEMDVDECQDPAACRPGRCVNLPGSYRCECRPPWVPGPSGRDCQLPESPAERAPERRDVCWSQRGEDGMCAGPLAGPALTFDDCCCRQGRGWGAQCRPCPPRGAGSHCPTSQSESNSFWDTSPLLLGKPPRDEDSSEEDSDECRCVSGRCVPRPGGAVCECPGGFQLDASRARCVDIDECRELNQRGLLCKSERCVNTSGSFRCVCKAGFARSRPHGACVPQRRR

SEQ ID NO: 8116 - protein, 1256 aa, Homo Sapiens
MPGPRGAAGGLAPEMRGAGAAGLLALLLLLLLLLLGLGGRVEGGPAGERGAGGGGALARERFKVVFAPVICKRTCLKGQCRDSCQQGSNMTLIGENGHSTDTLTGSGFRVVVCPLPCMNGGQCSSRNQCLCPPDFTGRFCQVPAGGAGGGTGGSGPGLSRTGALSTGALPPLAPEGDSVASKHAIYAVQVIADPPGPGEGPPAQHAAFLVPLGPGQISAEVQAPPPVVNVRVHHPPEASVQVHRIESSNAESAAPSQHLLPHPKPSHPRPPTQKPLGRCFQDTLPKQPCGSNPLPGLTKQEDCCGSIGTAWGQSKCHKCPQLQYTGVQKPGPVRGEVGADCPQGYKRLNSTHCQDINECAMPGVCRHGDCLNNPGSYRCVCPPGHSLGPSRTQCIADKPEEKSLCFRLVSPEHQCQHPLTTRLTRQLCCCSVGKAWGARCQRCPTDGTAAFKEICPAGKGYHILTSHQTLTIQGESDFSLFLHPDGPPKPQQLPESPSQAPPPEDTEEERGVTTDSPVSEERSVQQSHPTATTTPARPYPELISRPSPPTMRWFLPDLPPSRSAVEIAPTQVTETDECRLNQNICGHGECVPGPPDYSCHCNPGYRSHPQHRYCVDVNECEAEPCGPGRGICMNTGGSYNCHCNRGYRLHVGAGGRSCVDLNECAKPHLCGDGGFCINFPGHYKCNCYPGYRLKASRPPVCEDIDECRDPSSCPDGKCENKPGSFKCIACQPGYRSQGGGACRDVNECAEGSPCSPGWCENLPGSFRCTCAQGYAPAPDGRSCLDVDECEAGDVCDNGICSNTPGSFQCQCLSGYHLSRDRSHCEDIDECDFPAACIGGDCINTNGSYRCLCPQGHRLVGGRKCQDIDECSQDPSLCLPHGACKNLQGSYVCVCDEGFTPTQDQHGCEEVEQPHHKKECYLNFDDTVFCDSVLATNVTQQECCCSLGAGWGDHCEIYPCPVYSSAEFHSLCPDGKGYTQDNNIVNYGIPAHRDIDECMLFGSEICKEGKCVNTQPGYECYCKQGFYYDGNLLECVDVDECLDESNCRNGVCENTRGGYRCACTPPAEYSPAQRQCLSPEEMERAPERRDVCWSQRGEDGMCAGPLAGPALTFDDCCCRQGRGWGAQCRPCPPRGAGSHCPTSQSESNSFWDTSPLLLGKPPRDEDSSEEDSDECRCVSGRCVPRPGGAVCECPGGFQLDASRARCVDIDECRELNQRGLLCKSERCVNTSGSFRCVCKAGFARSRPHGACVPQRRR

SEQ ID NO: 8117 - protein, 1303 aa, Homo Sapiens
MPGPRGAAGGLAPEMRGAGAAGLLALLLLLLLLLLGLGGRVEGGPAGERGAGGGGALARERFKVVFAPVICKRTCLKGQCRDSCQQGSNMTLIGENGHSTDTLTGSGFRVVVCPLPCMNGGQCSSRNQCLCPPDFTGRFCQVPAGGAGGGTGGSGPGLSRTGALSTGALPPLAPEGDSVASKHAIYAVQVIADPPGPGEGPPAQHAAFLVPLGPGQISAEVQAPPPVVNVRVHHPPEASVQVHRIESSNAESAAPSQHLLPHPKPSHPRPPTQKPLGRCFQDTLPKQPCGSNPLPGLTKQEDCCGSIGTAWGQSKCHKCPQLQYTGVQKPGPVRGEVGADCPQGYKRLNSTHCQDINECAMPGVCRHGDCLNNPGSYRCVCPPGHSLGPSRTQCIADKPEEKSLCFRLVSPEHQCQHPLTTRLTRQLCCCSVGKAWGARCQRCPTDGTAAFKEICPAGKGYHILTSHQTLTIQGESDFSLFLHPDGPPKPQQLPESPSQAPPPEDTEEERGVTTDSPVSEERSVQQSHPTATTTPARPYPELISRPSPPTMRWFLPDLPPSRSAVEIAPTQVTETDECRLNQNICGHGECVPGPPDYSCHCNPGYRSHPQHRYCVDVNECEAEPCGPGRGICMNTGGSYNCHCNRGYRLHVGAGGRSCVDLNECAKPHLCGDGGFCINFPGHYKCNCYPGYRLKASRPPVCEDIDECRDPSSCPDGKCENKPGSFKCIACQPGYRSQGGGACRDVNECAEGSPCSPGWCENLPGSFRCTCAQGYAPAPDGRSCLDVDECEAGDVCDNGICSNTPGSFQCQCLSGYHLSRDRSHCEDIDECDFPAACIGGDCINTNGSYRCLCPQGHRLVGGRKCQDIDECSQDPSLCLPHGACKNLQGSYVCVCDEGFTPTQDQHGCEEVEQPHHKKECYLNFDDTVFCDSVLATNVTQQECCCSLGAGWGDHCEIYPCPVYSSAEFHSLCPDGKGYTQDNNIVNYGIPAHRDIDECMLFGSEICKEGKCVNTQPGYECYCKQGFYYDGNLLECVDVDECLDESNCRNGVCENTRGGYRCACTPPAEYSPAQRQCLSPEEMDVDECQDPAACRPGRCVNLPGSYRCECRPPWVPGPSGRDCQLPESPAERAPERRDVCWSQRGEDGMCAGPLAGPALTFDDCCCRQGRGWGAQCRPCPPRGAGSHCPTSQSESNSFWDTSPLLLGKPPRDEDSSEEDSDECRCVSGRCVPRPGGAVCECPGGFQLDASRARCVDIDECRELNQRGLLCKSERCVNTSGSFRCVCKAGFARSRPHGACVPQRRR

SEQ ID NO: 8118 - protein, 116 aa, Homo Sapiens
MPGPRGAAGGLAPEMRGAGAAGLLALLLLLLLLLLGLGGRVEGGPAGERGAGGGGALARERFKVVFAPVICKRTCLKGQCRDSCQQGSNMTLIGENGHSTDTLTGSGFRWCALSPA

SEQ ID NO: 8119 - protein, 1137 aa, Homo Sapiens
MTLIGENGHSTDTLTGSGFRVVVCPLPCMNGGQCSSRNQCLCPPDFTGRFCQVPAGGAGGGTGGSGPGLSRTGALSTGALPPLAPEGDSVASKHAIYAVQVIADPPGPGEGPPAQHAAFLVPLGPGQISAEVQAPPPVVNVRVHHPPEASVQVHRIESSNAESAAPSQHLLPHPKPSHPRPPTQKPLGRCFQDTLPKQPCGSNPLPGLTKQEDCCGSIGTAWGQSKCHKCPQLQYTGVQKPGPVRGEVGADCPQGYKRLNSTHCQDINECAMPGVCRHGDCLNNPGSYRCVCPPGHSLGPSRTQCIADKPEEKSLCFRLVSPEHQCQHPLTTRLTRQLCCCSVGKAWGARCQRCPTDGTAAFKEICPAGKGYHILTSHQTLTIQGESDFSLFLHPDGPPKPQQLPESPSQAPPPEDTEEERGVTTDSPVSEERSVQQSHPTATTTPARPYPELISRPSPPTMRWFLPDLPPSRSAVEIAPTQVTETDECRLNQNICGHGECVPGPPDYSCHCNPGYRSHPQHRYCVDVNECEAEPCGPGRGICMNTGGSYNCHCNRGYRLHVGAGGRSCVDLNECAKPHLCGDGGFCINFPGHYKCNCYPGYRLKASRPPVCEDIDECRDPSSCPDGKCENKPGSFKCIACQPGYRSQGGGACRDVNECAEGSPCSPGWCENLPGSFRCTCAQGYAPAPDGRSCLDVDECEAGDVCDNGICSNTPGSFQCQCLSGYHLSRDRSHCEDIDECDFPAACIGGDCINTNGSYRCLCPQGHRLVGGRKCQDIDECSQDPSLCLPHGACKNLQGSYVCVCDEGFTPTQDQHGCEEVEQPHHKKECYLNFDDTVFCDSVLATNVTQQECCCSLGAGWGDHCEIYPCPVYSSAEFHSLCPDGKGYTQDNNIVNYGIPAHRDIDECMLFGSEICKEGKCVNTQPGYECYCKQGFYYDGNLLECVDVDECLDESNCRNGVCENTRGGYRCACTPPAEYSPAQRQCLSPEEMDVDECQDPAACRPGRCVNLPGSYRCECRPPWVPGPSGRDCQLPESPAERAPERRDVCWSQRGEDGMCAGPLAGPALTFDDCCCRQGRGWGAQCRPCPPRGAGSHCPTSQSESNSFWDTSPLLLGKPPRDEDSSEEDSDECRCVSG

SEQ ID NO: 8120 - protein, 907 aa, Homo Sapiens
  misc_feature (1)..(1): Xaa can be any naturally occurring amino acid
XFAPVICKRTCLKGQCRDSCQQGSNMTLIGENGHSTDTLTGSGFRVADKPEEKSLCFRLVSPEHQCQHPLTTRLTRQLCCCSVGKAWGARCQRCPTDGTAAFKEICPAGKGYHILTSHQTLTIQGESDFSLFLHPDGPPKPQQLPESPSQAPPPEDTEEERGVTTDSPVSEERSVQQSHPTATTTPARPYPELISRPSPPTMRWFLPDLPPSRSAVEIAPTQVTETDECRLNQNICGHGECVPGPPDYSCHCNPGYRSHPQHRYCVDVNECEAEPCGPGRGICMNTGGSYNCHCNRGYRLHVGAGGRSCVDLNECAKPHLCGDGGFCINFPGHYKCNCYPGYRLKASRPPVCEDIDECRDPSSCPDGKCENKPGSFKCIACQPGYRSQGGGACRDVNECAEGSPCSPGWCENLPGSFRCTCAQGYAPAPDGRSCLDVDECEAGDVCDNGICSNTPGSFQCQCLSGYHLSRDRSHCEDIDECDFPAACIGGDCINTNGSYRCLCPQGHRLVGGRKCQDIDECSQDPSLCLPHGACKNLQGSYVCVCDEGFTPTQDQHGCEEVEQPHHKKECYLNFDDTVFCDSVLATNVTQQECCCSLGAGWGDHCEIYPCPVYSSAEFHSLCPDGKGYTQDNNIVNYGIPAHRDIDECMLFGSEICKEGKCVNTQPGYECYCKQGFYYDGNLLECVDVDECLDESNCRNGVCENTRGGYRCACTPPAEYSPAQRQCLSPEEMERAPERRDVCWSQRGEDGMCAGPLAGPALTFDDCCCRQGRGWGAQCRPCPPRGAGSHCPTSQSESNSFWDTSPLLLGKPPRDEDSSEEDSDECRCVSGRCVPRPGGAVCECPGGFQLDASRARCVDIDECRELNQRGLLCKSERCVNTSGSFRCVCKAGFARSRPHGACVPQRRR

SEQ ID NO: 8121 - protein, 69 aa, Homo Sapiens
  misc_feature (1)..(1): Xaa can be any naturally occurring amino acid
XFAPVICKRTCLKGQCRDSCQQGSNMTLIGENGHSTDTLTGSGFRVGPAPRGECARPSPARGLSPGAPH

SEQ ID NO: 8122 - protein, 303 aa, Homo Sapiens
ECLNTDGSFACTCAPGYRPGPRGASCLDVDECSEEDLCQSGICTNTDGSFECICPPGHRAGPDLASCLDVDECRERGPALCGSQRCENSPGSYRCVRDCDPGYHAGPEGTCDDVNECETLQGVCGAALCENVEGSFLCVCPNSPEEFDPMTGRCVPPRTSADVDECQLFRDQVCKSGVCVNTAPGYSCYCSNGYYYHTQRLECIDNDECADEEPACEGGRCVNTVGSYHCTCEPPLVLDGSQRRCVSNESQSLDDNLGVCWQEVGADLVCSHPRLDRQATYTECCCLYGEAWGMDCALCPAQD

SEQ ID NO: 8123 - protein, 1557 aa, Homo Sapiens
MAGGVRLLWVSLLVLLAQLGPQPGLGRLGERLRVRFTPVVCGLRCVHGPTGSRCTPTCAPRNATSVDSGAPGGAAPGGPGFRAFLCPLICHNGGVCVKPDRCLCPPDFAGKFCQLHSSGARPPAPAVPGLTRSVYTMPLANHRDDEHGVASMVSVHVEHPQEASVVVHQVERVSGPWEEADAEAVARAEAAARAEAAAPYTVLAQSAPREDGYSDASGFGYCFRELRGGECASPLPGLRTQEVCCRGAGLAWGVHDCQLCSERLGNSERVSAPDGPCPTGFERVNGSCEDVDECATGGRCQHGECANTRGGYTCVCPDGFLLDSSRSSCISQHVISEAKGPCFRVLRDGGCSLPILRNITKQICCCSRVGKAWGRGCQLCPPFGSEGFREICPAGPGYHYSASDLRYNTRPLGQEPPRVSLSQPRTLPATSRPSAGFLPTHRLEPRPEPRPDPRPGPELPLPSIPAWTGPEIPESGPSSGMCQRNPQVCGPGRCISRPSGYTCACDSGFRLSPQGTRCIDVDECRRVPPPCAPGRCENSPGSFRCVCGPGFRAGPRAAECLDVDECHRVPPPCDLGRCENTPGSFLCVCPAGYQAAPHGASCQDVDECTQSPGLCGRGACKNLPGSFRCVCPAGFRGSACEEDVDECAQEPPPCGPGRCDNTAGSFHCACPAGFRSRGPGAPCQDVDECARSPPPCTYGRCENTEGSFQCVCPMGFQPNTAGSECEDVDECENHLACPGQECVNSPGSFQCRTCPSGHHLHRGRCTDVDECSSGAPPCGPHGHCTNTEGSFRCSCAPGYRAPSGRPGPCADVNECLEGDFCFPHGECLNTDGSFACTCAPGYRPGPRGASCLDVDECSEEDLCQSGICTNTDGSFECICPPGHRAGPDLASCLDVDECRERGPALCGSQRCENSPGSYRCVRDCDPGYHAGPEGTCDDVDECQEYGPEICGAQRCENTPGSYRCTPACDPGYQPTPGGGCQDVDECRNRSFCGAHAVCQNLPGSFQCLCDQGYEGARDGRHCVDVNECETLQGVCGAALCENVEGSFLCVCPNSPEEFDPMTGRCVPPRTSAGTFPGSQPQAPASPVLPARPPPPPLPRRPSTPRQGPVGSGRRECYFDTAAPDACDNILARNVTWQECCCTVGEGWGSGCRIQQCPGTETAEYQSLCPHGRGYLAPSGDLSLRRDVDECQLFRDQVCKSGVCVNTAPGYSCYCSNGYYYHTQRLECIDNDECADEEPACEGGRCVNTVGSYHCTCEPPLVLDGSQRRCVSNESQSLDDNLGVCWQEVGADLVCSHPRLDRQATYTECCCLYGEAWGMDCALCPAQDSDDFEALCNVLRPPAYSPPRPGGFGLPYEYGPDLGPPYQGLPYGPELYPPPALPYDPYPPPPGPFARREAPYGAPRFDMPDFEDDGGPYGESEAPAPPGPGTRWPYRSRDTRRSFPEPEEPPEGGSYAGSLAEPYEELEAEECGILDGCTNGRCVRVPEGFTCRCFDGYRLDMTRMACVDINECDEAEAASPLCVNARCLNTDGSFRCICRPGFAPTHQPHHCAPARPRA

SEQ ID NO: 8124 - protein, 44 aa, Homo Sapiens
MGDVKALLFVAAARARRLGGAAASEPSAGSEAASPKSVQAPSGA

SEQ ID NO: 8125 - protein, 1587 aa, Homo Sapiens
MGDVKALLFVAAARARRLGGAAASESLAVSEAFCRVRSCQPKKCAGPQRCLNPVPAVPSPSPSVRKRQVSLNWQPLTLQEARALLKRRRPRGPGGRGLLRRRPPQRAPAGKAPVLCPLICHNGGVCVKPDRCLCPPDFAGKFCQLHSSGARPPAPAVPGLTRSVYTMPLANHRDDEHGVASMVSVHVEHPQEASVVVHQVERVSGPWEEADAEAVARAEAAARAEAAAPYTVLAQSAPREDGYSDASGFGYCFRELRGGECASPLPGLRTQEVCCRGAGLAWGVHDCQLCSERLGNSERVSAPDGPCPTGFERVNGSCEDVDECATGGRCQHGECANTRGGYTCVCPDGFLLDSSRSSCISQHVISEAKGPCFRVLRDGGCSLPILRNITKQICCCSRVGKAWGRGCQLCPPFGSEGFREICPAGPGYHYSASDLRYNTRPLGQEPPRVSLSQPRTLPATSRPSAGFLPTHRLEPRPEPRPDPRPGPELPLPSIPAWTGPEIPESGPSSGMCQRNPQVCGPGRCISRPSGYTCACDSGFRLSPQGTRCIDVDECRRVPPPCAPGRCENSPGSFRCVCGPGFRAGPRAAECLDVDECHRVPPPCDLGRCENTPGSFLCVCPAGYQAAPHGASCQDVDECTQSPGLCGRGACKNLPGSFRCVCPAGFRGSACEEDVDECAQEPPPCGPGRCDNTAGSFHCACPAGFRSRGPGAPCQDVDECARSPPPCTYGRCENTEGSFQCVCPMGFQPNTAGSECEDVDECENHLACPGQECVNSPGSFQCRTCPSGHHLHRGRCTDVDECSSGAPPCGPHGHCTNTEGSFRCSCAPGYRAPSGRPGPCADVNECLEGDFCFPHGECLNTDGSFACTCAPGYRPGPRGASCLDVDECSEEDLCQSGICTNTDGSFECICPPGHRAGPDLASCLDVDECRERGPALCGSQRCENSPGSYRCVRDCDPGYHAGPEGTCDDVDECQEYGPEICGAQRCENTPGSYRCTPACDPGYQPTPGGGCQDVDECRNRSFCGAHAVCQNLPGSFQCLCDQGYEGARDGRHCVDVNECETLQGVCGAALCENVEGSFLCVCPNSPEEFDPMTGRCVPPRTSAGTFPGSQPQAPASPVLPARPPPPPLPRRPSTPRQGPVGSGRRECYFDTAAPDACDNILARNVTWQECCCTVGEGWGSGCRIQQCPGTETAEYQSLCPHGRGYLAPSGDLSLRRDVDECQLFRDQVCKSGVCVNTAPGYSCYCSNGYYYHTQRLECIDNDECADEEPACEGGRCVNTVGSYHCTCEPPLVLDGSQRRCVSNESQSLDDNLGVCWQEVGADLVCSHPRLDRQATYTECCCLYGEAWGMDCALCPAQDSDDFEALCNVLRPPAYSPPRPGGFGLPYEYGPDLGPPYQGLPYGPELYPPPALPYDPYPPPPGPFARREAPYGAPRFDMPDFEDDGGPYGESEAPAPPGPGTRWPYRSRDTRRSFPEPEEPPEGGSYAGSLAEPYEELEAEECGILDGCTNGRCVRVPEGFTCRCFDGYRLDMTRMACVDINECDEAEAASPLCVNARCLNTDGSFRCICRPGFAPTHQPHHCAPARPRA

SEQ ID NO: 8126 - protein, 44 aa, Homo Sapiens
MLQPQALLFVAAARARRLGGAAASEPSAGSEAASPKSVQAPSGA

SEQ ID NO: 8127 - protein, 1624 aa, Homo Sapiens
MPRPGTSGRRPLLLVLLLPLFAAATSAASPSPSPSQVVEVPGVPSRPASVAVCRCCPGQTSRRSRCIRAFCRVRSCQPKKCAGPQRCLNPVPAVPSPSPSVRKRQVSLNWQPLTLQEARALLKRRRPRGPGGRGLLRRRPPQRAPAGKAPVLCPLICHNGGVCVKPDRCLCPPDFAGKFCQLHSSGARPPAPAVPGLTRSVYTMPLANHRDDEHGVASMVSVHVEHPQEASVVVHQVERVSGPWEEADAEAVARAEAAARAEAAAPYTVLAQSAPREDGYSDASGFGYCFRELRGGECASPLPGLRTQEVCCRGAGLAWGVHDCQLCSERLGNSERVSAPDGPCPTGFERVNGSCEDVDECATGGRCQHGECANTRGGYTCVCPDGFLLDSSRSSCISQHVISEAKGPCFRVLRDGGCSLPILRNITKQICCCSRVGKAWGRGCQLCPPFGSEGFREICPAGPGYHYSASDLRYNTRPLGQEPPRVSLSQPRTLPATSRPSAGFLPTHRLEPRPEPRPDPRPGPELPLPSIPAWTGPEIPESGPSSGMCQRNPQVCGPGRCISRPSGYTCACDSGFRLSPQGTRCIDVDECRRVPPPCAPGRCENSPGSFRCVCGPGFRAGPRAAECLDVDECHRVPPPCDLGRCENTPGSFLCVCPAGYQAAPHGASCQDVDECTQSPGLCGRGACKNLPGSFRCVCPAGFRGSACEEDVDECAQEPPPCGPGRCDNTAGSFHCACPAGFRSRGPGAPCQDVDECARSPPPCTYGRCENTEGSFQCVCPMGFQPNTAGSECEDVDECENHLACPGQECVNSPGSFQCRTCPSGHHLHRGRCTDVDECSSGAPPCGPHGHCTNTEGSFRCSCAPGYRAPSGRPGPCADVNECLEGDFCFPHGECLNTDGSFACTCAPGYRPGPRGASCLDVDECSEEDLCQSGICTNTDGSFECICPPGHRAGPDLASCLDVDECRERGPALCGSQRCENSPGSYRCVRDCDPGYHAGPEGTCDDVDECQEYGPEICGAQRCENTPGSYRCTPACDPGYQPTPGGGCQDVDECRNRSFCGAHAVCQNLPGSFQCLCDQGYEGARDGRHCVDVNECETLQGVCGAALCENVEGSFLCVCPNSPEEFDPMTGRCVPPRTSAGTFPGSQPQAPASPVLPARPPPPPLPRRPSTPRQGPVGSGRRECYFDTAAPDACDNILARNVTWQECCCTVGEGWGSGCRIQQCPGTETAEYQSLCPHGRGYLAPSGDLSLRRDVDECQLFRDQVCKSGVCVNTAPGYSCYCSNGYYYHTQRLECIDNDECADEEPACEGGRCVNTVGSYHCTCEPPLVLDGSQRRCVSNESQSLDDNLGVCWQEVGADLVCSHPRLDRQATYTECCCLYGEAWGMDCALCPAQDSDDFEALCNVLRPPAYSPPRPGGFGLPYEYGPDLGPPYQGLPYGPELYPPPALPYDPYPPPPGPFARREAPYGAPRFDMPDFEDDGGPYGESEAPAPPGPGTRWPYRSRDTRRSFPEPEEPPEGGSYAGSLAEPYEELEAEECGILDGCTNGRCVRVPEGFTCRCFDGYRLDMTRMACVDINECDEAEAASPLCVNARCLNTDGSFRCICRPGFAPTHQPHHCAPARPRA

SEQ ID NO: 8128 - protein, 70 aa, Homo Sapiens
MSARTAPFSWSGGKLRPKDQETLASGHTSWKALLFVAAARARRLGGAAASEPSAGSEAASPKSVQAPSGA

SEQ ID NO: 8129 - protein, 145 aa, Homo Sapiens
PPGPGTRWPYRSRDTRRSFPEPEEPPEGGSYAGSLAEPYEELEAEECGILDGCTNGRCVRVPEGFTCRCFDGYRLDMTRMACVAFSSDRCLPSADINECDEAEAASPLCVNARCLNTDGSFRCICRPGFAPTHQPHHCAPARPRA

SEQ ID NO: 8130 - protein, 252 aa, Homo Sapiens
  misc_feature (1)..(1): Xaa can be any naturally occurring amino acid
XFRCSCAPGYRAPSGRPGPCADVNECLEGDFCFPHGECLNTDGSFACTCAPGYRPGPRGASCLDVDECSEEDLCQSGICTNTDGSFECICPPGHRAGPDLASCLDVDECRERGPALCGSQRCENSPGSYRCVRDCDPGYHAGPEGTCDDVDECRNRSFCGAHAVCQNLPGSFQCLCDQGYEGARDGRHCVDVNECETLQGVCGAALCENVEGSFLCVCPNSPEEFDPMTGRCVPPRTSAGTFPGSQPQAPAS

SEQ ID NO: 8131 - protein, 182 aa, Homo Sapiens
  misc_feature (1)..(1): Xaa can be any naturally occurring amino acid
XGPEICGAQRCENTPGSYRCTPACDPGYQPTPGGGCQDVDECRNRSFCGAHAVCQNLPGSFQCLCDQGYEGARDGRHCVDVNECETLQGVCGAALCENVEGSFLCVCPNSPEEFDPMTGRCVPPRTSADVDECQLFRDQVCKSGVCVNTAPGYSCYCSNGYYYHTQRLECIDNDECADEEPA

SEQ ID NO: 8132 - protein, 224 aa, Homo Sapiens
  misc_feature (1)..(1): Xaa can be any naturally occurring amino acid
XNTDGSFACTCAPGYRPGPRGASCLDVDECSEEDLCQSGICTNTDGSFECICPPGHRAGPDLASCLDVDECRERGPALCGSQRCENSPGSYRCVRDCDPGYHAGPEGTCDDVDECQEYGPEICGAQRCENTPGSYRCTPACDPGYQPTPGGGCQDVNECETLQGVCGAALCENVEGSFLCVCPNSPEEFDPMTGRCVPPRTSAGTFPGSQPQAPASPVLPARPP

SEQ ID NO: 8133 - protein, 674 aa, Homo Sapiens
  misc_feature (1)..(1): Xaa can be any naturally occurring amino acid
XNTEGSFQCVCPMGFQPNTAGSECEDVDECENHLACPGQECVNSPGSFQCRTCPSGHHLHRGRCTDVDECSSGAPPCGPHGHCTNTEGSFRCSCAPGYRAPSGRPGPCADVNECLEGDFCFPHGECLNTDGSFACTCAPGYRPGPRGASCLDVDECSEEDLCQSGICTNTDGSFECICPPGHRAGPDLASCLDVDECRERGPALCGSQRCENSPGSYRCVRDCDPGYHAGPEGTCDDVNECETLQGVCGAALCENVEGSFLCVCPNSPEEFDPMTGRCVPPRTSAGTFPGSQPQAPASPVLPARPPPPPLPRRPSTPRQGPVGSGRRECYFDTAAPDACDNILARNVTWQECCCTVGEGWGSGCRIQQCPGTETAEYQSLCPHGRGYLAPSGDLSLRRDVDECQLFRDQVCKSGVCVNTAPGYSCYCSNGYYYHTQRLECIDNDECADEEPACEGGRCVNTVGSYHCTCEPPLVLDGSQRRCVSNESQSLDDNLGVCWQEVGADLVCSHPRLDRQATYTECCCLYGEAWGMDCALCPAQDSDDFEALCNVLRPPAYSPPRPGGFGLPYEYGPDLGPPYQGLPYGPELYPPPALPYDPYPPPPGPFARREAPYGAPRFDMPDFEDDGGPYGESEAPAPPGPGTRWPYRSRDTRRSFPEPEEPPEGGSYAGSLAEP

SEQ ID NO: 8134 - protein, 94 aa, Homo Sapiens
  misc_feature (1)..(1): Xaa can be any naturally occurring amino acid
XRFDMPDFEDDGGPYGESEAEECGILDGCTNGRCVRVPEGFTCRCFDGYRLDMTRMACVDINECDEAEAASPLCVNARCLNTDGSFRCICRPGF

SEQ ID NO: 8135 - protein, 957 aa, Homo Sapiens
  misc_feature (1)..(1): Xaa can be any naturally occurring amino acid
XVDECRRVPPPCAPGRCENSPGSFRCVCGPGFRAGPRAAECLDVDECHRVPPPCDLGRCENTPGSFLCVCPAGYQAAPHGASCQDVDECARSPPPCTYGRCENTEGSFQCVCPMGFQPNTAGSECEDVDECENHLACPGQECVNSPGSFQCRTCPSGHHLHRGRCTDVDECSSGAPPCGPHGHCTNTEGSFRCSCAPGYRAPSGRPGPCADVNECLEGDFCFPHGECLNTDGSFACTCAPGYRPGPRGASCLDVDECSEEDLCQSGICTNTDGSFECICPPGHRAGPDLASCLDVDECRERGPALCGSQRCENSPGSYRCVRDCDPGYHAGPEGTCDDVDECQEYGPEICGAQRCENTPGSYRCTPACDPGYQPTPGGGCQDVDECRNRSFCGAHAVCQNLPGSFQCLCDQGYEGARDGRHCVDVNECETLQGVCGAALCENVEGSFLCVCPNSPEEFDPMTGRCVPPRTSAGTFPGSQPQAPASPVLPARPPPPPLPRRPSTPRQGPVGSGRRECYFDTAAPDACDNILARNVTWQECCCTVGEGWGSGCRIQQCPGTETAEYQSLCPHGRGYLAPSGDLSLRRDVDECQLFRDQVCKSGVCVNTAPGYSCYCSNGYYYHTQRLECIDNDECADEEPACEGGRCVNTVGSYHCTCEPPLVLDGSQRRCVSNESQSLDDNLGVCWQEVGADLVCSHPRLDRQATYTECCCLYGEAWGMDCALCPAQDSDDFEALCNVLRPPAYSPPRPGGFGLPYEYGPDLGPPYQGLPYGPELYPPPALPYDPYPPPPGPFARREAPYGAPRFDMPDFEDDGGPYGESEAPAPPGPGTRWPYRSRDTRRSFPEPEEPPEGGSYAGSLAEPYEELEAEECGILDGCTNGRCVRVPEGFTCRCFDGYRLDMTRMACVDINECDEAEAASPLCVNARCLNTDGSFRCICRPGFAPTHQPHHCAPARPRA

SEQ ID NO: 8136 - protein, 191 aa, Homo Sapiens
  misc_feature (1)..(1): Xaa can be any naturally occurring amino acid
XVDECSEEDLCQSGICTNTDGSFECICPPGHRAGPDLASCLDVDECRERGPALCGSQRCENSPGSYRCVRDCDPGYHAGPEGTCDDVDECQEYGPEICGAQRCENTPGSYRCTPACDPGYQPTPGGGCQDVNECETLQGVCGAALCENVEGSFLCVCPNSPEEFDPMTGRCVPPRTSADVDECQLFRDQVC

SEQ ID NO: 8137 - protein, 189 aa, Homo Sapiens
  misc_feature (1)..(1): Xaa can be any naturally occurring amino acid
XVDECSEEDLCQSGICTNTDGSFECICPPGHRAGPDLASCLDVDECRERGPALCGSQRCENSPGSYRCVRDCDPGYHAGPEGTCDDVDECRNRSFCGAHAVCQNLPGSFQCLCDQGYEGARDGRHCVDVNECETLQGVCGAALCENVEGSFLCVCPNSPEEFDPMTGRCVPPRTSAGTFPGSQPQAPAS

SEQ ID NO: 8138 - protein, 416 aa, Homo Sapiens
MEATGISLASQLKVPPYASENQTCRDQEKEYYEPQHRICCSRCPPGTYVSAKCSRIRDTVCATCAENSYNEHWNYLTICQLCRPCDPVMGLEEIAPCTSKRKTQCRCQPGMFCAAWALECTHCELLSDCPPGTEAELKDEVGKGNNHCVPCKAGHFQNTSSPSARCQPHTRCENQGLVEAAPGTAQSDTTCKNPLEPLPPEMSGTMLMLAVLLPLAFFLLLATVFSCIWKSHPSLCRKLGSLLKRRPQGEGPNPVAGSWEPPKAHPYFPDLVQPLLPISGDVSPVSTGLPAAPVLEAGVPQQQSPLDLTREPQLEPGEQSQVAHGTNGIHVTGGSMTITGNIYIYNGPVLGGPPGPGDLPATPEPPYPIPEEGDPGPPGLSTPHQEDGKAWHLAETEHCGATPSNRGPRNQFITHD

SEQ ID NO: 8139 - protein, 148 aa, Homo Sapiens
MGLEEIAPCTSKRKTQCRCQPGMFCAAWALECTHCELLSDCPPGTEAELKDEVGKGNNHCVPCKAGHFQNTSSPSARCQPHTRCENQGLVEAAPGTAQSDTTCKNPLEPLPPEMSEPALSKGVENLQALLYQAATGSSEASFPTLSPL

SEQ ID NO: 8140 - protein, 292 aa, Homo Sapiens
MGLEEIAPCTSKRKTQCRCQPGMFCAAWALECTHCELLSDCPPGTEAELKDEVGKGNNHCVPCKAGHFQNTSSPSARCQPHTRCENQGLVEAAPGTAQSDTTCKNPLEPLPPEMSGSLLKRRPQGEGPNPVAGSWEPPKAHPYFPDLVQPLLPISGDVSPVSTGLPAAPVLEAGVPQQQSPLDLTREPQLEPGEQSQVAHGTNGIHVTGGSMTITGNIYIYNGPVLGGPPGPGDLPATPEPPYPIPEEGDPGPPGLSTPHQEDGKAWHLAETEHCGATPSNRGPRNQFITHD

SEQ ID NO: 8141 - protein, 74 aa, Homo Sapiens
MGLEEIAPCTSKRKTQCRCQPGMFCAAWALECTHCELLSDCPPGTEAELKGVRTKVWWRQLQALPSPTQPAKIH

SEQ ID NO: 8142 - protein, 218 aa, Homo Sapiens
MLLPWATSAPGLAWGPLVLGLFGLLAASQPQAVPPYASENQTCRDQEKEYYEPQHRICCSRCPPAKCSRIRDTVCATCAENSYNEHWNYLTICQLCRPCDPVMGLEEIAPCTSKRKTQCRCQPGMFCAAWALECTHCELLSDCPPGTEAELKDEVGKGNNHCVPCKAGHFQNTSSPSARCQPHTRCENQGLVEAAPGTAQSDTTCKNPLEPLPPEMSG

SEQ ID NO: 8143 - protein, 435 aa, Homo Sapiens
MLLPWATSAPGLAWGPLVLGLFGLLAASQPQAVPPYASENQTCRDQEKEYYEPQHRICCSRCPPGTYVSAKCSRIRDTVCATCAENSYNEHWNYLTICQLCRPCDPVMGLEEIAPCTSKRKTQCRCQPGMFCAAWALECTHCELLSDCPPGTEAELKDEVGKGNNHCVPCKAGHFQNTSSPSARCQPHTRCENQGLVEAAPGTAQSDTTCKNPLEPLPPEMSGTMLMLAVLLPLAFFLLLATVFSCIWKSHPSLCRKLGSLLKRRPQGEGPNPVAGSWEPPKAHPYFPDLVQPLLPISGDVSPVSTGLPAAPVLEAGVPQQQSPLDLTREPQLEPGEQSQVAHGTNGIHVTGGSMTITGNIYIYNGPVLGGPPGPGDLPATPEPPYPIPEEGDPGPPGLSTPHQEDGKAWHLAETEHCGATPSNRGPRNQFITHD

SEQ ID NO: 8144 - protein, 696 aa, Homo Sapiens
MGLCLAGRRRSVQWCAVSQPEATKCFQWQRNMRKVRGPPVSCIKRDSPIQCIQAIAENRADAVTLDGGFIYEAGLAPYKLRPVAAEVYGTERQPRTHYYAVAVVKKGGSFQLNELQGLKSCHTGLRRTAGWNVPIGTLRPFLNWTGPPEPIEAAVARFFSASCVPGADKGQFPNLCRLCAGTGENKCAFSSQEPYFSYSGAFKCLRDGAGDVAFIRESTVFEDLSDEAERDEYELLCPDNTRKPVDKFKDCHLARVPSHAVVARSVNGKEDAIWNLLRQAQEKFGKDKSPKFQLFGSPSGQKDLLFKDSAIGFSRVPPRIDSGLYLGSGYFTAIQNLRKSEEEVAARRARVVWCAVGEQELRKCNQWSGLSEGSVTCSSASTTEDCIALVLKGEADAMSLDGGYVYTAGKCGLVPVLAENYKSQQSSDPDPNCVDRPVEGYLAVAVVRRSDTSLTWNSVKGKKSCHTAVDRTAGWNIPMGLLFNQTGSCKFDEYFSQSCAPGSDPRSNLCALCIGDEQGENKCVPNSNERYYGYTGAFRCLAENAGDVAFVKDVTVLQNTDGNNNEAWAKDLKLADFALLCLDGKRKPVTEARSCHLAMAPNHAVVSRMDKVERLKQVLLHQQAKFGRNGSDCPDKFCLFQSETKNLLFNDNTECLARLHGKTTYEKYLGPQYVAGITNLKKCSTSPLLEACEFLR

SEQ ID NO: 8145 - protein, 182 aa, Homo Sapiens
MKLVFLVLLFLGALGFLWMPFIRQPGLCLAGRRRSVQWCAVSQPEATKCFQWQRNMRKVRGPPVSCIKRDSPIQCIQAIAENRADAVTLDGGFIYEAGLAPYKLRPVAAEVYGTERQPRTHYYAVAVVKKGGSFQLNELQGLKSCHTGLRRTAGWNVPIGTLRPFLNWTGPPEPIEAAVARF

SEQ ID NO: 8146 - protein, 710 aa, Homo Sapiens
MKLVFLVLLFLGALGLCLAGRRRSVQWCAVSQPEATKCFQWQRNMRKVRGPPVSCIKRDSPIQCIQAIAENRADAVTLDGGFIYEAGLAPYKLRPVAAEVYGTERQPRTHYYAVAVVKKGGSFQLNELQGLKSCHTGLRRTAGWNVPIGTLRPFLNWTGPPEPIEAAVARFFSASCVPGADKGQFPNLCRLCAGTGENKCAFSSQEPYFSYSGAFKCLRDGAGDVAFIRESTVFEDLSDEAERDEYELLCPDNTRKPVDKFKDCHLARVPSHAVVARSVNGKEDAIWNLLRQAQEKFGKDKSPKFQLFGSPSGQKDLLFKDSAIGFSRVPPRIDSGLYLGSGYFTAIQNLRKSEEEVAARRARVVWCAVGEQELRKCNQWSGLSEGSVTCSSASTTEDCIALVLKGEADAMSLDGGYVYTAGKCGLVPVLAENYKSQQSSDPDPNCVDRPVEGYLAVAVVRRSDTSLTWNSVKGKKSCHTAVDRTAGWNIPMGLLFNQTGSCKFDEYFSQSCAPGSDPRSNLCALCIGDEQGENKCVPNSNERYYGYTGAFRCLAENAGDVAFVKDVTVLQNTDGNNNEAWAKDLKLADFALLCLDGKRKPVTEARSCHLAMAPNHAVVSRMDKVERLKQVLLHQQAKFGRNGSDCPDKFCLFQSETKNLLFNDNTECLARLHGKTTYEKYLGPQYVAGITNLKKCSTSPLLEACEFLRK

SEQ ID NO: 8147 - protein, 708 aa, Homo Sapiens
MKLVFLVLLFLGALGLCLAGRRRSVQWCAVSQPEATKCFQWQRNMRKVRGPPVSCIKRDSPIQCIQAIAENRADAVTLDGGFIYEAGLAPYKLRPVAAEVYGTERQPRTHYYAVAVVKKGGSFQLNELQGLKSCHTGLRRTAGWNVPIGTLRPFLNWTGPPEPIEAAVARFFSASCVPGADKGQFPNLCRLCAGTGENKCAFSSQEPYFSYSGAFKCLRDGAGDVAFIRESTVFEDLSDEAERDEYELLCPDNTRKPVDKFKDCHLARVPSHAVVARSVNGKEDAIWNLLRQAQEKFGKDKSPKFQLFGSPSGQKDLLFKDSAIGFSRVPPRIDSGLYLGSGYFTAIQNLRKSEEEVAARRARVVWCAVGEQELRKCNQWSGLSEGSVTCSSASTTEDCIALKGEADAMSLDGGYVYTAGKCGLVPVLAENYKSQQSSDPDPNCVDRPVEGYLAVAVVRRSDTSLTWNSVKGKKSCHTAVDRTAGWNIPMGLLFNQTGSCKFDEYFSQSCAPGSDPRSNLCALCIGDEQGENKCVPNSNERYYGYTGAFRCLAENAGDVAFVKDVTVLQNTDGNNNEAWAKDLKLADFALLCLDGKRKPVTEARSCHLAMAPNHAVVSRMDKVERLKQVLLHQQAKFGRNGSDCPDKFCLFQSETKNLLFNDNTECLARLHGKTTYEKYLGPQYVAGITNLKKCSTSPLLEACEFLRK

SEQ ID NO: 8148 - protein, 666 aa, Homo Sapiens
MRKVRGPPVSCIKRDSPIQCIQAIAENRADAVTLDGGFIYEAGLAPYKLRPVAAEVYGTERQPRTHYYAVAVVKKGGSFQLNELQGLKSCHTGLRRTAGWNVPIGTLRPFLNWTGPPEPIEAAVARFFSASCVPGADKGQFPNLCRLCAGTGENKCAFSSQEPYFSYSGAFKCLRDGAGDVAFIRESTVFEDLSDEAERDEYELLCPDNTRKPVDKFKDCHLARVPSHAVVARSVNGKEDAIWNLLRQAQEKFGKDKSPKFQLFGSPSGQKDLLFKDSAIGFSRVPPRIDSGLYLGSGYFTAIQNLRKSEEEVAARRARVVWCAVGEQELRKCNQWSGLSEGSVTCSSASTTEDCIALVLKGEADAMSLDGGYVYTAGKCGLVPVLAENYKSQQSSDPDPNCVDRPVEGYLAVAVVRRSDTSLTWNSVKGKKSCHTAVDRTAGWNIPMGLLFNQTGSCKFDEYFSQSCAPGSDPRSNLCALCIGDEQGENKCVPNSNERYYGYTGAFRCLAENAGDVAFVKDVTVLQNTDGNNNEAWAKDLKLADFALLCLDGKRKPVTEARSCHLAMAPNHAVVSRMDKVERLKQVLLHQQAKFGRNGSDCPDKFCLFQSETKNLLFNDNTECLARLHGKTTYEKYLGPQYVAGITNLKKCSTSPLLEACEFLRK

SEQ ID NO: 8149 - protein, 864 aa, Homo Sapiens
MGCWGQLLVWFGAAGAILCSSPGSQETFLRSSPLPLASPSPRDPKVSAPPSILEPASPLNSPGTEGSWLFSTCGASGRHGPTQTQCDGAYAGTSVVVTVGAAGQLRGVQLWRVPGPGQYLISAYGAAGGKGAKNHLSRAHGVFVSAIFSLGLGESLYILVGQQGEDACPGGSPESQLVCLGESRAVEEHAAMDGSEGVPGSRRWAGGGGGGGGATYVFRVRAGELEPLLVAAGGGGRAYLRPRDRGRTQASPEKLENRSEAPGSGGRGGAAGGGGGWTSRAPSPQAGRSLQEGAEGGQGCSEAWATLGWAAAGGFGGGGGACTAGGGGGGYRGGDASETDNLWADGEDGVSFIHPSSELFLQPLAVTENHGEVEIRRHLNCSHCPLRDCQWQAELQLAECLCPEGMELAVDNVTCMDLHKPPGPLVLMVAVVATSTLSLLMVCGVLILVKQKKWQGLQEMRLPSPELELSKLRTSAIRTAPNPYYCQVGLGPAQSWPLPPGVTEVSPANVTLLRALGHGAFGEVYEGLVIGLPGDSSPLQVAIKTLPELCSPQDELDFLMEALIISKFRHQNIVRCVGLSLRATPRLILLELMSGGDMKSFLRHSRPHLGQPSPLVMRDLLQLAQDIAQGCHYLEENHFIHRDIAARNCLLSCAGPSRVAKIGDFGMARDIYRASYYRRGDRALLPVKWMPPEAFLEGIFTSKTDSWSFGVLLWEIFSLGYMPYPGRTNQEVLDFVVGGGRMDPPRGCPGPVYRIMTQCWQHEPELRPSFASILERLQYCTQDPDVLNSLLPMELGPTPEEEGTSGLGNRSLECLRPPQPQELSPEKLKSWGGSPLGPWLSSGLKPLKSRGLQPQNLWNPTYRS

SEQ ID NO: 8150 - protein, 803 aa, Homo Sapiens
MGCWGQLLVWFGAAGAILCSSPGSQETFLRSSPLPLASPSPRDPKVSAPPSILEPASPLNSPGTEGSWLFSTCGASGRHGPTQTQCDGAYAGTSVVVTVGAAGQLRGVQLWRVPGPGQYLISAYGAAGGKGAKNHLSRAHGVFVSAIFSLGLGESLYILVGQQGEDACPGGSPESQLVCLGESRAVEEHAAMDGSEGVPGSRRWAGGGGGGGGATYVFRVRAGELEPLLVAAGGGGRAYLRPRDRGRTQASPEKLENRSEAPGSGGRGGAAGGDASETDNLWADGEDGVSFIHPSSELFLQPLAVTENHGEVEIRRHLNCSHCPLRDCQWQAELQLAECLCPEGMELAVDNVTCMDLHKPPGPLVLMVAVVATSTLSLLMVCGVLILVKQKKWQGLQEMRLPSPELELSKLRTSAIRTAPNPYYCQVGLGPAQSWPLPPGVTEVSPANVTLLRALGHGAFGEVYEGLVIGLPGDSSPLQVAIKTLPELCSPQDELDFLMEALIISKFRHQNIVRCVGLSLRATPRLILLELMSGGDMKSFLRHSRPHLGQPSPLVMRDLLQLAQDIAQGCHYLEENHFIHRDIAARNCLLSCAGPSRVAKIGDFGMARDIYRASYYRRGDRALLPVKWMPPEAFLEGIFTSKTDSWSFGVLLWEIFSLGYMPYPGRTNQEVLDFVVGGGRMDPPRGCPGPVYRIMTQCWQHEPELRPSFASILERLQYCTQDPDVLNSLLPMELGPTPEEEGTSGLGNRSLECLRPPQPQELSPEKLKSWGGSPLGPWLSSGLKPLKSRGLQPQNLWNPTYRS

SEQ ID NO: 8151 - protein, 734 aa, Homo Sapiens
MGCWGQLLVWFGAAGAILCSSPGSQETFLRSSPLPLASPSPRDPKVSAPPSILEPASPLNSPGTEGSWLFSTCGASGRHGPTQTQCDGAYAGTSVVVTVGAAGQLRGVQLWRVPGPGQYLISAYGAAGGKGAKNHLSRAHGVFVSAIFSLGLGESLYILVGQQGEDACPGGSPESQLVCLGESRAVEEHAAMDGSEGVPGSRRWAGGGGGGGGATYVFRVRAGELEPLLVAAGGGGRAYLRPRDRGRTQASPEKLENRSEAPGSGGRGGAAGGDASETDNLWADGEDGVSFIHPSSELFLQPLAVTENHGEVEIRRHLNCSHCPLRDCQWQAELQLAECLCPEGMELAVDNVTCMDLHKPPGPLVLMVAVVATSTLSLLMVCGVLILGGAWPGPVLASATRCHRGFPSQCYSAQTLPELCSPQDELDFLMEALIISKFRHQNIVRCVGLSLRATPRLILLELMSGGDMKSFLRHSRPHLGQPSPLVMRDLLQLAQDIAQGCHYLEENHFIHRDIAARNCLLSCAGPSRVAKIGDFGMARDIYRASYYRRGDRALLPVKWMPPEAFLEGIFTSKTDSWSFGVLLWEIFSLGYMPYPGRTNQEVLDFVVGGGRMDPPRGCPGPVYRIMTQCWQHEPELRPSFASILERLQYCTQDPDVLNSLLPMELGPTPEEEGTSGLGNRSLECLRPPQPQELSPEKLKSWGGSPLGPWLSSGLKPLKSRGLQPQNLWNPTYRS

SEQ ID NO: 8152 - protein, 562 aa, Homo Sapiens
MGCWGQLLVWFGAAGGDASETDNLWADGEDGVSFIHPSSELFLQPLAVTENHGEVEIRRHLNCSHCPLRDCQWQAELQLAECLCPEGMELAVDNVTCMDLHKPPGPLVLMVAVVATSTLSLLMVCGVLILGTKRLAGTVDSRLLLSMKQKKWQGLQEMRLPSPELELSKLRTSAIRTAPNPYYCQVGLGPAQSWPLPPGVTEVSPANVTLLRALGHGAFGEVYEGLVIGLPGDSSPLQVAIKTLPELCSPQDELDFLMEALIISKFRHQNIVRCVGLSLRATPRLILLELMSGGDMKSFLRHSRPHLGQPSPLVMRDLLQLAQDIAQGCHYLEENHFIHRDIAARNCLLSCAGPSRVAKIGDFGMARDIYRASYYRRGDRALLPVKWMPPEAFLEGIFTSKTDSWSFGVLLWEIFSLGYMPYPGRTNQEVLDFVVGGGRMDPPRGCPGPVYRIMTQCWQHEPELRPSFASILERLQYCTQDPDVLNSLLPMELGPTPEEEGTSGLGNRSLECLRPPQPQELSPEKLKSWGGSPLGPWLSSGLKPLKSRGLQPQNLWNPTYRS

SEQ ID NO: 8153 - protein, 338 aa, Homo Sapiens
MSLSAFTLFLALIGGTSGQYYDYDFPLSIYGQSSPNCAPECNCPESYPSAMYCDELKLKSVPMVPPGIKYLYLRNNQIDHIDEKAFENVTDLQWLILDHNLLENSKIKGRVFSKLKQLKKLHINHNNLTESVGPLPKSLEDLQLTHNKITKLGSFEGLVNLTFIHLQHNRLKEDAVSAAFKGLKSLEYLDLSFNQIARLPSGLPVSLLTLYLDNNKISNIPDEYFKRFNALQYLRLSHNELADSGIPGNSFNVSSLVELDLSYNKLKNIPTVNENLENYYLEVNQLEKFDIKSFCKILGPLSYSKIKHLRLDGNRISETSLPPDMYECLRVANEVTLN

SEQ ID NO: 8154 - protein, 176 aa, Homo Sapiens
MKFSPAHYLLPLLPALVLSTRQDYEELEKQLKEVFKERSTILRQLTKTSRELDGIKVNLQSLKNDEQSAKTDVQKLLELGQKQREEMKSLQEALQNQLKETSEKAEKHQATINFLKTEVERKSKMIRDLQNEAQQLTDLEQKLAVAKNELEKAALDRESQMKAMKETVQLCLTSVF

SEQ ID NO: 8155 - protein, 346 aa, Homo Sapiens
MKFSPAHYLLPLLPALVLSTRQDYEELEKQLKEVFKERSTILRQLTKTSRELDGIKVNLQSLKNDEQSAKTDVQKLLELGQKQREEMKSLQEALQNQLKETSEKAEKHQATINFLKTEVERKSKMIRDLQNENKSLKNKLLSGNKLCGIHAEESKKIQAQLKELRYGKKDLLFKAQQLTDLEQKLAVAKNELEKAALDRESQMKAMKETVQLCLTSVFRDQPPPPLSLITSNPTRMLLPPRNIASKLPDAAAKSKPQQSASGNNESSQVESTKEGNPSTTACDSQDEGRPCSMKHKESPPSNATAETEPIPQKLQMPPCSECEVKKAPEKPLTSFEGMAAREEKIL

SEQ ID NO: 8156 - protein, 260 aa, Homo Sapiens
MKSLQEALQNQLKETSEKAEKHQATINFLKTEVERKSKMIRDLQNENKSLKNKLLSGNKLCGIHAEESKKIQAQLKELRYGKKDLLFKAQQLTDLEQKLAVAKNELEKAALDRESQMKAMKETVQLCLTSVFRDQPPPPLSLITSNPTRMLLPPRNIASKLPDAAAKSKPQQSASGNNESSQVESTKEGNPSTTACDSQDEGRPCSMKHKESPPSNATAETEPIPQKLQMPPCSECEVKKAPEKPLTSFEGMAAREEKIL

SEQ ID NO: 8157 - protein, 260 aa, Homo Sapiens; identical to SEQ ID NO: 8156

SEQ ID NO: 8158 - protein, 978 aa, Homo Sapiens
MGPPSSSGFYVSRAVALLLAGLVAALLLALAVLAALYGHCERVPPSELPGLRDLEAESSPPLRQKPTPTPKPSSARELAVTTTPSNWRPPGPWDQLRLPPWLVPLHYDLELWPQLRPDELPAGSLPFTGRVNITVRCTVATSRLLLHSLFQDCERAEVRGPLSPDDVWFALDTEYMVLELSEPLKPGSSYELQLSFSGLVKEDLREGLFLNVYTDQGERRALLASQLEPTFARYVFPCFDEPALKATFNITMIHHPSYVALSNMPKLGQSEKEDVNGSKWTVTTFSTTPHMPTYLVAFVICDYDHVNRTERGKEIRIWARKDAIANGSADFALNITGPIFSFLEDLFNISYSLPKTDIIALPSFDNHAMENWGLMIFDESGLLLEPKDQLTEKKTLISYVVSHEIGHQWFGNLVTMNWWNNIWLNEGFASYFEFEVINYFNPKLPRNEIFFSNILHNILREDHALVTRAVAMKVENFKTSEIQELFDIFTYSKGASMARMLSCFLNEHLFVSALKSYLKTFSYSNAEQDDLWRHFQMAIDDQSTVILPATIKNIMDSWTHQSGFPVITLNVSTGVMKQEPFYLENIKNRTLLTSNDTWIVPILWIKNGTTQPLVWLDQSSKVFPEMQVSDSDHDWVILNLNMTGYYRVNYDKLGWKKLNQQLEKDPKAIPVIHRLQLIDDAFSLSKNNYIEIETALELTKYLAEEDEIIVWHTVLVNLVTRDLVSEVNIYDIYSLLKRYLLKRLNLIWNIYSTIIRENVLALQDDYLALISLEKLFVTACWLGLEDCLQLSKELFAKWVDHPENEIPYPIKDVVLCYGIALGSDKEWDILLNTYTNTTNKEEKIQLAYAMSCSKDPWILNRYMEYAISTSPFTSNETNIIEVVASSEVGRYVAKDFLVNNWQAVSKRYGTQSLINLIYTIGRTVTTDLQIVELQQFFSNMLEEHQRIRVHANLQTIKNENLKNKKLSARIAAWLRRNT

SEQ ID NO: 8159 - protein, 990 aa, Homo Sapiens
MGPPSSSGFYVSRAVALLLAGLVAALLLALAVLAALYGHCERVPPSELPGLRDLEAESSPPLRQKPTPTPKPSSARELAVTTTPSNWRPPGPWDQLRLPPWLVPLHYDLELWPQLRPDELPAGSLPFTGRVNITVRCTVATSRLLLHSLFQDCERAEVRGPLSPGTGNATVGRVPVDDVWFALDTEYMVLELSEPLKPGSSYELQLSFSGLVKEDLREGLFLNVYTDQGERRALLASQLEPTFARYVFPCFDEPALKATFNITMIHHPSYVALSNMPKLGQSEKEDVNGSKWTVTTFSTTPHMPTYLVAFVICDYDHVNRTERGKEIRIWARKDAIANGSADFALNITGPIFSFLEDLFNISYSLPKTDIIALPSFDNHAMENWGLMIFDESGLLLEPKDQLTEKKTLISYVVSHEIGHQWFGNLVTMNWWNNIWLNEGFASYFEFEVINYFNPKLPRNEIFFSNILHNILREDHALVTRAVAMKVENFKTSEIQELFDIFTYSKGASMARMLSCFLNEHLFVSALKSYLKTFSYSNAEQDDLWRHFQMAIDDQSTVILPATIKNIMDSWTHQSGFPVITLNVSTGVMKQEPFYLENIKNRTLLTSNDTWIVPILWIKNGTTQPLVWLDQSSKVFPEMQVSDSDHDWVILNLNMTGYYRVNYDKLGWKKLNQQLEKDPKAIPVIHRLQLIDDAFSLSKNNYIEIETALELTKYLAEEDEIIVWHTVLVNLVTRDLVSEVNIYDIYSLLKRYLLKRLNLIWNIYSTIIRENVLALQDDYLALISLEKLFVTACWLGLEDCLQLSKELFAKWVDHPENEIPYPIKDVVLCYGIALGSDKEWDILLNTYTNTTNKEEKIQLAYAMSCSKDPWILNRYMEYAISTSPFTSNETNIIEVVASSEVGRYVAKDFLVNNWQAVSKRYGTQSLINLIYTIGRTVTTDLQIVELQQFFSNMLEEHQRIRVHANLQTIKNENLKNKKLSARIAAWLRRNT

SEQ ID NO: 8160 - protein, 701 aa, Homo Sapiens
MGPPSSSGFYVSRAVALLLAGLVAALLLALAVLAALYGHCERVPPSELPGLRDLEAESSPPLRQKPTPTPKPSSARELAVTTTPSNWRPPGPWDQLRLPPWLVPLHYDLELWPQLRPDELPAGSLPFTGRVNITVRCTVATSRLLLHSLFQDCERAEVRGPLSPGTGNATVGRVPVDDVWFALDTEYMVLELSEPLKPGSSYELQLSFSGLVKEDLREGLFLNVYTDQGERRALLASQLEPTFARYVFPCFDEPALKATFNITMIHHPSYVALSNMPKLGQSEKEDVNGSKWTVTTFSTTPHMPTYLVAFVICDYDHVNRTERGKEIRIWARKDAIANGSADFALNITGPIFSFLEDLFNISYSLPKTDIIALPSFDNHAMENWGLMIFDESGLLLEPKDQLTEKKTLISYVVSHEIGHQWFGNLVTMNWWNNIWLNEGFASYFEFEVINYFNPKLPRNEIFFSNILHNILREDHALVTRAVAMKVENFKTSEIQELFDIFTYSKGASMARMLSCFLNEHLFVSALKSYLKTFSYSNAEQDDLWRHFQMAIDDQSTVILPATIKNIMDSWTHQSGFPVITLNVSTGVMKQEPFYLENIKNRTLLTSNDTWIVPILWIKNGTTQPLVWLDQSSKVFPEMQVSDSDHDWVILNLNMTGYYRVNYDKLGWKKLNQQLEKDPKAIPVIHRLQLIDDAFSLSKGTY

SEQ ID NO: 8161 - protein, 226 aa, Homo Sapiens
MKVENFKTSEIQELFDIFTYSKGASMARMLSCFLNEHLFVSALKSYLKTFSYSNAEQDDLWRHFQMAIDDQSTVILPATIKNIMDSWTHQSGFPVITLNVSTGVMKQEPFYLENIKNRTLLTSNDTWIVPILWIKNGTTQPLVWLDQSSKVFPEMQVSDSDHDWVILNLNMTGYYRVNYDKLGWKKLNQQLEKDPKAIPVIHRLQLIDDAFSLSNLQDFGHLKVPN

SEQ ID NO: 8162 - protein, 198 aa, Homo Sapiens
MKVENFKTSEIQELFDIFTYSKGASMARMLSCFLNEHLFVSALKSYLKTFSYSNAEQDDLWRHFQMAIDDQSTVILPATIKNIMDSWTHQSGFPVITLNVSTGVMKQEPFYLENIKNRTLLTSNDTWIVPILWIKNGTTQPLVWLDQSSKVFPEMQVSDSDHDWVILNLNMTGYYRVNYDKLGWKKLNQQLEKDPKMR

SEQ ID NO: 8163 - protein, 198 aa, Homo Sapiens; identical to SEQ ID NO: 8162

SEQ ID NO: 8164 - protein, 66 aa, Homo Sapiens
MKIFLPVLLAALLGVERASSLMCFSCLNQKSNLYCLKPTICSDQDNYCVTVSASAGIASFPMQGIS

SEQ ID NO: 8165 - protein, 66 aa, Homo Sapiens; identical to SEQ ID NO: 8164

SEQ ID NO: 8166 - protein, 73 aa, Homo Sapiens
MKIFLPVLLAALLGVERASSLMCFSCLNQKSNLYCLKPTICSDQDNYCVTVSASAGIGECQASDRAFLPWPSP

SEQ ID NO: 8167 - protein, 66 aa, Homo Sapiens
MKIFLPVLLAALLGVERASSLMCFSCLNQKSNLYCLKPTICSDQDNYCVTVSASAGIGGFAGGTDS

SEQ ID NO: 8168 - protein, 131 aa, Homo Sapiens
MKIFLPVLLAALLGVERASSLMCFSCLNQKSNLYCLKPTICSDQDNYCVTVSASAGIGNLVTFGHSLSKTCSPACPIPEGVNVGVASMGISCCQSFLCNFSAADGGLRASVTLLGAGLLLSLLPALLRFGP

SEQ ID NO: 8169 - protein, 131 aa, Homo Sapiens; identical to SEQ ID NO: 8168

SEQ ID NO: 8170 - protein, 131 aa, Homo Sapiens; identical to SEQ ID NO: 8168

SEQ ID NO: 8171 - protein, 131 aa, Homo Sapiens; identical to SEQ ID NO: 8168

SEQ ID NO: 8172 - protein, 131 aa, Homo Sapiens; identical to SEQ ID NO: 8168

SEQ ID NO: 8173 - protein, 131 aa, Homo Sapiens; identical to SEQ ID NO: 8168

SEQ ID NO: 8174 - protein, 131 aa, Homo Sapiens; identical to SEQ ID NO: 8168

SEQ ID NO: 8175 - protein, 41 aa, Homo Sapiens
MKIFLPVLLAALLGVEREEQSVLPEADHLLRPGQLLRDCVC

SEQ ID NO: 8176 - protein, 41 aa, Homo Sapiens; identical to SEQ ID NO: 8175

SEQ ID NO: 8177 - protein, 147 aa, Homo Sapiens
MTSGIPGCGGACVLPSRAPLRRRDPQHCSPTLSEAPLLRAHTQTRLLTRGLPTPNTTRTVQVSVTVTPTWSPVRPRQDRLLWFVTSRQDGHPLQNEDLLASAAGCPSGCGASQLADVLLLLEPEEQSVLPEADHLLRPGQLLRDCVC

SEQ ID NO: 8178 - protein, 201 aa, Homo Sapiens
MKVHMLVGVLVMVGFTVGKVPVPDIRTCHFCLVEDPSVGCISGSEKCTISSSSLCMVITIYYDVKVRFIVRGCGQYISYRCQEKRNTYFAEYWYQAQCCQYDYCNSWSSPQLQSSLPEPHDRPLALPLSDSQIQWFYQALNLSLPLPNFHAGTEPDGLDPMVTLSLNLGLSFAELRRMYLFLNSSGLLVLPQAGLLTPHPS

SEQ ID NO: 8179 - protein, 146 aa, Homo Sapiens
MVITIYYDVKVRFIVRGCGQYISYRCQEKRNTYFAEYWYQAQCCQYDYCNSWSSPQLQSSLPEPHDRPLALPLSDSQIQWFYQALNLSLPLPNFHAGTEPDGLDPMVTLSLNLGLSFAELRRMYLFLNSSGLLVLPQAGLLTPHPS

SEQ ID NO: 8180 - protein, 133 aa, Homo Sapiens
MKPQFVGILLSSLLGAALGNRMRCYNCGGSPSSSCKEAVTTCGEGRPQPGLEQIKLPGNPPVTLIHQHPACVAAHHCNQVETESVGDVTYPAHRDCYLGDLCNSAVASHVAPAGILAAAATALTCLLPGLWSG

SEQ ID NO: 8181 - protein, 174 aa, Homo Sapiens
MKPQFVGILLSSLLGAALGNRMRCYNCGGSPSSSCKEAVTTCGEGRPQPGLEQIKLPGNRRCFLRGLKIPLGSLKSHLLCPRRQVLKPGVQHPSFILSLSPSDLDSPTSSLRRSPSLQSSGDRVGGRRDLSSPQGLLPGRPVQQRRGKPCGPCRHFGCSSYRPDLSLARTVERI

SEQ ID NO: 8182 - protein, 66 aa, Homo Sapiens
MGTSSIFLCVLFLCGALGLTMSPARGRLRCYICGFTKPCHPVPTECRDDEACGISIGTSDQSEITE

SEQ ID NO: 8183 - protein, 125 aa, Homo Sapiens
MGTSSIFLCVLFLCGALGLTMSPARGRLRCYICGFTKPCHPVPTECRDDEACGISIGTSGKSCLSRAQCPLPGYATYWLHSYTLWHHCCEQDLCNIAASPQQLTSLLASLPLFVASFAGRGHLLH

SEQ ID NO: 8184 - protein, 100 aa, Homo Sapiens
MGTSSIFLCVLFLCGALGLTMSPARGRLRCYICGFTKPCHPVPTECRDDEACGISIGTSGRTLVQWPFSRRLPTSIHPAFPVAPASACLFHPTDQSEITE

SEQ ID NO: 8185 - protein, 88 aa, Homo Sapiens
MLQLYKSRDLGVQITSPRFLSLCLAMGTSSIFLCVLFLCGALGLTMSPARGRLRCYICGFTKPCHPVPTECRDDEACGISIGTSDAHC

SEQ ID NO: 8186 - protein, 161 aa, Homo Sapiens
MLAPQRTRAPSPRAAPRPTRSMLPAAMKGLGLALLAVLLCSAPAHGLWCQDCTLTTNSSHCTPKQCQPSDTVCASVRITDPSSSRKDHSVNKMCASSCDFVKRHFFSDYLMGFINSGILKVDVDCCEKDLCNGAAGAGHSPWALAGGLLLSLGPALLWAGP

SEQ ID NO: 8187 - protein, 161 aa, Homo Sapiens; identical to SEQ ID NO: 8186

SEQ ID NO: 8188 - protein, 140 aa, Homo Sapiens
MLPAAMKGLGLALLAVLLCSAPAHGLWCQDCTLTTNSSHCTPKQCQPSDTVCASVRITDPSSSRKDHSVNKMCASSCDFVKRHFFSDYLMGFINSGILKVDVDCCEKDLCNGAAGAGHSPWALAGGLLLSLGPALLWAGP

SEQ ID NO: 8189 - protein, 140 aa, Homo Sapiens; identical to SEQ ID NO: 8188

SEQ ID NO: 8190 - protein, 165 aa, Homo Sapiens
MALLALLLVVALPRVWTDANLTARQRDPEDSQRTDEGDNRVWCHVCERENTFECQNPRRCKWTEPYCVIAAVKIFPRFFMVAKQCSAGCAAMERPKPEEKRFLLEEPMPFFYLKCCKIRYCNLEGPPINSSVFKEYAGSMGESCGGLWLAILLLLASIAAGLSLS

SEQ ID NO: 8191 - protein, 100 aa, Homo Sapiens
MALLALLLVVALPRVWTDANLTARQRDPEDSQRTDEGDNRVWCHVCERENTFECQNPRRCKWTEPYCVIAAVRRSSGLVNSDSAQQSLSSPSVSTKLVGC

SEQ ID NO: 8192 - protein, 85 aa, Homo Sapiens
MALLALLLVVALPRVWTDANLTARQRDPEDSQRTDEGDNRVWCHVCERENTFECQNPRRCKWTEPYCVIAAVSEYLRSCWGPKGR

SEQ ID NO: 8193 - protein, 105 aa, Homo Sapiens
MALLALLLVVALPRVWTDANLTARQRDPEDSQRTDEGDNRVWCHVCERENTFECQNPRRCKWTEPYCVIAAVTVLRWLCSDGETQARGEAVSPGRAHALLLPQVL

SEQ ID NO: 8194 - protein, 138 aa, Homo Sapiens
MERLVLTLCTLPLAVASAGCATTPARNLSCYQCFKVSSWTECPPTWCSPLDQVCISNEVVVSFKWSVRVLLSKRCAPRCPNDNMKFEWSPAPMVQGVITRRCCSWALCNRALTPQEGRWALRGGLLLQVGLSLLRALL

SEQ ID NO: 8195 - protein, 162 aa, Homo Sapiens
MKGFTATLFLWTLIFPSCSGGGGGKAWPTHVVCSDSGLEVLYQSCDPLQDFGFSVEKCSKQLKSNINIRFGIILREDIKELFLDLALMSQGSSVLNFSYPICEAALPKFSFCGRRKGEQIYYAGPVNNPEFTIPQGEYQVLLELYTEKRSTVACANATIMCS

SEQ ID NO: 8196 - protein, 162 aa, Homo Sapiens; identical to SEQ ID NO: 8195

SEQ ID NO: 8197 - protein, 160 aa, Homo Sapiens [sequence omitted]

SEQ ID NO: 8198 - protein, 130 aa, Homo Sapiens
MLPFLFFSTLFSSIFTEAQKQYWVCNSSDASISYTYCGRDLKQLYFNLYITVNTMNLPKRKEVICRGSDDDYSFCRALKGETVNTTISFSFKGIKFSKGKYKCVVEAISGSPEEMLFCLEFVILHQPNSN

SEQ ID NO: 8199 - protein, 194 aa, Homo Sapiens
MSALWLLLGLLALMDLSESSNWGCYGNIQSLDTPGASCGIGRRHGLNYCGVRASERLAEIDMPYLLKYQPMMQTIGQKYCMDPAVIAGVLSRKSPGDKILVNMGDRTSMVQDPGSQAPTSWISESQVSQTTEVLTTRIKEIQRRFPTWTPDQYLRGGLCAYSGGAGYVRSSQDLSCDFCNDVLARAKYLKRHGF

SEQ ID NO: 8200 - protein, 194 aa, Homo Sapiens; identical to SEQ ID NO: 8199

SEQ ID NO: 8201 - protein, 169 aa, Homo Sapiens
MLSSVVFWGLIALIGTSRGSYPFSHSMKPHLHPRLYHGCYGDIMTMKTSGATCDANSVMNCGIRGSEMFAEMDLRAIKPYQTLIKEVGQRHCVDPAVIAAIISRESHGGSVLQDGWDHRGLKFGLMQLDKQTYHPVGAWDSKEHLSQATGILTERIKAIQKKFPTWSVA

SEQ ID NO: 8202 - protein, 178 aa, Homo Sapiens
MLSSVVFWGLIALIGTSRGSYPFSHSMKPHLHPRLYHGCYGDIMTMKTSGATCDANSVMNCGIRGSEMFAEMDLRAIKPYQTLIKEVGQRHCVDPAVIAAIISRESHGGSVLQDGWDHRGLKFGLMQLDKQTYHPVGAWDSKEHLSQATGILTERIKAIQKKFPTWSVAQHLKGFFLL

SEQ ID NO: 8203 - protein, 178 aa, Homo Sapiens; identical to SEQ ID NO: 8202

SEQ ID NO: 8204 - protein, 212 aa, Homo Sapiens
MLSSVVFWGLIALIGTSRGSYPFSHSMKPHLHPRLYHGCYGDIMTMKTSGATCDANSVMNCGIRGSEMFAEMDLRAIKPYQTLIKEVGQRHCVDPAVIAAIISRESHGGSVLQDGWDHRGLKFGLMQLDKQTYHPVGAWDSKEHLSQATGILTERIKAIQKKFPTWSVAQHLKGGLSAFKSGIEAIATPSDIDNDFVNDIIARAKFYKRQSF

SEQ ID NO: 8205 - protein, 212 aa, Homo Sapiens; identical to SEQ ID NO: 8204

SEQ ID NO: 8206 - protein, 182 aa, Homo Sapiens
MLSSVVFWGLIALIGTSRGSYPFSHSMKPHLHPRLYHGCYGDIMTMKTSGATCDANSVMNCGIRGSEMFAEMDLRAIKPYQTLIKEVGQRHCVDPAVIAAIISRESHGGSVLQDGWDHRGLKFGLMQLDKQTYHPVGAWDSKEHLSQATGILTERIKAIQKKFPTWSVAQHLKGRLYSEYFV

SEQ ID NO: 8207 - protein, 82 aa, Homo Sapiens
MTPLLTLILVVLMGLPLAQALDCHVCAYNGDNCFNPMRCPAMVAYCMTTRTYYTPTRMKVSKSCVPRCFETVYDGYSKHAST

SEQ ID NO: 8208 - protein, 84 aa, Homo Sapiens
MTPLLTLILVVLMGLPLAQALDCHVCAYNGDNCFNPMRCPAMVAYCMTTRTYYTPTRMKVSKSCVPRCFETVYDGYSKHASTTS

SEQ ID NO: 8209 - protein, 116 aa, Homo Sapiens
MTPLLTLILVVLMGLPLAQALDCHVCAYNGDNCFNPMRCPAMVAYCMTTRTYYTPTRMKVSKSCVPRCFETVYDGYSKHASTTSCCQYDLCNGTGLATPATLALAPILLATLWGLL

SEQ ID NO: 8210 - protein, 116 aa, Homo Sapiens; identical to SEQ ID NO: 8209

SEQ ID NO: 8211 - protein, 116 aa, Homo Sapiens; identical to SEQ ID NO: 8209

SEQ ID NO: 8212 - protein, 89 aa, Homo Sapiens
MCQKEVMEQSAGIMYRKSCASSAACLIASAGYQSFCSPGKLNSVCISCCNTPLCNGPRPKKRGSSASALRPGLRTTILFLKLALFSAHC

SEQ ID NO: 8213 - protein, 39 aa, Homo Sapiens
MWVLGIAATFCGLFLLPGENTQRPAAEARLCAANPVLPV

SEQ ID NO: 8214 - protein, 141 aa, Homo Sapiens
MWVLGIAATFCGLFLLPGFALQIQCYQCEEFQLNNDCSSPEFIVNCTVNVQDMCQKEVMEQSAGIMYRKSCASSAACLIASAGYQSFCSPGKLNSVCISCCNTPLCNGPRPKKRGSSASALRPGLRTTILFLKLALFSAHC

SEQ ID NO: 8215 - protein, 125 aa, Homo Sapiens
MRGTRLALLALVLAACGELAPALRCYVCPEPTGVSDCVTIATCTTNETMCKTTLYSREIVYPFQGDSTVTKSCASKCKPSDVDGIGQTLPVSCCNTELCNVDGAPALNSLHCGALTLLPLLSLRL

SEQ ID NO: 8216 - protein, 246 aa, Homo Sapiens
MGPQHLRLVQLFCLLGAISTLPRAGALLCYEATASRFRAVAFHNWKWLLMRNMVCKLQEGCEETLVFIETGTARGVVGFKGCSSSSSYPAQISYLVSPPGVSIASYSRVCRSYLCNNLTNLEPFVKLKASTPKSITSASCSCPTCVGEHMKDCLPNFVTTNSCPLAASTCYSSTLKFQAGFLNTTFLLMGCAREHNQLLADFHHIGSIKVTEVLNILEKSQIVGAASSRQDPAWGVVLGLLFAFRD

SEQ ID NO: 8217 - protein, 211 aa, Homo Sapiens
MGPQHLRLVQLFCLLGAISTLPRMSCGAGCYKTQKGTARGVVGFKGCSSSSSYPAQISYLVSPPGVSIASYSRVCRSYLCNNLTNLEPFVKLKASTPKSITSASCSCPTCVGEHMKDCLPNFVTTNSCPLAASTCYSSTLKFQAGFLNTTFLLMGCAREHNQLLADFHHIGSIKVTEVLNILEKSQIVGAASSRQDPAWGVVLGLLFAFRD

SEQ ID NO: 8218 - protein, 211 aa, Homo Sapiens; identical to SEQ ID NO: 8217

SEQ ID NO: 8219 - protein, 53 aa, Homo Sapiens
MEPGPALAWLLLLSLLADCLKAAQSRDFTVKDIIYLHPSTTPYPGGFKCFTCE

SEQ ID NO: 8220 - protein, 171 aa, Homo Sapiens
MEPGPALAWLLLLSLLADCLKAAQSRDFTVKDIIYLHPSTTPYPGGFKCFTCEKAADNYECNRWAPDIYCPRETRYCYTQHTMEVTGNSISVTKRCVPLEECLSTGCRDSEHEGHKVCTSCCEGNICNLPLPRNETDATFATTSPINQTNGHPRCMSVIVSCLWLWLGLML

SEQ ID NO: 8221 - protein, 171 aa, Homo Sapiens; identical to SEQ ID NO: 8220

SEQ ID NO: 8222 - protein, 76 aa, Homo Sapiens
MEPGPALAWLLLLSLLADCLKAAQSRDFTVKDIIYLHPSTTPYPGGFKCFTCEKAADNYECNRWAPDIYCPRGTMI

SEQ ID NO: 8223 - protein, 76 aa, Homo Sapiens; identical to SEQ ID NO: 8222

SEQ ID NO: 8224 - protein, 50 aa, Homo Sapiens
MLCERHCTEEDENHSKPNKGNAEEIFSAEYWKVRFPASRISGNVNEQHEA

SEQ ID NO: 8225 - protein, 74 aa, Homo Sapiens
MLLITLSANLFTVPERSLTTTFSFSRCERHCTEEDENHSKPNKGNAEEIFSAEYWKVRFPASRISGNVNEQHEA

SEQ ID NO: 8226 - protein, 207 aa, Homo Sapiens
MLLITLSANLFTVPERSLTTTFSFSRYKSSDRPAHKVSMLLLCHALAIAVVQIVIFSESWAFAKNINFYNVRPPLDPTPFPNSFKCFTCENAGDNYNCNRWAEDKWCPQNTQYCLTVHHFTSHGRSTSITKKCASRSECHFVGCHHSRDSEHTECRSCCEGMICNVELPTNHTNAVFAVMHAQRTSGSSAPTLYLPVLAWVFVLPLL

SEQ ID NO: 8227 - protein, 54 aa, Homo Sapiens
MLYKSSDRPAHKVSMLLLCHALAIAVVQIVIFSESWAFAKNINFYNVRPPLDHK

SEQ ID NO: 8228 - protein, 183 aa, Homo Sapiens
MLYKSSDRPAHKVSMLLLCHALAIAVVQIVIFSESWAFAKNINFYNVRPPLDPTPFPNSFKCFTCENAGDNYNCNRWAEDKWCPQNTQYCLTVHHFTSHGRSTSITKKCASRSECHFVGCHHSRDSEHTECRSCCEGMICNVELPTNHTNAVFAVMHAQRTSGSSAPTLYLPVLAWVFVLPLL

SEQ ID NO: 8229 - protein, 183 aa, Homo Sapiens; identical to SEQ ID NO: 8228

SEQ ID NO: 8230 - protein, 183 aa, Homo Sapiens
MRYKSSDRPAHKVSMLLLCHALAIAVVQIVIFSESWAFAKNINFYNVRPPLDPTPFPNSFKCFTCENAGDNYNCNRWAEDKWCPQNTQYCLTVHHFTSHGRSTSITKKCASRSECHFVGCHHSRDSEHTECRSCCEGMICNVELPTNHTNAVFAVMHAQRTSGSSAPTLYLPVLAWVFVLPLL

SEQ ID NO: 8231 - protein, 237 aa, Homo Sapiens
MKGILVAGITAVLVAAVESLSCVQCNSWEKSCVNSIASECPSHANTSCISSSASSSLETPVRLYQNMFCSAENCSEETHITAFTVHVSAEEHFHFVSQCCQGKECSNTSDALDPPLKNVSSNAECPACYESNGTSCHGKPWKCYEEEQCVFLVAELKNDIESKSLVLKGCSNVSNATCQFLSGENKTLGGVIFRKFECANVNSLTPTSAPTTSHNVGSKASLYLLALASLLLRGLLP

SEQ ID NO: 8232 - protein, 54 aa, Homo Sapiens
  misc_feature (1)..(1): Xaa can be any naturally occurring amino acid
XPPLKNVSSNAECPACYESNGTSCHGKPWKCYEEEQCVFLVAELKNGTPGDGAD

SEQ ID NO: 8233 - protein, 148 aa, Homo Sapiens
MKALIVLGLVLLSVTVQGKVFERCELARTLKRLGMDGYRGISLANWMCLAKWESGYNTRATNYNAGDRSTDYGIFQINSRYWCNDGKTPGAVNACHLSCSALLQDNIADAVACAKRVVRDPQGIRAWVAWRNRCQNRDVRQYVQGCGV

SEQ ID NO: 8234 - protein, 104 aa, Homo Sapiens
MKALIVLGLVLLSVTVQGKVFERCELARTLKRLGMDGYRGISLANWMCLAKWESGYNTRATNYNAGDRSTDYGIFQINSRYWCNDGKTPGAVNACHLSCSGKTS

SEQ ID NO: 8235 - protein, 137 aa, Homo Sapiens
MKALIVLGLVLLSVTVQGKVFERCELARTLKRLGMDGYRGISLANWMCLAKWESGYNTRATNYNAGDRSTDYGIFQINSRYWCNDGKTPGAVNACHLSCSGWHGEIVVKTEMSVSMFKVVECNSRIFLLQLILSLSH

SEQ ID NO: 8236 - protein, 146 aa, Homo Sapiens
MKASVVLSLLGYLVVPSGAYILGRCTVAKKLHDGGLDYFEGYSLENWVCLAYFESKFNPMAIYENTREGYTGFGLFQMRGSDWCGDHGRNRCHMSCSALLNPNLEKTIKCAKTIVKGKEGMGAWPTWSRYCQYSDTLARWLDGCKL

SEQ ID NO: 8237 - protein, 146 aa, Homo Sapiens; identical to SEQ ID NO: 8236

SEQ ID NO: 8238 - protein, 148 aa, Homo Sapiens
MTKALLIYLVSSFLALNQASLISRCDLAQVLQLEDLDGFEGYSLSDWLCLAFVESKFNISKINENADGSFDYGLFQINSHYWCNDYKSYSENLCHVDCQDLLNPNLLAGIHCAKRIVSGARGMNNWVEWRLHCSGRPLFYWLTGCRLR

SEQ ID NO: 8239 - protein, 148 aa, Homo Sapiens; identical to SEQ ID NO: 8238

SEQ ID NO: 8240 - protein, 86 aa, Homo Sapiens
  misc_feature (1)..(1): Xaa can be any naturally occurring amino acid
XLEDLDGFEGYSLSDWLCLAFVESKFNISKINENADGSFDYGLFQINSHYWCNDYKSYSENLCHVDCQGIHCAKRIVSGARGMNNW

SEQ ID NO: 8241 - protein, 148 aa, Homo Sapiens
LLLLLAVAVRESWQTEEKTCDLDNFNPVSEERGKVQDCFYLFEMDSSLACSPEISHLSVGSILLVTFASLVAVYVVGGFLYQRLVVGAKGMEQFPHLAFWQDLGNLVADGCDFVCRSKPRNVPAAYRGVGDDQLGEESEERDDHLLPM

SEQ ID NO: 8242 - protein, 92 aa, Homo Sapiens
MFPFYSCWRTGLLLLLLAVAVRESWQTEEKTCDLVGEKGKESEKELALVKRLKPLFNKSFESTVGQGSDTYIYIFRVCREAGNHTSGAGLVQ

SEQ ID NO: 8243 - protein, 109 aa, Homo Sapiens
MFPFYSCWRTGLLLLLLAVAVRESWQTEEKTCDLVGEKGKESEKELALVKRLKPLFNKSFESTVGQGSDTYIYIFRVCREAGNHTSGAGLVQINKSNGKETVVGRLNET

SEQ ID NO: 8244 - protein, 133 aa, Homo Sapiens
MFPFYSCWRTGLLLLLLAVAVRESWQTEEKTCDLVGEKGKESEKELALVKRLKPLFNKSFESTVGQGSDTYIYIFRVCREAGNHTSGAGLVQINKSNGKETVVGRLNETHIFNGSLHHWLLFMLLGGSYTSDW

SEQ ID NO: 8245 - protein, 191 aa, Homo Sapiens
MFPFYSCWRTGLLLLLLAVAVRESWQTEEKTCDLVGEKGKESEKELALVKRLKPLFNKSFESTVGQGSDTYIYIFRVCREAGNHTSGAGLVQINKSNGKETVVGRLNETHIFNGSNWIMLIYKGGDEYDNHCGKEQRRAVVMISCNRHTLADGCDFVCRSKPRNVPAAYRGVGDDQLGEESEERDDHLLPM

SEQ ID NO: 8246 - protein, 277 aa, Homo Sapiens
MFPFYSCWRTGLLLLLLAVAVRESWQTEEKTCDLVGEKGKESEKELALVKRLKPLFNKSFESTVGQGSDTYIYIFRVCREAGNHTSGAGLVQINKSNGKETVVGRLNETHIFNGSNWIMLIYKGGDEYDNHCGKEQRRAVVMISCNRHTLADNFNPVSEERGKVQDCFYLFEMDSSLACSPEISHLSVGSILLVTFASLVAVYVVGGFLYQRLVVGAKGMEQFPHLAFWQDLGNLVADGCDFVCRSKPRNVPAAYRGVGDDQLGEESEERDDHLLPM

SEQ ID NO: 8247 - protein, 25 aa, Homo Sapiens
MLIYKGGDEYDNHCGKEQRRAVVMI

SEQ ID NO: 8248 - protein, 85 aa, Homo Sapiens
VVGGFLYQRLVVGAKGMEQFPHLAFWQDLGNLVAACGFDLFFNLLERERKQKWDIEGSAVLCAGCGMLLHLSLLLAQGSVFLPTF

SEQ ID NO: 8249 - protein, 104 aa, Homo Sapiens
  misc_feature (1)..(1): Xaa can be any naturally occurring amino acid
XFNKSFESTVGQGSDTYIYIFRVCREAGNHTSGAGLVQINKSNGKETVVGRLNETHIFNGSNWIMLIYKGGDEYDNHCGKEQRRAVVMISCNRHTLAESKHLTT

SEQ ID NO: 8250 - protein, 122 aa, Homo Sapiens
  misc_feature (1)..(1): Xaa can be any naturally occurring amino acid
XGGDEYDNHCGKEQRRAVVMISCNRHTLADNFNPVSEERGKVQDCFYLFEMDSSLACSPEISHLSVGSILLVTFASLVAVYVVGGFLYQRLVVGAKGMEQFPHLAFWQDLGNLVAVSNRAAG

SEQ ID NO: 8251 - protein, 96 aa, Homo Sapiens
  misc_feature (1)..(1): Xaa can be any naturally occurring amino acid
XILLVTFASLVAVYVVGGFLYQRLVVGAKGMEQFPHLAFWQDLGNLVAKGNGSRSGTSRALLSSALGVECCCTCPFCWLREVSSCPHFCGERFLIL

SEQ ID NO: 8252 - protein, 157 aa, Homo Sapiens
MEDLGENTMVLSTLRSLNNFISQRVEGGSGLDISTSAPGSLQMQYQQSMQLEERAEQIRSKSHLIQVEREKMQMELSHKRARVELERAASTSARNYEREVDRNQELLTRIRQLQEREAGAEEKMQEQLERNRQCQQNLDAASKRLREKEDSLAQAGE

SEQ ID NO: 8253 - protein, 718 aa, Homo Sapiens
MEDLGENTMVLSTLRSLNNFISQRVEGGSGLDISTSAPGSLQMQYQQSMQLEERAEQIRSKSHLIQVEREKMQMELSHKRARVELERAASTSARNYEREVDRNQELLTRIRQLQEREAGAEEKMQEQLERNRQCQQNLDAASKRLREKEDSLAQAGETINALKGRISELQWSVMDQEMRVKRLESEKQELQEQLDLQHKKCQEANQKIQELQASQEARADHEQQIKDLEQKLSLQEQDAAIVKNMKSELVRLPRLERELKQLREESAHLREMRETNGLLQEELEGLQRKLGRQEKMQETLVGLELENERLLAKLQSWERLDQTMGLSIRTPEDLSRFVVELQQRELALKDKNSAVTSSARGLEKARQQLQEELRQVSGQLLEERKKRETHEALARRLQKRVLLLTKERDGMRAILGSYDSELTPAEYSPQLTRRMREAEDMVQKVHSHSAEMEAQLSQALEELGGQKQRADMLEMELKMLKSQSSSAEQSFLFSREEADTLRLKVEELEGERSRLEEEKRMLEAQLERRALQGDYDQSRTKVLHMSLNPTSVARQRLREDHSQLQAECERLRGLLRAMERGGTVPADLEAAAASLPSSKEVAELKKQVESAELKNQRLKEVFQTKIQEFRKACYTLTGYQIDITTENQYRLTSLYAEHPGDCLIFKATSPSGSKMQLLETEFSHTVGELIEVHLRRQDSIPAFLSSLTLELFSRQTVA

SEQ ID NO: 8254 - protein, 718 aa, Homo Sapiens; identical to SEQ ID NO: 8253

SEQ ID NO: 8255 - protein, 718 aa, Homo Sapiens; identical to SEQ ID NO: 8253

SEQ ID NO: 8256 - protein, 144 aa, Homo Sapiens
MEDLGENTMVLSTLRSLNNFISQRVEGGSGLDISTSAPGSLQMQYQQSMQREVDRNQELLTRIRQLQEREAGAEEKMQEQLERNRQCQQNLDAASKRLREKEDSLAQAGETINALKGRISELQWSVMDQEMRVKRLESEKQELQ

SEQ ID NO: 8257 - protein, 626 aa, Homo Sapiens
MLPARGCVRKRTVWPRLARVLIVTLLTLELSYAPLPCQLSGVPYNTGDPVGRWARPCIWPCPWHTTINALKGRISELQWSVMDQEMRVKRLESEKQELQEQLDLQHKKCQEANQKIQELQASQEARADHEQQIKDLEQKLSLQEQDAAIVKNMKSELVRLPRLERELKQLREESAHLREMRETNGLLQEELEGLQRKLGRQEKMQETLVGLELENERLLAKLQSWERLDQTMGLSIRTPEDLSRFVVELQQRELALKDKNSAVTSSARGLEKARQQLQEELRQVSGQLLEERKKRETHEALARRLQKRVLLLTKERDGMRAILGSYDSELTPAEYSPQLTRRMREAEDMVQKVHSHSAEMEAQLSQALEELGGQKQRADMLEMELKMLKSQSSSAEQSFLFSREEADTLRLKVEELEGERSRLEEEKRMLEAQLERRALQGDYDQSRTKVLHMSLNPTSVARQRLREDHSQLQAECERLRGLLRAMERGGTVPADLEAAAASLPSSKEVAELKKQVESAELKNQRLKEVFQTKIQEFRKACYTLTGYQIDITTENQYRLTSLYAEHPGDCLIFKATSPSGSKMQLLETEFSHTVGELIEVHLRRQDSIPAFLSSLTLELFSRQTVA

SEQ ID NO: 8258 - protein, 205 aa, Homo Sapiens
MQEQLERNRQCQQNLDAASKRLREKEDSLAQAGETINALKGRISELQWSVMDQEMRVKRLESEKQELQEQLDLQHKKCQEANQKIQELQASQEARADHEQQIKDLEQKLSLQEQDAAIVKNMKSELVRLPRLERELKQLREESAHLREMRETNGLLQEELEGLQRKLGRQEKMQETLVGLELENERLLAKLQSWERLDQTMGLSI

SEQ ID NO: 8259 - protein, 213 aa, Homo Sapiens
MQMELSHKRARVELERAASTSARNYEREVDRNQELLTRIRQLQEREAGAEEKMQEQLERNRQCQQNLDAASKRLREKEDSLAQAGETINALKGRISELQWSVMDQEMRVKRLESEKQELQEQLDLQHKKCQEANQKIQELQASQEARADHEQQIKDLEQKLSLQEQDAAIVKNMKSELVRLPRLERELKQLREESAHLREMRETNGLLQEELE

SEQ ID NO: 8260 - protein, 41 aa, Homo Sapiens
MRAILGSYDSELTPAEYSPQLTRRMREAEDMVQKVHSHSAE

SEQ ID NO: 8261 - protein, 80 aa, Homo Sapiens
MRAILGSYDSELTPAEYSPQLTRRMREAEDMVQKVHSHSAEMEAQLSQALEELGGQKQRADMLEMELKMLKSQSSSAEQS

SEQ ID NO: 8262 - protein, 266 aa, Homo Sapiens
MRELEFAKLECCLAWQLQASRRELEMELKMLKSQSSSAEQSFLFSREEADTLRLKVEELEGERSRLEEEKRMLEAQLERRALQGDYDQSRTKVLHMSLNPTSVARQRLREDHSQLQAECERLRGLLRAMERGGTVPADLEAAAASLPSSKEVAELKKQVESAELKNQRLKEVFQTKIQEFRKACYTLTGYQIDITTENQYRLTSLYAEHPGDCLIFKATSPSGSKMQLLETEFSHTVGELIEVHLRRQDSIPAFLSSLTLELFSRQ

SEQ ID NO: 8263 - protein, 122 aa, Homo Sapiens
MSLNPTSVARQRLREDHSQLQAECERLRGLLRAMERGGTVPADLEAAAASLPSSKEVAELKKQVESAELKNQRLKEVFQTKIQEFRKACYTLTGYQIDITTENQYRLTSLYAEHPGDCLIFK

SEQ ID NO: 8264 - protein, 199 aa, Homo Sapiens
MVSLRPCLPGLPTQHLEEPCPGDYSARGLEKARQQLQEELRQVSGQLLEERKKRETHEALARRLQKRVLLLTKERDGMRAILGSYDSELTPAEYSPQLTRRMREAEDMVQKVHSHSAEMEAQLSQALEELGGQKQRADMLEMELKMLKSQSSSAEQSFLFSREEADTLRLKVEELEGERSRLEEEKRMLEAQLERRALQ

SEQ ID NO: 8265 - protein, 58 aa, Homo Sapiens
MIFLTALPLFWIMISASRGGHWGAWMPSSISAFEGTCVSIPCRFDFPDELRPAVVHGV

SEQ ID NO: 8266 - protein, 158 aa, Homo Sapiens
MIFLTALPLFWIMISASRGGHWGAWMPSSISAFEGTCVSIPCRFDFPDELRPAVVHGVWYFNSPYPKNYPPVVFKSRTQVVHESFQGRSRLLGDLGLRNCTLLLSNVSPELGGKYYFRGDLGGYNQYTFSEHSVLDIVNTPNIVVPPEVVAGTEVEVS

SEQ ID NO: 8267 - protein, 582 aa, Homo Sapiens
MIFLTALPLFWIMISASRGGHWGAWMPSSISAFEGTCVSIPCRFDFPDELRPAVVHGVWYFNSPYPKNYPPVVFKSRTQVVHESFQGRSRLLGDLGLRNCTLLLSNVSPELGGKYYFRGDLGGYNQYTFSEHSVLDIVNTPNIVVPPEVVAGTEVEVSCMVPDNCPELRPELSWLGHEGLGEPAVLGRLREDEGTWVQVSLLHFVPTREANGHRLGCQASFPNTTLQFEGYASMDVKYPPVIVEMNSSVEAIEGSHVSLLCGADSNPPPLLTWMRDGTVLREAVAESLLLELEEVTPAEDGVYACLAENAYGQDNRTVGLSVMYAPWKPTVNGTMVAVEGETVSILCSTQSNPDPILTIFKEKQILSTVIYESELQLELPAVSPEDDGEYWCVAENQYGQRATAFNLSVEFAPVLLLESHCAAARDTVQCLCVVKSNPEPSVAFELPSRNVTVNESEREFVYSERSGLVLTSILTLRGQAQAPPRVICTARNLYGAKSLELPFQGAHRLMWAKIGPVGAVVAFAILIAIVCYITQTRRKKNVTESPSFSAGDNPPVLFSSDFRISGAPEKYESKEVSTLESH

SEQ ID NO: 8268 - protein, 626 aa, Homo Sapiens
MIFLTALPLFWIMISASRGGHWGAWMPSSISAFEGTCVSIPCRFDFPDELRPAVVHGVWYFNSPYPKNYPPVVFKSRTQVVHESFQGRSRLLGDLGLRNCTLLLSNVSPELGGKYYFRGDLGGYNQYTFSEHSVLDIVNTPNIVVPPEVVAGTEVEVSCMVPDNCPELRPELSWLGHEGLGEPAVLGRLREDEGTWVQVSLLHFVPTREANGHRLGCQASFPNTTLQFEGYASMDVKYPPVIVEMNSSVEAIEGSHVSLLCGADSNPPPLLTWMRDGTVLREAVAESLLLELEEVTPAEDGVYACLAENAYGQDNRTVGLSVMYAPWKPTVNGTMVAVEGETVSILCSTQSNPDPILTIFKEKQILSTVIYESELQLELPAVSPEDDGEYWCVAENQYGQRATAFNLSVEFAPVLLLESHCAAARDTVQCLCVVKSNPEPSVAFELPSRNVTVNESEREFVYSERSGLVLTSILTLRGQAQAPPRVICTARNLYGAKSLELPFQGAHRLMWAKIGPVGAVVAFAILIAIVCYITQTRRKKNVTESPSFSAGDNPPVLFSSDFRISGAPEKYESERRLGSERRLLGLRGEPPELDLSYSHSDLGKRPTKDSYTLTEELAEYAEIRVK

SEQ ID NO: 8269 - protein, 131 aa, Homo Sapiens
MPSSISAFEGTCVSIPCRFDFPDELRPAVVHGVWYFNSPYPKNYPPVVFKSRTQVVHESFQGRSRLLGDLGLRNCTLLLSNVSPELGGKYYFRGDLGGYNQYTFSEHSVLDIVNTPNIVVPPEVVAGTEVE

SEQ ID NO: 8270 - protein, 601 aa, Homo Sapiens
MPSSISAFEGTCVSIPCRFDFPDELRPAVVHGVWYFNSPYPKNYPPVVFKSRTQVVHESFQGRSRLLGDLGLRNCTLLLSNVSPELGGKYYFRGDLGGYNQYTFSEHSVLDIVNTPNIVVPPEVVAGTEVEVSCMVPDNCPELRPELSWLGHEGLGEPAVLGRLREDEGTWVQVSLLHFVPTREANGHRLGCQASFPNTTLQFEGYASMDVKYPPVIVEMNSSVEAIEGSHVSLLCGADSNPPPLLTWMRDGTVLREAVAESLLLELEEVTPAEDGVYACLAENAYGQDNRTVGLSVMYAPWKPTVNGTMVAVEGETVSILCSTQSNPDPILTIFKEKQILSTVIYESELQLELPAVSPEDDGEYWCVAENQYGQRATAFNLSVEFAPVLLLESHCAAARDTVQCLCVVKSNPEPSVAFELPSRNVTVNESEREFVYSERSGLVLTSILTLRGQAQAPPRVICTARNLYGAKSLELPFQGAHRLMWAKIGPVGAVVAFAILIAIVCYITQTRRKKNVTESPSFSAGDNPPVLFSSDFRISGAPEKYESERRLGSERRLLGLRGEPPELDLSYSHSDLGKRPTKDSYTLTEELAEYAEIRVK

SEQ ID NO: 8271 - protein, 134 aa, Homo Sapiens
MAARWRFWCVSVTMVVALLIVCDVPSASAQRKKEMVLSEKVSQLMEWTNKRPVIRMNGDKFRRLVKAPPRNYSVIVMFTALQLHRQCVVCKQADEEFQILANSWRYSSAFTNRIFFAMVDFDEGSDVFQMFQVF

SEQ ID NO: 8272 - protein, 335 aa, Homo Sapiens
MAARWRFWCVSVTMVVALLIVCDVPSASAQRKKEMVLSEKVSQLMEWTNKRPVIRMNGDKFRRLVKAPPRNYSVIVMFTALQLHRQCVVCKQADEEFQILANSWRYSSAFTNRIFFAMVDFDEGSDVFQMLNMNSAPTFINFPAKGKPKRGDTYELQVRGFSAEQIARWIADRTDVNIRVIRPPNYAGPLMLGLLLAVIGGLVYLRRSNMEFLFNKTGWAFAALCFVLAMTSGQMWNHIRGPPYAHKNPHTGHVNYIHGSSQAQFVAETHIVLLFNGGVTLGMVLLCEAATSDMDIGKRKIMCVAGIGLVVLFFSWMLSIFRSKYHGYPYSFLMS

SEQ ID NO: 8273 - protein, 367 aa, Homo Sapiens
MRKGKGPICLFSRPTLRPSRSKVSLIEGRGANMAARWRFWCVSVTMVVALLIVCDVPSASAQRKKEMVLSEKVSQLMEWTNKRPVIRMNGDKFRRLVKAPPRNYSVIVMFTALQLHRQCVVCKQADEEFQILANSWRYSSAFTNRIFFAMVDFDEGSDVFQMLNMNSAPTFINFPAKGKPKRGDTYELQVRGFSAEQIARWIADRTDVNIRVIRPPNYAGPLMLGLLLAVIGGLVYLRRSNMEFLFNKTGWAFAALCFVLAMTSGQMWNHIRGPPYAHKNPHTGHVNYIHGSSQAQFVAETHIVLLFNGGVTLGMVLLCEAATSDMDIGKRKIMCVAGIGLVVLFFSWMLSIFRSKYHGYPYSFLMS

SEQ ID NO: 8274 - protein, 367 aa, Homo Sapiens; identical to SEQ ID NO: 8273

SEQ ID NO: 8275 - protein, 234 aa, Homo Sapiens
MGPGGRVARLLAPLMWRRAVSSVAGSAVGAEPGLRLLAVQRLPVGAAFCRACQTPNFVRGLHSEPGLEERAEGTVNEGRPESDAADHTGPKFDIDMMVSLLRQENARDICVIQVPPEMRYTDYFVIVSGTSTRHLHAMAFYVVKMYKHLKCKRDPHVKIEGKDTDDWLCVDFGSMVIHLMLPETREIYELEKLWTLRSYDDQLAQIAPETVPEDFILGIEDDTSSVTPVELKCE

SEQ ID NO: 8276 - protein, 686 aa, Homo Sapiens
MLLRGVLLALQALQLAGALDLPAGSCAFEESTCGFDSVLASLPWILNEEGHYIYVDTSFGKQGEKAVLLSPDLQAEEWSCLRLVYQITTSSESLSDPSQLNLYMRFEDESFDRLLWSAKEPSDSWLIASLDLQNSSKKFKILIEGVLGQGNTASIALFEIKMTTGYCIECDFEENHLCGFVNRWNPNVNWFVGGGSIRNVHSILPQDHTFKSELGHYMYVDSVYVKHFQEVAQLISPLTTAPMAGCLSFYYQIQQGNDNVFSLYTRDVAGLYEEIWKADRPGNAAWNLAEVEFSAPYPMEVIFEVAFNGPKGGYVALDDISFSPVHCQNQTELLFSAVEASCNFEQDLCNFYQDKEGPGWTRVKVKPNMYRAGDHTTGLGYYLLANTKFTSQPGYIGRLYGPSLPGNLQYCLRFHYAIYGFLKMSDTLAVYIFEENHVVQEKIWSVLESPRGVWMQAEITFKKPMPTKVVFMSLCKSFWDCGLVALDDITIQLGSCSSSEKLPPPPGECTFEQDECTFTQEKRNRSSWHRRRGETPTSYTGPKGDHTTGVGYYMYIEASHMVYGQKARLLSRPLRGVSGKHCLTFFYHMYGGGTGLLSVYLKKEEDSEESLLWRRRGEQSISWLRALIEYSCERQHQIIFEAIRGVSIRSDIAIDDVKFQAGPCGEMEDTTQQSSGYSEDLNEIEY

SEQ ID NO: 8277 - protein, 165 aa, Homo Sapiens [sequence omitted]

SEQ ID NO: 8278 - protein, 1010 aa, Homo Sapiens
MGAYARASGVCARGCLDSAGPWTMSRALRPPLPPLCFFLLLLAAAGARAGGYETCPTVQPNMLNVHLLPHTHDDVGWLKTVDQYFYGIKNDIQHAGVQYILDSVISALLADPTRRFIYVEIAFFSRWWHQQTNATQEVVRDLVRQGRLEFANGGWVMNDEAATHYGAIVDQMTLGLRFLEDTFGNDGRPRVAWHIDPFGHSREQASLFAQMGFDGFFFGRLDYQDKWVRMQKLEMEQVWRASTSLKPPTADLFTGVLPNGYNPPRNLCWDVLCVDQPLVEDPRSPEYNAKELVDYFLNVATAQGRYYRTNHTVMTMGSDFQYENANMWFKNLDKLIRLVNAQAKGSSVHVLYSTPACYLWELNKANLTWSVKHDDFFPYADGPHQFWTGYFSSRPALKRYERLSYNFLQVCNQLEALVGLAANVGPYGSGDSAPLNEAMAVLQHHDAVSGTSRQHVANDYARQLAAGWGPCEVLLSNALARLRGFKDHFTFCQQLNISICPLSQTAARFQVIVYNPLGRKVNWMVRLPVSEGVFVVKDPNGRTVPSDVVIFPSSDSQAHPPELLFSASLPALGFSTYSVAQVPRWKPQARAPQPIPRRSWSPALTIENEHIRATFDPDTGLLMEIMNMNQQLLLPVRQTFFWYNASIGDNESDQASGAYIFRPNQQKPLPVSRWAQIHLVKTPLVQEVHQNFSAWCSQVVRLYPGQRHLELEWSVGPIPVGDTWGKEVISRFDTPLETKGRFYTDSNGREILERRRDYRPTWKLNQTEPVAGNYYPVNTRIYITDGNMQLTVLTDRSQGGSSLRDGSLELMVHRRLLKDDGRGVSEPLMENGSGAWVRGRHLVLLDTAQAAAAGHRLLAEQEVLAPQVVLAPGGGAAYNLGAPPRTQFSGLRRDLPPSVHLLTLASWGPEMVLLRLEHQFAVGEDSGRNLSAPVTLNLRDLFSTFTITRLQETTLVANQLREAASRLKWTTNTGPTPHQTPYQLDPANITLEPMEIRTFLASVQWKEVDG

SEQ ID NO: 8279 - protein, 1011 aa, Homo Sapiens
MGAYARASGVCARGCLDSAGPWTMSRALRPPLPPLCFFLLLLAAAGARAGGYETCPTVQPNMLNVHLLPHTHDDVGWLKTVDQYFYGIKNDIQHAGVQYILDSVISALLADPTRRFIYVEIAFFSRWWHQQTNATQEVVRDLVRQGRLEFANGGWVMNDEAATHYGAIVDQMTLGLRFLEDTFGNDGRPRVAWHIDPFGHSREQASLFAQMGFDGFFFGRLDYQDKWVRMQKLEMEQVWRASTSLKPPTADLFTGVLPNGYNPPRNLCWDVLCVDQPLVEDPRSPEYNAKELVDYFLNVATAQGRYYRTNHTVMTMGSDFQYENANMWFKNLDKLIRLVNAQQAKGSSVHVLYSTPACYLWELNKANLTWSVKHDDFFPYADGPHQFWTGYFSSRPALKRYERLSYNFLQVCNQLEALVGLAANVGPYGSGDSAPLNEAMAVLQHHDAVSGTSRQHVANDYARQLAAGWGPCEVLLSNALARLRGFKDHFTFCQQLNISICPLSQTAARFQVIVYNPLGRKVNWMVRLPVSEGVFVVKDPNGRTVPSDVVIFPSSDSQAHPPELLFSASLPALGFSTYSVAQVPRWKPQARAPQPIPRRSWSPALTIENEHIRATFDPDTGLLMEIMNMNQQLLLPVRQTFFWYNASIGDNESDQASGAYIFRPNQQKPLPVSRWAQIHLVKTPLVQEVHQNFSAWCSQVVRLYPGQRHLELEWSVGPIPVGDTWGKEVISRFDTPLETKGRFYTDSNGREILERRRDYRPTWKLNQTEPVAGNYYPVNTRIYITDGNMQLTVLTDRSQGGSSLRDGSLELMVHRRLLKDDGRGVSEPLMENGSGAWVRGRHLVLLDTAQAAAAGHRLLAEQEVLAPQVVLAPGGGAAYNLGAPPRTQFSGLRRDLPPSVHLLTLASWGPEMVLLRLEHQFAVGEDSGRNLSAPVTLNLRDLFSTFTITRLQETTLVANQLREAASRLKWTTNTGPTPHQTPYQLDPANITLEPMEIRTFLASVQWKEVDG

SEQ ID NO: 8280 - protein, 172 aa, Homo Sapiens
MGAYARASGVCARGCLDSAGPWTMSRALRPPLPPLCFFLLLLAAAGARAGGYEVCVFGVPVQTCPTVQPNMLNVHLLPHTHDDVGWLKTVDQYFYGIKNDIQHAGVQYILDSVISALLADPTRRFIYVEIAFFSRWWHQQTNATQEVVRDLVRQGRLEFANGGWVMNDEAAT

SEQ ID NO: 8281 - protein, 140 aa, Homo Sapiens
  misc_feature (1)..(1): Xaa can be any naturally occurring amino acid
XLAAGWGPCEVLLSNALARLRGFKDHFTFCQQLNISICPLSQTAARFQVIVYNPLGRKVNWMVRLPVSEGVFVVKDPNGRTVPSDLRQPGAPSGAAVLSLTARPGLQHLFSSPGASLEAPGPRTTAHPQKILVPCFNHRK

SEQ ID NO: 8282 - protein, 67 aa, Homo Sapiens
  misc_feature (1)..(1): Xaa can be any naturally occurring amino acid
XSDVVIFPSSDSQAHPPELLFSASLPALGFSTYSVAQVPRWKPQARAPQPIPRRSWSPALTIENEGC

SEQ ID NO: 8283 - protein, 1009 aa, Homo Sapiens
MGQLCWLPLLAPLLLLRPPGVQSAGPIRAFVVPHSHMDVGWVYTVQESMRAYAANVYTSVVEELARGQQRRFIAVEQEFFRLWWDGVASDQQKYQVRQLLEEGRLEFVIGGQVMHDEAVTHLDDQILQLTEGHGFLYETFGIRPQFSWHVDPFGASATTPTLFALAGFNAHLGSRIDYDLKAAMQEARGLQFVWRGSPSLSERQEIFTHIMDQYSYCTPSHIPFSNRSGFYWNGVAVFPKPPQDGVYPNMSEPVTPANINLYAEALVANVKQRAAWFRTPHVLWPWGCDKQFFNASVQFANMDPLLDHINSHAAELGVSVQYATLGDYFRALHALNVTWRVRDHHDFLPYSTEPFQAWTGFYTSRSSLKGLARRASALLYAGESMFTRYLWPAPRGHLDPTWALQQLQQLRWAVSEVQHHDAITGTESPKVRDMYATHLASGMLGMRKLMASIVLDELQPQAPMAASSDAGPAGHFASVYNPLAWTVTTIVTLTVGFPGVRVTDEAGHPVPSQIQNSTETPSAYDLLILTTIPGLSYRHYNIRPTAGAQEGTQEPAATVASTLQFGRRLRRRTSHAGRYLVPVANDCYIVLLDQDTNLMHSIWERQSNRTVRVTQEFLEYHVNGDVKQGPISDNYLFTPGKAAVPAWEAVEMEIVAGQLVTEIRQYFYRNMTAQNYTYAIRSRLTHVPQGHDGELLCHRIEQEYQAGPLELNREAVLRTSTNLNSQQVIYSDNNGYQMQRRPYVSYVNNSIARNYYPMVQSAFMEDGKSRLVLLSERAHGISSQGNGQVEVMLHRRLWNNFDWDLGYNLTLNDTSVVHPVLWLLLGSWSLTTALRQRSALALQHRPVVLFGDLAGTAPKLPGPQQQEAVTLPPNLHLQILSIPGWRYSSNHTEHSQNLRKGHRGEAQADLRRVLLRLYHLYEVGEDPVLSQPVTVNLEAVLQALGSVVAVEERSLTGTWDLSMLHRWSWRTGPGRHRGDTTSPSRPPGGPIITVHPKEIRTFFIHFQQQ

SEQ ID NO: 8284 - protein, 958 aa, Homo Sapiens
MGQLCWLPLLAPLLLLRPPGVQSAGPIRAFVVPHSHMDVGWVYTVQESMRAYAANVYTSVVEELARGQQRRFIAVEQEFFRLWWDGVASDQQKYQVRQLLEEGRLEFVIGGQVMHDEAVTHLDDQILQLTEGHGFLYETFGIRPQFSWHVDPFGASATTPTLFALAGFNAHLGSRIDYDLKAAMQEARGLQFVWRGSPSLSERQEIFTHIMDQYSYCTPSHIPFSNRSGFYWNGVAVFPKPPQDGVYPNMSEPVTPANINLYAELGVSVQYATLGDYFRALHALNVTWRVRDHHDFLPYSTEPFQAWTGFYTSRSSLKGLARRASALLYAGESMFTRYLWPAPRGHLDPTWALQQLQQLRWAVSEVQHHDAITGTESPKVRDMYATHLASGMLGMRKLMASIVLDELQPQAPMAASSDAGPAGHFASVYNPLAWTVTTIVTLTVGFPGVRVTDEAGHPVPSQIQNSTETPSAYDLLILTTIPGLSYRHYNIRPTAGAQEGTQEPAATVASTLQFGRRLRRRTSHAGRYLVPVANDCYIVLLDQDTNLMHSIWERQSNRTVRVTQEFLEYHVNGDVKQGPISDNYLFTPGKAAVPAWEAVEMEIVAGQLVTEIRQYFYRNMTAQNYTYAIRSRLTHVPQGHDGELLCHRIEQEYQAGPLELNREAVLRTSTNLNSQQVIYSDNNGYQMQRRPYVSYVNNSIARNYYPMVQSAFMEDGKSRLVLLSERAHGISSQGNGQVEVMLHRRLWNNFDWDLGYNLTLNDTSVVHPVLWLLLGSWSLTTALRQRSALALQHRPVVLFGDLAGTAPKLPGPQQQEAVTLPPNLHLQILSIPGWRYSSNHTEHSQNLRKGHRGEAQADLRRVLLRLYHLYEVGEDPVLSQPVTVNLEAVLQALGSVVAVEERSLTGTWDLSMLHRWSWRTGPGRHRGDTTSPSRPPGGPIITVHPKEIRTFFIHFQQQ

SEQ ID NO: 8285 - protein, 953 aa, Homo Sapiens
  misc_feature (1)..(1): Xaa can be any naturally occurring amino acid
XQLCWLPLLAPLLLLRPPGVQSAGPIRAFVVPHSHMDVGWVYTVQESMRAYAANVYTSVVEELARGQQRRFIAVEQEFFRLWWDGVASDQQKYQVRQLLEEGRLEFVIGGQVMHDEAVTHLDDQILQLTEGHGFLYETFGIRPQFSWHVDPFGASATTPTLFALAGFNAHLGSRIDYDLKAAMQEARGLQFVWRGSPSLSERQEIFTHIMDQYSYCTPSHIPFSNRSGFYWNGVAVFPKPPQDGVYPNMSEPVTPANINLYAEALVANVKQRAAWFRTPHVLWPWGCDKQFFNASVQFANMDPLLDHINSHAAELGVSVQYATLGDYFRALHALNVTWRVRDHHDFLPYSTEPFQAWTGFYTSRSSLKGLARRASALLYAGESMFTRYLWPAPRGHLDPTWALQQLQQLRWAVSEVQHHDAITGTESPKVRDMYATHLASGMLGMRKLMASIVLDELQPQAPMAASSDAGPAGHFASVYNPLAWTVTTIVTLTVGFPGVRVTDEAGHPVPSQIQNSTETPSAYDLLILTTIPGLSYRHYNIRPTAGAQEGTQEPAATVASTLQFGRRLRRRTSHAGRYLVPVANDCYIVLLDQDTNLMHSIWERQSNRTVRVTQEFLEYHVNGDVKQGPISDNYLFTPGKAAVPAWEAVEMEIVAGQLVTEIRQYFYRNMTAQNYTYAIRSRLTHVPQGHDGELLCHRIEQEYQAGPLELNREAVLRTSTNLNSQQVIYSDNNGYQMQRRPYVSYVNNSIARNYYPMVQSAFMEDGKSRLVLLSERAHGISSQGNGQVEVMLHRRLWNNFDWDLGYNLTLNDTSVVHPVLWLLLGSWSLTTALRQRSALALQHRPVVLFGDLAGTAPKLPGPQQQEAVTLPPNLHLQILSIPGWRYSSNHTEHSQNLRKGHRGEAQADLRRVLLRLYHLYEVGEDPVLSQPVTVNLEVNFPTPIQTISQGSKP

SEQ ID NO: 8286 - protein, 822 aa, Homo Sapiens
MRLHLLLLLALCGAGTTAAELSYSLRGNWSICNGNGSLELPGAVPGCVHSALFQQGLIQDSYYRFNDLNYRWVSLDNWTYSKEFKIPFEISKWQKVNLILEGVDTVSKILFNEVTIGETDNMFNRYEQCSFSWDWGPSFPTQGIWKDVRIEAYNICHLNYFTFSPIYDKSAQEWNLEIESTFDVVSSKPVGGQVIVAIPKLQTQQTYSIELQPGKRIVELFVNISKNITVETWWPHGHGNQTGYNMTVLFELDGGLNIEKSAKVYFRTVELIEEPIKGSPGLSFYFKINGFPIFLKGSNWIPADSFQDRVTSELLRLLLQSVVDANMNTLRVWGGGIYEQDEFYELCDELGIMVWQDFMFACALYPTDQGFLDSVTAEVAYQIKRLKSHPSIIIWSGNNENEEALMMNWYHISFTDRPIYIKDYVTLYVKNIRELVLAGDKSRPFITSSPTNGAETVAEAWVSQNPNSNYFGDVHFYDYISDCWNWKVFPKARFASEYGYQSWPSFSTLEKVSSTEDWSFNSKFSLHRQHHEGGNKQMLYQAGLHFKLPQSTDPLRTFKDTIYLTQVMQAQCVKTETEFYRRSRSEIVDQQGHTMGALYWQLNDIWQAPSWASLEYGGKWKMLHYFAQNFFAPLLPVGFENENTFYIYGVSDLHSDYSMTLSVRVHTWSSLEPVCSRVTERFVMKGGEAVCLYEEPVSELLRRCGNCTRESCVVSFYLSADHELLSPTNYHFLSSPKEAVGLCKAQITAIISQQGDIFVFDLETSAVAPFVWLDVGSIPGRFSDNGFLMTEKTRTILFYPWEPTSKNELEQSFHVTSLTDIY

SEQ ID NO: 8287 - protein, 879 aa, Homo Sapiens
MRLHLLLLLALCGAGTTAAELSYSLRGNWSICNGNGSLELPGAVPGCVHSALFQQGLIQDSYYRFNDLNYRWVSLDNWTYSKEFKIPFEISKWQKVNLILEGVDTVSKILFNEVTIGETDNMFNRYSFDITNVVRDVNSIELRFQSAVLYAAQQSKAHTRYQVPPDCPPLVQKGECHVNFVRKEQCSFSWDWGPSFPTQGIWKDVRIEAYNICHLNYFTFSPIYDKSAQEWNLEIESTFDVVSSKPVGGQVIVAIPKLQTQQTYSIELQPGKRIVELFVNISKNITVETWWPHGHGNQTGYNMTVLFELDGGLNIEKSAKVYFRTVELIEEPIKGSPGLSFYFKINGFPIFLKGSNWIPADSFQDRVTSELLRLLLQSVVDANMNTLRVWGGGIYEQDEFYELCDELGIMVWQDFMFACALYPTDQGFLDSVTAEVAYQIKRLKSHPSIIIWSGNNENEEALMMNWYHISFTDRPIYIKDYVTLYVKNIRELVLAGDKSRPFITSSPTNGAETVAEAWVSQNPNSNYFGDVHFYDYISDCWNWKVFPKARFASEYGYQSWPSFSTLEKVSSTEDWSFNSKFSLHRQHHEGGNKQMLYQAGLHFKLPQSTDPLRTFKDTIYLTQVMQAQCVKTETEFYRRSRSEIVDQQGHTMGALYWQLNDIWQAPSWASLEYGGKWKMLHYFAQNFFAPLLPVGFENENTFYIYGVSDLHSDYSMTLSVRVHTWSSLEPVCSRVTERFVMKGGEAVCLYEEPVSELLRRCGNCTRESCVVSFYLSADHELLSPTNYHFLSSPKEAVGLCKAQITAIISQQGDIFVFDLETSAVAPFVWLDVGSIPGRFSDNGFLMTEKTRTILFYPWEPTSKNELEQSFHVTSLTDIY

SEQ ID NO: 8288 - protein, 509 aa, Homo Sapiens
MRLHLLLLLALCGAGTTAAELSYSLRGNWSICNGNGSLELPGAVPGCVHSALFQQGLIQDSYYRFNDLNYRWVSLDNWTYSKEFKIPFEISKWQKVNLILEGVDTVSKILFNEVTIGETDNMFNRYSFDITNVVRDVNSIELRFQSAVLYAAQQSKAHTRYQVPPDCPPLVQKGECHVNFVRKEQCSFSWDWGPSFPTQGIWKDVRIEAYNICHLNYFTFSPIYDKSAQEWNLEIESTFDVVSSKPVGGQVIVAIPKLQTQQTYSIELQPGKRIVELFVNISKNITVETWWPHGHGNQTGYNMTVLFELDGGLNIEKSAKVYFRTVELIEEPIKGSPGLSFYFKINGFPIFLKGSNWIPADSFQDRVTSELLRLLLQSVVDANMNTLRVWGGGIYEQDEFYELCDELGIMVWQDFMFACALYPTDQGFLDSVTAEVAYQIKRLKSHPSIIIWSGNNENEEALMMNWYHISFTDRPIYIKDYVTLYVKNIRELVLACGKMPDTIDLTNTC

SEQ ID NO: 8289 - protein, 886 aa, Homo Sapiens
MRLHLLLLLALCGAGTTAAELSYSLRGNWSICNGNGSLELPGAVPGCVHSALFQQGLIQDSYYRFNDLNYRWVSLDNWTYSKEFKIPFEISKWQKVNLILEGVDTVSKILFNEVTIGETDNMFNRYSFDITNVVRDVNSIELRFQSAVLYAAQQSKAHTRYQVPPDCPPLVQKGECHVNFVRKEQCSFSWDWGPSFPTQGIWKDVRIEAYNICHLNYFTFSPIYDKSAQEWNLEIESTFDVVSSKPVGGQVIVAIPKLQTQQTYSIELQPGKRIVELFVNISKNITVETWWPHGHGNQTGYNMTVLFELDGGLNIEKSAKVYFRTVELIEEPIKGSPGLSFYFKINGFPIFLKGSNWIPADSFQDRVTSELLRLLLQSVVDANMNTLRVWGGGIYEQDEFYELCDELGIMVWQDFMFACALYPTDQGFLDSVTAEVAYQIKRLKSHPSIIIWSGNNENEEALMMNWYHISFTDRPIYIKDYVTLYVKNIRELVLAGDKSRPFITSSPTNGAETVAEAWVSQNPNSNYFGDVHFYDYISDCWNWKVFPKARFASEYGYQSWPSFSTLEKVSSTEDWSFNSKFSLHRQHHEGGNKQMLYQAGLHFKLPQSTDPLRTFKDTIYLTQVMQAQCVKTETEFYRRSRSEIVDQQGHTMGALYWQLNDIWQAPSWASLEYGGKWKMLHYFAQNFFAPLLPVGFENENTFYIYGVSDLHSDYSMTLSVRVHTWSSLEPVCSRVTERFVMKGGEAVCLYEEPVSELLRRCGNCTRESCVVSFYLSADHELLSPTNYHFLSSPKEAVGLCKAQITGASLNPRLCSQTYREEISNPTKITSISMTPASLSALVLEQQKLMLPWQLPGQAGMSRMNLVPVAALGPSLEQLGGHHLSAR

SEQ ID NO: 8290 - protein, 397 aa, Homo Sapiens
MRLHLLLLLALCGAGTTAAELSYSLRGNWSICNGNGSLELPGAVPGCVHSALFQQGLIQDSYYRFNDLNYRWVSLDNWTYSKEFKIPFEISKWQKVNLILEGVDTVSKILFNEVTIGETDNMFNRYSFDITNVVRDVNSIELRFQSAVLYAAQQSKAHTRYQVPPDCPPLVQKGECHVNFVRKEQCSFSWDWGPSFPTQGIWKDVRIEAYNICHLNYFTFSPIYDKSAQEWNLEIESTFDVVSSKPVGGQVIVAIPKLQTQQTYSIELQPGKRIVELFVNISKNITVETWWPHGHGNQTGYNMTVLFELDGGLNIEKSAKVYFRTVELIEEPIKGSPGLSFYFKINGFPIFLKGSNWIPADSFQDRVTSEFWGWVGCGPSAQLGQLVTAPFTVCCGC

SEQ ID NO: 8291 - protein, 413 aa, Homo Sapiens
MRLHLLLLLALCGAGTTAAELSYSLRGNWSICNGNGSLELPGAVPGCVHSALFQQGLIQDSYYRFNDLNYRWVSLDNWTYSKEFKIPFEISKWQKVNLILEGVDTVSKILFNEVTIGETDNMFNRYSFDITNVVRDVNSIELRFQSAVLYAAQQSKAHTRYQVPPDCPPLVQKGECHVNFVRKEQCSFSWDWGPSFPTQGIWKDVRIEAYNICHLNYFTFSPIYDKSAQEWNLEIESTFDVVSSKPVGGQVIVAIPKLQTQQTYSIELQPGKRIVELFVNISKNITVETWWPHGHGNQTGYNMTVLFELDGGLNIEKSAKVYFRTVELIEEPIKGSPGLSFYFKINGFPIFLKGSNWIPADSFQDRVTSELLRLLLQSVVDANMNTLRVWGGGIYEQDEFYELCDELGIMVCI

SEQ ID NO: 8292 - protein, 879 aa, Homo Sapiens; identical to SEQ ID NO: 8287

SEQ ID NO: 8293 - protein, 365 aa, Homo Sapiens
MRLHLLLLLALCGAGTTAAELSYSLRGNWSICNGNGSLELPGAVPGCVHSALFQQGLIQDSYYRFNDLNYRWVSLDNWTYSKEFKIPFEISKWQKVNLILEGVDTVSKILFNEVTIGETDNMFNRYSFDITNVVRDVNSIELRFQSAVLYAAQQSKAHTRYQVPPDCPPLVQKGECHVNFVRKEQCSFSWDWGPSFPTQGIWKDVRIEAYNICHLNYFTFSPIYDKSAQEWNLEIESTFDVVSSKPVGGQVIVAIPKLQTQQTYSIELQPGKRIVELFVNISKNITVETWWPHGHGNQTGYNMTVLFELDGGLNIEKSAKSWRLESKIKVSAELCSFRRLWERILPCPFQFLIIAGNPWLVDASL

SEQ ID NO: 8294 - protein, 925 aa, Homo Sapiens
MRLHLLLLLALCGAGTTAAELSYSLRGNWSICNGNGSLELPGAVPGCVHSALFQQGLIQDSYYRFNDLNYRWVSLDNWTYSKEFKIPFEISKWQKVNLILEGVDTVSKILFNEVTIGETDNMFNRYSFDITNVVRDVNSIELRFQSAVLYAAQQSKAHTRYQVPPDCPPLVQKGECHVNFVRKEQCSFSWDWGPSFPTQGIWKDVRIEAYNICHLNYFTFSPIYDKSAQEWNLEIESTFDVVSSKPVGGQVIVAIPKLQTQQTYSIELQPGKRIVELFVNISKNITVETWWPHGHGNQTGYNMTVLFELDGGLNIEKSAKVYFRTVELIEEPIKGSPGLSFYFKINGFPIFLKGSNWIPADSFQDRVTSELFHKKMKFFSRHSHGIIGSIFFLFKCSSPLPAGAGLAVVLQPNWANWLRLLLQSVVDANMNTLRVWGGGIYEQDEFYELCDELGIMVWQDFMFACALYPTDQGFLDSVTAEVAYQIKRLKSHPSIIIWSGNNENEEALMMNWYHISFTDRPIYIKDYVTLYVKNIRELVLAGDKSRPFITSSPTNGAETVAEAWVSQNPNSNYFGDVHFYDYISDCWNWKVFPKARFASEYGYQSWPSFSTLEKVSSTEDWSFNSKFSLHRQHHEGGNKQMLYQAGLHFKLPQSTDPLRTFKDTIYLTQVMQAQCVKTETEFYRRSRSEIVDQQGHTMGALYWQLNDIWQAPSWASLEYGGKWKMLHYFAQNFFAPLLPVGFENENTFYIYGVSDLHSDYSMTLSVRVHTWSSLEPVCSRVTERFVMKGGEAVCLYEEPVSELLRRCGNCTRESCVVSFYLSADHELLSPTNYHFLSSPKEAVGLCKAQITAIISQQGDIFVFDLETSAVAPFVWLDVGSIPGRFSDNGFLMTEKTRTILFYPWEPTSKNELEQSFHVTSLTDIY

SEQ ID NO: 8295 - protein, 62 aa, Homo Sapiens
MRLHLLLLLALCGAGTTAAELSYSLRGNWSICNGNGSLELPGAVPGCVHSALFQQGLIQKEQ

SEQ ID NO: 8296 - protein, 68 aa, Homo Sapiens
MRLHLLLLLALCGAGTTAAELSYSLRGNWSICNGNGSLELPGAVPGCVHSALFQQGLIQSLTLSPRLE

SEQ ID NO: 8297 - protein, 199 aa, Homo Sapiens
MSKAEWDTDQWKTENYINESTEAQSKQKEQKSSEDSYYRFNDLNYRWVSLDNWTYSKEFKIPFEISKWQKVNLILEGVDTVSKILFNEVTIGETDNMFNRYSFDITNVVRDVNSIELRFQSAVLYAAQQSKAHTRYQVPPDCPPLVQKGECHVNFVRKEQCSFSWDWGPSFPTQGIWKDVRIEAYNICHLNYFTFSPIY

SEQ ID NO: 8298 - protein, 215 aa, Homo Sapiens
SKILFNEVTIGETDNMFNRYSFDITNVVRDVNSIELRFQSAVLYAAQQSKAHTRYQVPPDCPPLVQKGECHVNFVRKEQCSFSWDWGPSFPTQGIWKDVRIEAYNICHLNYFTFSPIYDKSAQEWNLEIESTFDVVSSKPVGGQVIVAIPKLQTQQTYSIELQPGKRIVELFVNISKNITVETWWPHGHGNQTGYNMTVLFELDGGLNIEKSAKL

SEQ ID NO: 8299 - protein, 230 aa, Homo Sapiens
  misc_feature (1)..(1): Xaa can be any naturally occurring amino acid
XDCPPLVQKGECHVNFVRKEQCSFSWDWGPSFPTQGIWKDVRIEAYNICHLNYFTFSPIYDKSAQEWNLEIESTFDVVSSKPVGGQVIVAIPKLQTQQTYSIELQPGKRIVELFVNISKNITVETWWPHGHGNQTGYNMTVLFELDGGLNIEKSAKVYFRTVELIEEPIKGSPGLSFYFKINGFPIFLKGSNWIPADSFQDRVTSEFWGWVGCGPSAQLGQLVSLPWCLC

SEQ ID NO: 8300 - protein, 263 aa, Homo Sapiens
MADDNGEPSDDLVPAILDTAHQYSIQVAFHIQPYKGRDDITVHDNIKYIIDTYGSHGAFYRYKNSMGKSLPLFYIYDSYLTSPEAWAHLLTPNGPHSIRNTPYDGVFIALLVEEGHTHDILAAGFDGMYTYFASNGFSFGSSHQNWKAVKNFCDANNLMFIPSVGPGYIDTSIRPWNNHNTRNRVNGKYYETALQAALTVRPEIVSITSFNEWHEGTQIEKAIPKKTPTRLYLDYLPHQPSLYLELTRRWAEHFIKEKEQWLM

SEQ ID NO: 8301 - protein, 250 aa, Homo Sapiens
MARRRRRACIALFLVLLFAFGTLMGLRTLKAPDGLPALGPGLELAPFERRPEGAPAPAARAPAAPAAPPPPPPPPRTADPGGSPGPAPAEAEPAPVQSLRVYSDLHAFYYSWYGSPRREGHYIHWDHVMVPHWDPKISASYPRGRHSPPDDLGSSFYPELGPYSSRDPEVLREHMTQLKEAAIGVLVLSWYPPGMADDNGEPSDDLVPAILDTAHQYSIQVAFHIQPYKGRDDITVHDNIKYIIDTTGKL

SEQ ID NO: 8302 - protein, 457 aa, Homo Sapiens
MARRRRRACIALFLVLLFAFGTLMGLRTLKAPDGLPALGPGLELAPFERRPEGAPAPAARAPAAPAAPPPPPPPPRTADPGGSPGPAPAEAEPAPVQSLRVYSDLHAFYYSWYGSPRREGHYIHWDHVMVPHWDPKISASYPRGRHSPPDDLGSSFYPELGPYSSRDPEVLREHMTQLKEAAIGVLVLSWYPPGMADDNGEPSDDLVPAILDTAHQYSIQVAFHIQPYKGRDDITVHDNIKYIIDTYGSHGAFYRYKNSMGKSLPLFYIYDSYLTSPEAWAHLLTPNGPHSIRNTPYDGVFIALLVEEGHTHDILAAGFDGMYTYFASNGFSFGSSHQNWKAVKNFCDANNLMFIPSVGPGYIDTSIRPWNNHNTRNRVNGKYYETALQAALTVRPEIVSITSFNEWHEGTQIEKAIPKKTPTRLYLDYLPHQPSLYLELTRRWAEHFIKEKEQWLM

SEQ ID NO: 8303 - protein, 235 aa, Homo Sapiens
MITGSPQMTWCPPFWTPPISTASRYGSHGAFYRYKNSMGKSLPLFYIYDSYLTSPEAWAHLLTPNGPHSIRNTPYDGVFIALLVEEGHTHDILAAGFDGMYTYFASNGFSFGSSHQNWKAVKNFCDANNLMFIPSVGPGYIDTSIRPWNNHNTRNRVNGKYYETALQAALTVRPEIVSITSFNEWHEGTQIEKAIPKKTPTRLYLDYLPHQPSLYLELTRRWAEHFIKEKEQWLM

SEQ ID NO: 8304 - protein, 130 aa, Homo Sapiens
VYSDLHAFYYSWYGSPRREGHYIHWDHVMVPHWDPKISASYPRGRHSPPDDLGSSFYPELGPYSSRDPEVLREHMTQLKEAAIGVLVLSWYPPGMADDNGEPSDDLVPAILDTAHQYSIQVWLPWCILPL

SEQ ID NO: 8305 - protein, 185 aa, Homo Sapiens
MRRMRRMWATQGLAVALALSVLPGSRALRPGDCEVCISYLGRFYQDLKDRDVTFSPATIENELIKFCREARGKENRLCYYIGATDDAATKIINEVSKPLAHHIPVEKICEKLKKKDSQICELKYDKQIDLSTVDLKKLRVKELKKILDDWGETCKGCAEKSDYIRKINELMPKYAPKAASARTDL

SEQ ID NO: 8306 - protein, 71 aa, Homo Sapiens
  misc_feature (1)..(1): Xaa can be any naturally occurring amino acid
XATQGLAVALALSVLPGSRALRPGDCEVCISYLGRFYQDLKDRDVTFSPATIENELIKFCREARGKENRLV

SEQ ID NO: 8307 - protein, 397 aa, Homo Sapiens
MFFGGEGSLTYTLGIRGNEPVYTSTQEDCINSCCSTKNISGDKACNLMIFDTRKTARQPNCYLFFCPNEEACPLKPAKGLMSYRIITDFPSLTRNLPSQELPQEDSLLHGQFSQAVTPLAHHHTDYSKPTDISWRDTLSQKFGSSDHLEKLFKMDEASAQLLAYKEKGHSQSSQFSSDQEIAHLLPENVSALPATVAVASPHTTSATPKPATLLPTNASVTPSGTSQPQLATTAPPVTTVTSQPPTTLISTVFTRAAATLQAMATTAVLTTTFQAPTDSKGSLETIPFTEISNLTLNTGNVYNPTALSMSNVESSTMNKTASWEGREASPGSSSQGSVPENQYGLPFEKWLLIGSLLFGVLFLVIGLVLLGRILSESLRRKRYSRLDYLINGIYVDI

SEQ ID NO: 8308 - protein, 57 aa, Homo Sapiens
MFFGGEGSLTYTLVIICFLTLRLSASQNCLKKSLEDVVIDIQSSLSKGIRGNEPVYT

SEQ ID NO: 8309 - protein, 431 aa, Homo Sapiens
MFFGGEGSLTYTLVIICFLTLRLSASQNCLKKSLEDVVIDIQSSLSKGIRGNEPVYTSTQEDCINSCCSTKNISGDKACNLMIFDTRKTARQPNCYLFFCPNEEACPLKPAKGLMSYRIITDFPSLTRNLPSQELPQEDSLLHGQFSQAVTPLAHHHTDYSKPTDISWRDTLSQKFGSSDHLEKLFKMDEASAQLLAYKEKGHSQSSQFSSDQEIAHLLPENVSALPATVAVASPHTTSATPKPATLLPTNASVTPSGTSQPQLATTAPPVTTVTSQPPTTLISTVFTRAAATLQAMATTAVLTTTFQAPTDSKGSLETIPFTEISNLTLNTGNVYNPTALSMSNVESSTMNKTASWEGREASPGSSSQGSVPENQYGLPFEKWLLIGSLLFGVLFLVIGLVLLGRILSESLRRKRYSRLDYLINGIYVDI

SEQ ID NO: 8310 - protein, 350 aa, Homo Sapiens
MIFDTRKTARQPNCYLFFCPNEEACPLKPAKGLMSYRIITDFPSLTRNLPSQELPQEDSLLHGQFSQAVTPLAHHHTDYSKPTDISWRDTLSQKFGSSDHLEKLFKMDEASAQLLAYKEKGHSQSSQFSSDQEIAHLLPENVSALPATVAVASPHTTSATPKPATLLPTNASVTPSGTSQPQLATTAPPVTTVTSQPPTTLISTVFTRAAATLQAMATTAVLTTTFQAPTDSKGSLETIPFTEISNLTLNTGNVYNPTALSMSNVESSTMNKTASWEGREASPGSSSQGSVPENQYGLPFEKWLLIGSLLFGVLFLVIGLVLLGRILSESLRRKRYSRLDYLINGIYVDI

SEQ ID NO: 8311 - protein, 832 aa, Homo Sapiens
MELTGLEVALVLILQKVENGDLSNKILKITDFGLAREWHRTTKMSAAGTYAWMAPEVIRASMFSKGSDVWSYGVLLWELLTGEVPFRGIDGLAVAYGVAMNKLALPIPSTCPEPFAKLMEDCWNPDPHSRPSFTNILDQLTTIEESGFFEMPKDSFHCLQDNWKHEIQEMFDQLRAKEKELRTWEEELTRAALQQKNQEELLRRREQELAEREIDILERELNIIIHQLCQEKPRVKKRKGKFRKSRLKLKDGNRISLPSDFQHKFTVQASPTMDKRKSLINSRSSPPASPTIIPRLRAIQLTPGESSKTWGRSSVVPKEEGEEEEKRAPKKKGRTWGPGTLGQKELASGDEGLKSLVDGYKQWSSSAPNLVKGPRSSPALPGFTSLMEMALLAASWVVPIDIEEDEDSEGPGSGESRLQHSPSQSYLCIPFPRGEDGDGPSSDGIHEEPTPVNSATSTPQLTPTNSLKRGGAHHRRCEVALLGCGAVLAATGLGFDLLEAGKCQLLPLEEPEPPAREEKKRREGLFQRSSRPRRSTSPPSRKLFKKEEPMLLLGDPSASLTLLSLSSISECNSTRSLLRSDSDEIVVYEMPVSPVEAPPLSPCTHNPLVNVRVERFKRDPNQSLTPTHVTLTTPSQPSSHRRTPSDGALKPETLLASRSPSSNGLSPSPGAGMLKTPSPSRDPGEFPRLPDPNVVFPPTPRRWNTQQDSTLERPKTLEFLPRPRPSANRQRLDPWWFVSPSHARSTSPANSSSTETPSNLDSCFASSSSTVEERPGLPALLPFQAGPLPPTERTLLDLDAEGQSQDSTVPLCRAELNTHRPAPYEIQQEFWS

SEQ ID NO: 8312 - protein, 880 aa, Homo Sapiens
MELTGLEVALVLILQKVENGDLSNKILKITDFGLAREWHRTTKMSAAGTYAWMAPEVIRASMFSKGSDVWSYGVLLWELLTGEVPFRGIDGLAVAYGVAMNKLALPIPSTCPEPFAKLMEDCWNPDPHSRPSFTNILDQLTTIEESGFFEMPKDSFHCLQDNWKHEIQEMFDQLRAKEKELRTWEEELTRAALQQKNQEELLRRREQELAEREIDILERELNIIIHQLCQEKPRVKKRKGKFRKSRLKLKDGNRISLPSDFQHKFTVQASPTMDKRKSLINSRSSPPASPTIIPRLRAIQCETVSQISWGQNTQGHLSPALSSHRLVQACSIHNFCHLSSTMCIYMHILTPGESSKTWGRSSVVPKEEGEEEEKRAPKKKGRTWGPGTLGQKELASGDEGLKSLVDGYKQWSSSAPNLVKGPRSSPALPGFTSLMEMALLAASWVVPIDIEEDEDSEGPGSGESRLQHSPSQSYLCIPFPRGEDGDGPSSDGIHEEPTPVNSATSTPQLTPTNSLKRGGAHHRRCEVALLGCGAVLAATGLGFDLLEAGKCQLLPLEEPEPPAREEKKRREGLFQRSSRPRRSTSPPSRKLFKKEEPMLLLGDPSASLTLLSLSSISECNSTRSLLRSDSDEIVVYEMPVSPVEAPPLSPCTHNPLVNVRVERFKRDPNQSLTPTHVTLTTPSQPSSHRRTPSDGALKPETLLASRSPSSNGLSPSPGAGMLKTPSPSRDPGEFPRLPDPNVVFPPTPRRWNTQQDSTLERPKTLEFLPRPRPSANRQRLDPWWFVSPSHARSTSPANSSSTETPSNLDSCFASSSSTVEERPGLPALLPFQAGPLPPTERTLLDLDAEGQSQDSTVPLCRAELNTHRPAPYEIQQEFWS

SEQ ID NO: 8313 - protein, 1081 aa, Homo Sapiens
MEPSRALLGCLASAAAAAPPGEDGAGAGAEEEEEEEEEAAAAVGPGELGCDAPLPYWTAVFEYEAAGEDELTLRLGDVVEVLSKDSQVSGDEGWWTGQLNQRVGIFPSNYVTPRSAFSSRCQPGGEDPSCYPPIQLLEIDFAELTLEEIIGIGGFGKVYRAFWIGDEVAVKAARHDPDEDISQTIENVRQEAKLFAMLKHPNIIALRGVCLKEPNLCLVMEFARGGPLNRVLSGKRIPPDILVNWAVQIARGMNYLHDEAIVPIIHRDLKSSNILILQKVENGDLSNKILKITDFGLAREWHRTTKMSAAGTYAWMAPEVIRASMFSKGSDVWSYGVLLWELLTGEVPFRGIDGLAVAYGVAMNKLALPIPSTCPEPFAKLMEDCWNPDPHSRPSFTNILDQLTTIEESGFFEMPKDSFHCLQDNWKHEIQEMFDQLRAKEKELRTWEEELTRAALQQKNQEELLRRREQELAEREIDILERELNIIIHQLCQEKPRVKKRKGKFRKSRLKLKDGNRISLPSDFQHKFTVQASPTMDKRKSLINSRSSPPASPTIIPRLRAIQLTPGESSKTWGRSSVVPKEEGEEEEKRAPKKKGRTWGPGTLGQKELASGDEGLKSLVDGYKQWSSSAPNLVKGPRSSPALPGFTSLMEMEDEDSEGPGSGESRLQHSPSQSYLCIPFPRGEDGDGPSSDGIHEEPTPVNSATSTPQLTPTNSLKRGGAHHRRCEVALLGCGAVLAATGLGFDLLEAGKCQLLPLEEPEPPAREEKKRREGLFQRSSRPRRSTSPPSRKLFKKEEPMLLLGDPSASLTLLSLSSISECNSTRSLLRSDSDEIVVYEMPVSPVEAPPLSPCTHNPLVNVRVERFKRDPNQSLTPTHVTLTTPSQPSSHRRTPSDGALKPETLLASRSPSSNGLSPSPGAGMLKTPSPSRDPGEFPRLPDPNVVFPPTPRRWNTQQDSTLERPKTLEFLPRPRPSANRQRLDPWWFVSPSHARSTSPANSSSTETPSNLDSCFASSSSTVEERPGLPALLPFQAGPLPPTERTLLDLDAEGQSQDSTVPLCRAELNTHRPAPYEIQQEFWS

SEQ ID NO: 8314 - protein, 1118 aa, Homo Sapiens
MEPSRALLGCLASAAAAAPPGEDGAGAGAEEEEEEEEEAAAAVGPGELGCDAPLPYWTAVFEYEAAGEDELTLRLGDVVEVLSKDSQVSGDEGWWTGQLNQRVGIFPSNYVTPRSAFSSRCQPGGEDPSCYPPIQLLEIDFAELTLEEIIGIGGFGKVYRAFWIGDEVAVKAARHDPDEDISQTIENVRQEAKLFAMLKHPNIIALRGVCLKEPNLCLVMEFARGGPLNRVLSGKRIPPDILVNWAVQIARGMNYLHDEAIVPIIHRDLKSSNILILQKVENGDLSNKILKITDFGLAREWHRTTKMSAAGTYAWMAPEVIRASMFSKGSDVWSYGVLLWELLTGEVPFRGIDGLAVAYGVAMNKLALPIPSTCPEPFAKLMEDCWNPDPHSRPSFTNILDQLTTIEESGFFEMPKDSFHCLQDNWKHEIQEMFDQLRAKEKELRTWEEELTRAALQQKNQEELLRRREQELAEREIDILERELNIIIHQLCQEKPRVKKRKGKFRKSRLKLKDGNRISLPSDFQHKFTVQASPTMDKRKSLINSRSSPPASPTIIPRLRAIQLTPGESSKTWGRSSVVPKEEGEEEEKRAPKKKGRTWGPGTLGQKELASGDEGSPQRREKANGLSTPSESPHFHLGLKSLVDGYKQWSSSAPNLVKGPRSSPALPGFTSLMEMALLAASWVVPIDIEEDEDSEGPGSGESRLQHSPSQSYLCIPFPRGEDGDGPSSDGIHEEPTPVNSATSTPQLTPTNSLKRGGAHHRRCEVALLGCGAVLAATGLGFDLLEAGKCQLLPLEEPEPPAREEKKRREGLFQRSSRPRRSTSPPSRKLFKKEEPMLLLGDPSASLTLLSLSSISECNSTRSLLRSDSDEIVVYEMPVSPVEAPPLSPCTHNPLVNVRVERFKRDPNQSLTPTHVTLTTPSQPSSHRRTPSDGALKPETLLASRSPSSNGLSPSPGAGMLKTPSPSRDPGEFPRLPDPNVVFPPTPRRWNTQQDSTLERPKTLEFLPRPRPSANRQRLDPWWFVSPSHARSTSPANSSSTETPSNLDSCFASSSSTVEERPGLPALLPFQAGPLPPTERTLLDLDAEGQSQDSTVPLCRAELNTHRPAPYEIQQEFWS

SEQ ID NO: 8315 - protein, 1104 aa, Homo Sapiens
MEPSRALLGCLASAAAAAPPGEDGAGAGAEEEEEEEEEAAAAVGPGELGCDAPLPYWTAVFEYEAAGEDELTLRLGDVVEVLSKDSQVSGDEGWWTGQLNQRVGIFPSNYVTPRSAFSSRCQPGGEDPSCYPPIQLLEIDFAELTLEEIIGIGGFGKVYRAFWIGDEVAVKAARHDPDEDISQTIENVRQEAKLFAMLKHPNIIALRGVCLKEPNLCLVMEFARGGPLNRVLSGKRIPPDILVNWAVQIARGMNYLHDEAIVPIIHRDLKSSNILILQKVENGDLSNKILKITDFGLAREWHRTTKMSAAGTYAWMAPEVIRASMFSKGSDVWSYGVLLWELLTGEVPFRGIDGLAVAYGVAMNKLALPIPSTCPEPFAKLMEDCWNPDPHSRPSFTNILDQLTTIEESGFFEMPKDSFHCLQDNWKHEIQEMFDQLRAKEKELRTWEEELTRAALQQKNQEELLRRREQELAEREIDILERELNIIIHQLCQEKPRVKKRKGKFRKSRLKLKDGNRISLPSDFQHKFTVQASPTMDKRKSLINSRSSPPASPTIIPRLRAIQLTPGESSKTWGRSSVVPKEEGEEEEKRAPKKKGRTWGPGTLGQKELASGDEGSPQRREKANGLSTPSESPHFHLGLKSLVDGYKQWSSSAPNLVKGPRSSPALPGFTSLMEMEDEDSEGPGSGESRLQHSPSQSYLCIPFPRGEDGDGPSSDGIHEEPTPVNSATSTPQLTPTNSLKRGGAHHRRCEVALLGCGAVLAATGLGFDLLEAGKCQLLPLEEPEPPAREEKKRREGLFQRSSRPRRSTSPPSRKLFKKEEPMLLLGDPSASLTLLSLSSISECNSTRSLLRSDSDEIVVYEMPVSPVEAPPLSPCTHNPLVNVRVERFKRDPNQSLTPTHVTLTTPSQPSSHRRTPSDGALKPETLLASRSPSSNGLSPSPGAGMLKTPSPSRDPGEFPRLPDPNVVFPPTPRRWNTQQDSTLERPKTLEFLPRPRPSANRQRLDPWWFVSPSHARSTSPANSSSTETPSNLDSCFASSSSTVEERPGLPALLPFQAGPLPPTERTLLDLDAEGQSQDSTVPLCRAELNTHRPAPYEIQQEFWS

SEQ ID NO: 8316 - protein, 837 aa, Homo Sapiens
MSAAGTYAWMAPEVIRASMFSKGSDVWSYGVLLWELLTGEVPFRGIDGLAVAYGVAMNKLALPIPSTCPEPFAKLMEDCWNPDPHSRPSFTNILDQLTTIEESGFFEMPKDSFHCLQDNWKHEIQEMFDQLRAKEKELRTWEEELTRAALQQKNQEELLRRREQELAEREIDILERELNIIIHQLCQEKPRVKKRKGKFRKSRLKLKDGNRISLPSDFQHKFTVQASPTMDKRKSLINSRSSPPASPTIIPRLRAIQCETVSQISWGQNTQGHLSPALSSHRLVQACSIHNFCHLSSTMCIYMHILTPGESSKTWGRSSVVPKEEGEEEEKRAPKKKGRTWGPGTLGQKELASGDEGLKSLVDGYKQWSSSAPNLVKGPRSSPALPGFTSLMEMALLAASWVVPIDIEEDEDSEGPGSGESRLQHSPSQSYLCIPFPRGEDGDGPSSDGIHEEPTPVNSATSTPQLTPTNSLKRGGAHHRRCEVALLGCGAVLAATGLGFDLLEAGKCQLLPLEEPEPPAREEKKRREGLFQRSSRPRRSTSPPSRKLFKKEEPMLLLGDPSASLTLLSLSSISECNSTRSLLRSDSDEIVVYEMPVSPVEAPPLSPCTHNPLVNVRVERFKRDPNQSLTPTHVTLTTPSQPSSHRRTPSDGALKPETLLASRSPSSNGLSPSPGAGMLKTPSPSRDPGEFPRLPDPNVVFPPTPRRWNTQQDSTLERPKTLEFLPRPRPSANRQRLDPWWFVSPSHARSTSPANSSSTETPSNLDSCFASSSSTVEERPGLPALLPFQAGPLPPTERTLLDLDAEGQSQDSTVPLCRAELNTHRPAPYEIQQEFWS

SEQ ID NO: 8317 - protein, 55 aa, Homo Sapiens
MFGQIQSPGYPDSYPSDSEVTWNITVPDGFRIKLYFMHFNLESSYLCEYDYVKVE

SEQ ID NO: 8318 - protein, 354 aa, Homo Sapiens
MFGQIQSPGYPDSYPSDSEVTWNITVPDGFRIKLYFMHFNLESSYLCEYDYVKVETEDQVLATFCGRETTDTEQTPGQEVVLSPGSFMSITFRSDFSNEERFTGFDAHYMAVDVDECKEREDEELSCDHYCHNYIGGYYCSCRFGYILHTDNRTCRVECSDNLFTQRTGVITSPDFPNPYPKSSECLYTIELEEGFMVNLQFEDIFDIEDHPEVPCPYDYIKIKVGPKVLGPFCGEKAPEPISTQSHSVLILFHSDNSGENRGWRLSYRAAGNECPELQPPVHGKIEPSQAKYFFKDQVLVSCDTGYKVLKDNVEMDTFQIECLKDGTWSNKIPTCKKNEIDLESELKSEQVTE

SEQ ID NO: 8319 - protein, 118 aa, Homo Sapiens
MPANSRDTQGPQNKDKASRTPHRARAHRWLLLYYALCFSLSKASAHTVELNNMFGQIQSPGYPDSYPSDSEVTWNITVPDGFRIKLYFMHFNLESSYLCEYDYVKVETEDQVLATFCG

SEQ ID NO: 8320 - protein, 205 aa, Homo Sapiens [sequence omitted]

SEQ ID NO: 8321 - protein, 380 aa, Homo Sapiens
MRWLLLYYALCFSLSKASAHTVELNNMFGQIQSPGYPDSYPSDSEVTWNITVPDGFRIKLYFMHFNLESSYLCEYDYVKVETEDQVLATFCGRETTDTEQTPGQEVVLSPGSFMSITFRSDFSNEERFTGFDAHYMAVDVDECKEREDEELSCDHYCHNYIGGYYCSCRFGYILHTDNRTCRVECSDNLFTQRTGVITSPDFPNPYPKSSECLYTIELEEGFMVNLQFEDIFDIEDHPEVPCPYDYIKIKVGPKVLGPFCGEKAPEPISTQSHSVLILFHSDNSGENRGWRLSYRAAGNECPELQPPVHGKIEPSQAKYFFKDQVLVSCDTGYKVLKDNVEMDTFQIECLKDGTWSNKIPTCKKNEIDLESELKSEQVTE

SEQ ID NO: 8322 - protein, 728 aa, Homo Sapiens
MRWLLLYYALCFSLSKASAHTVELNNMFGQIQSPGYPDSYPSDSEVTWNITVPDGFRIKLYFMHFNLESSYLCEYDYVKVETEDQVLATFCGRETTDTEQTPGQEVVLSPGSFMSITFRSDFSNEERFTGFDAHYMAVDVDECKEREDEELSCDHYCHNYIGGYYCSCRFGYILHTDNRTCRVECSDNLFTQRTGVITSPDFPNPYPKSSECLYTIELEEGFMVNLQFEDIFDIEDHPEVPCPYDYIKIKVGPKVLGPFCGEKAPEPISTQSHSVLILFHSDNSGENRGWRLSYRAAGNECPELQPPVHGKIEPSQAKYFFKDQVLVSCDTGYKVLKDNVEMDTFQIECLKDGTWSNKIPTCKIVDCRAPGELEHGLITFSTRNNLTTYKSEIKYSCQEPYYKMLNNNTGIYTCSAQGVWMNKVLGRSLPTCLPECGQPSRSLPSLVKRIIGGRNAEPGLFPWQALIVVEDTSRVPNDKWFGSGALLSASWILTAAHVLRSQRRDTTVIPVSKEHVTVYLGLHDVRDKSGAVNSSAARVVLHPDFNIQNYNHDIALVQLQEPVPLGPHVMPVCLPRLEPEGPAPHMLGLVAGWGISNPNVTVDEIISSGTRTLSDVLQYVKLPVVPHAECKTSYESRSGNYSVTENMFCAGYYEGGKDTCLGDSGGAFVIFDDLSQRWVVQGLVSWGGPEECGSKQVYGVYTKVSNYVDWVWEQMGLPQSVVEPQVER

SEQ ID NO: 8323 - protein, 699 aa, Homo Sapiens
MRWLLLYYALCFSLSKASAHTVELNNMFGQIQSPGYPDSYPSDSEVTWNITVPDGFRIKLYFMHFNLESSYLCEYDYVKVETEDQVLATFCGRETTDTEQTPGQEVVLSPGSFMSITFRSDFSNEERFTGFDAHYMAVDVDECKEREDEELSCDHYCHNYIGGYYCSCRFGYILHTDNRTCRVECSDNLFTQRTGVITSPDFPNPYPKSSECLYTIELEEGFMVNLQFEDIFDIEDHPEVPCPYDYIKIKVGPKVLGPFCGEKAPEPISTQSHSVLILFHSDNSGENRGWRLSYRAAGNECPELQPPVHGKIEPSQAKYFFKDQVLVSCDTGYKVLKDNVEMDTFQIECLKDGTWSNKIPTCKIVDCRAPGELEHGLITFSTRNNLTTYKSEIKYSCQEPYYKMLNNNTGIYTCSAQGVWMNKVLGRSLPTCLPVCGLPKFSRKLMARIFNGRPAQKGTTPWIAMLSHLNGQPFCGGSLLGSSWIVTAAHCLHQSLDPEDPTLRDSDLLSPSDFKIILGKHWRLRSDENEQHLGVKHTTLHPQYDPNTFENDVALVELLESPVLNAFVMPICLPEGPQQEGAMVIVSGWGKQFLQRFPETLMEIEIPIVDHSTCQKAYAPLKKKVTRDMICAGEKEGGKDACAGDSGGPMVTLNRERGQWYLVGTVSWGDDCGKKDRYGVYSYIHHNKDWIQRVTGVRN

SEQ ID NO: 8324 - protein, 615 aa, Homo Sapiens
MSITFRSDFSNEERFTGFDAHYMAVDVDECKEREDEELSCDHYCHNYIGGYYCSCRFGYILHTDNRTCRVECSDNLFTQRTGVITSPDFPNPYPKSSECLYTIELEEGFMVNLQFEDIFDIEDHPEVPCPYDYIKIKVGPKVLGPFCGEKAPEPISTQSHSVLILFHSDNSGENRGWRLSYRAAGNECPELQPPVHGKIEPSQAKYFFKDQVLVSCDTGYKVLKDNVEMDTFQIECLKDGTWSNKIPTCKIVDCRAPGELEHGLITFSTRNNLTTYKSEIKYSCQEPYYKMLNNNTGIYTCSAQGVWMNKVLGRSLPTCLPECGQPSRSLPSLVKRIIGGRNAEPGLFPWQALIVVEDTSRVPNDKWFGSGALLSASWILTAAHVLRSQRRDTTVIPVSKEHVTVYLGLHDVRDKSGAVNSSAARVVLHPDFNIQNYNHDIALVQLQEPVPLGPHVMPVCLPRLEPEGPAPHMLGLVAGWGISNPNVTVDEIISSGTRTLSDVLQYVKLPVVPHAECKTSYESRSGNYSVTENMFCAGYYEGGKDTCLGDSGGAFVIFDDLSQRWVVQGLVSWGGPEECGSKQVYGVYTKVSNYVDWVWEQMGLPQSVVEPQVER

SEQ ID NO: 8325 - protein, 686 aa, Homo Sapiens
MRLLTLLGLLCGSVATPLGPKWPEPVFGRLASPGFPGEYANDQERRWTLTAPPGYRLRLYFTHFDLELSHLCEYDFVKLSSGAKVLATLCGQESTDTERAPGKDTFYSLGSSLDITFRSDYSNEKPFTGFEAFYAAEDIDECQVAPGEAPTCDHHCHNHLGGFYCSCRAGYVLHRNKRTCSALCSGQVFTQRSGELSSPEYPRPYPKLSSCTYSISLEEGFSVILDFVESFDVETHPETLCPYDFLKIQTDREEHGPFCGKTLPHRIETKSNTVTITFVTDESGDHTGWKIHYTSTAQPCPYPMAPPNGHVSPVQAKYILKDSFSIFCETGYELLQGHLPLKSFTAVCQKDGSWDRPMPACSIVDCGPPDDLPSGRVEYITGPGVTTYKAVIQYSCEETFYTMKVNDGKYVCEADGFWTSSKGEKSLPVCEPVCGLSARTTGGRIYGGQKAKPGDFPWQVLILGGTTAAGALLYDNWVLTAAHAVYEQKHDASALDIRMGTLKRLSPHYTQAWSEAVFIHEGYTHDAGFDNDIALIKLNNKVVINSNITPICLPRKEAESFMRTDDIGTASGWGLTQRGFLARNLMYVDIPIVDHQKCTAAYEKPPYPRGSVTANMLCAGLESGGKDSCRGDSGGALVFLDSETERWFVGGIVSWGSMNCGEAGQYGVYTKVINYIPWIENIISDF

SEQ ID NO: 8326 - protein, 185 aa, Homo Sapiens
MRLLTLLGLLCGSVATPLGPKWPEPVFGRLASPGFPGEYANDQERRWTLTAPPGYRLRLYFTHFDLELSHLCEYDFVKLSSGAKVLATLCGQESTDTERAPGKDTFYSLGSSLDITFRSDYSNEKPFTGFEAFYAAEDIDECQVAPGEAPTCDHHCHNHLGGFYCSCRAGYVLHRNKRTCSEQSL

SEQ ID NO: 8327 - protein, 496 aa, Homo Sapiens
MRVLSGTSLMLCSLLLLLQALCSPGLAPQSRGHLCRTRPTDLVFVVDSSRSVRPVEFEKVKVFLSQVIESLDVGPNATRVGMVNYASTVKQEFSLRAHVSKAALLQAVRRIQPLSTGTMTGLAIQFAITKAFGDAEGGRSRSPDISKVVIVVTDGRPQDSVQDVSARARASGVELFAIGVGSVDKATLRQIASEPQDEHVDYVESYSVIEKLSRKFQEAFCVVSDLCATGDHDCEQVCISSPGSYTCACHEGFTLNSDGKTCNVCSGGGGSSATDLVFLIDGSKSVRPENFELVKKFISQIVDTLDVSDKLAQVGLVQYSSSVRQEFPLGRFHTKKDIKAAVRNMSYMEKGTMTGAALKYLIDNSFTVSSGARPGAQKVGIVFTDGRSQDYINDAAKKAKDLGFKMFAVGVGNAVEDELREIASEPVAEHYFYTADFKTINQIGKKLQKKICVEEDPCACESLVKFQAKVEGLLQALTRKLEAVSKRLAILENTVV

SEQ ID NO: 8328 - protein, 115 aa, Homo Sapiens
MEDHNCEQLCVNVPGSFVCQCYSGYALAEDGKRCVAVDYCASENHGCEHECVNADGSYLCQCHEGFALNPDKKTCTKIDYCASSNHGCQHECVNTDDSYSCHCLKGFTLNPDKKT

SEQ ID NO: 8329 - protein, 672 aa, Homo Sapiens
MEDHNCEQLCVNVPGSFVCQCYSGYALAEDGKRCVAVDYCASENHGCEHECVNADGSYLCQCHEGFALNPDKKTCTKIDYCASSNHGCQHECVNTDDSYSCHCLKGFTLNPDKKTCRRINYCALNKPGCEHECVNMEESYYCRCHRGYTLDPNGKTCSRVDHCAQQDHGCEQLCLNTEDSFVCQCSEGFLINEDLKTCSRVDYCLLSDHGCEYSCVNMDRSFACQCPEGHVLRSDGKTCAKLDSCALGDHGCEHSCVSSEDSFVCQCFEGYILREDGKTCRRKDVCQAIDHGCEHICVNSDDSYTCECLEGFRLAEDGKRCRRKDVCKSTHHGCEHICVNNGNSYICKCSEGFVLAEDGRRCKKCTEGPIDLVFVIDGSKSLGEENFEVVKQFVTGIIDSLTISPKAARVGLLQYSTQVHTEFTLRNFNSAKDMKKAVAHMKYMGKGSMTGLALKHMFERSFTQGEGARPLSTRVPRAAIVFTDGRAQDDVSEWASKAKANGITMYAVGVGKAIEEELQEIASEPTNKHLFYAEDFSTMDEISEKLKKGICEALEDSDGRQDSPAGELPKTVQQPTESEPVTINIQDLLSCSNFAVQHRYLFEEDNLLRSTQKLSHSTKPSGSPLEEKHDQCKCENLIMFQNLANEEVRKLTQRLEEMTQRMEALENRLRYR

SEQ ID NO: 8330 - protein, 956 aa, Homo Sapiens
MEKMLAGCFLLILGQIVLLPAEARERSRGRSISRGRHARTHPQTALLESSCENKRADLVFIIDSSRSVNTHDYAKVKEFIVDILQFLDIGPDVTRVGLLQYGSTVKNEFSLKTFKRKSEVERAVKRMRHLSTGTMTGLAIQYALNIAFSEAEGARPLRENVPRVIMIVTDGRPQDSVAEVAAKARDTGILIFAIGVGQVDFNTLKSIGSEPHEDHVFLVANFSQIETLTSVFQKKLCTAHMCSTLEHNCAHFCINIPGSYVCRCKQGYILNSDQTTCRIQDLCAMEDHNCEQLCVNVPGSFVCQCYSGYALAEDGKRCVAVDYCASENHGCEHECVNADGSYLCQCHEGFALNPDKKTCTKIDYCASSNHGCQHECVNTDDSYSCHCLKGFTLNPDKKTCRRINYCALNKPGCEHECVNMEESYYCRCHRGYTLDPNGKTCSRVDHCAQQDHGCEQLCLNTEDSFVCQCSEGFLINEDLKTCSRVDYCLLSDHGCEYSCVNMDRSFACQCPEGHVLRSDGKTCAKLDSCALGDHGCEHSCVSSEDSFVCQCFEGYILREDGKTCRRKDVCQAIDHGCEHICVNSDDSYTCECLEGFRLAEDGKRCRRKDVCKSTHHGCEHICVNNGNSYICKCSEGFVLAEDGRRCKKCTEGPIDLVFVIDGSKSLGEENFEVVKQFVTGIIDSLTISPKAARVGLLQYSTQVHTEFTLRNFNSAKDMKKAVAHMKYMGKGSMTGLALKHMFERSFTQGEGARPLSTRVPRAAIVFTDGRAQDDVSEWASKAKANGITMYAVGVGKAIEEELQEIASEPTNKHLFYAEDFSTMDEISEKLKKGICEALEDSDGRQDSPAGELPKTVQQPTESEPVTINIQDLLSCSNFAVQHRYLFEEDNLLRSTQKLSHSTKPSGSPLEEKHDQCKCENLIMFQNLANEEVRKLTQRLEEMTQRMEALENRLRYR

SEQ ID NO: 8331 - protein, 915 aa, Homo Sapiens
MEKMLAGCFLLILGQIVLLPAEARERSRGRSISRGRHARTHPQTALLESSCENKRADLVFIIDSSRSVNTHDYAKVKEFIVDILQFLDIGPDVTRVGLLQYGSTVKNEFSLKTFKRKSEVERAVKRMRHLSTGTMTGLAIQYALNIAFSEAEGARPLRENVPRVIMIVTDGRPQDSVAEVAAKARDTGILIFAIGVGQVDFNTLKSIGSEPHEDHVFLVANFSQIETLTSVFQKKLCTAHMCSTLEHNCAHFCINIPGSYVCRCKQGYILNSDQTTCRIQDLCAMEDHNCEQLCVNVPGSFVCQCYSGYALAEDGKRCVAVDYCASENHGCEHECVNADGSYLCQCHEGFALNPDKKTCTRINYCALNKPGCEHECVNMEESYYCRCHRGYTLDPNGKTCSRVDHCAQQDHGCEQLCLNTEDSFVCQCSEGFLINEDLKTCSRVDYCLLSDHGCEYSCVNMDRSFACQCPEGHVLRSDGKTCAKLDSCALGDHGCEHSCVSSEDSFVCQCFEGYILREDGKTCRRKDVCQAIDHGCEHICVNSDDSYTCECLEGFRLAEDGKRCRRKDVCKSTHHGCEHICVNNGNSYICKCSEGFVLAEDGRRCKKCTEGPIDLVFVIDGSKSLGEENFEVVKQFVTGIIDSLTISPKAARVGLLQYSTQVHTEFTLRNFNSAKDMKKAVAHMKYMGKGSMTGLALKHMFERSFTQGEGARPLSTRVPRAAIVFTDGRAQDDVSEWASKAKANGITMYAVGVGKAIEEELQEIASEPTNKHLFYAEDFSTMDEISEKLKKGICEALEDSDGRQDSPAGELPKTVQQPTESEPVTINIQDLLSCSNFAVQHRYLFEEDNLLRSTQKLSHSTKPSGSPLEEKHDQCKCENLIMFQNLANEEVRKLTQRLEEMTQRMEALENRLRYR

SEQ ID NO: 8332 - protein, 956 aa, Homo Sapiens; identical to SEQ ID NO: 8330

SEQ ID NO: 8333 - protein, 937 aa, Homo Sapiens
MEKMLAGCFLLILGQIVLLPAEARERSRGRSISRGRHARTHPQTALLESSCENKRADLVFIIDSSRSVNTHDYAKVKEFIVDILQFLDIGPDVTRVGLLQYGSTVKNEFSLKTFKRKSEVERAVKRMRHLSTGTMTGLAIQYALNIAFSEAEGARPLRENVPRVIMIVTDGRPQDSVAEVAAKARDTGILIFAIGVGQVDFNTLKSIGSEPHEDHVFLVANFSQIETLTSVFQKKLCTAHMCSTLEHNCAHFCINIPGSYVCRCKQGYILNSDQTTCRIQDLCAMEDHNCEQLCVNVPGSFVCQCYSGYALAEDGKRCVAVDYCASENHGCEHECVNADGSYLCQCHEGFALNPDKKTCTKIDYCASSNHGCQHECVNTDDSYSCHCLKGFTLNPDKKTCRRINYCALNKPGCEHECVNMEESYYCRCHRGYTLDPNGKTCSRVDHCAQQDHGCEQLCLNTEDSFVCQCSEGFLINEDLKTCSRVDYCLLSDHGCEYSCVNMDRSFACQCPEGHVLRSDGKTCAKLDSCALGDHGCEHSCVSSEDSFVCQCFEGYILREDGKTCRRKDVCQAIDHGCEHICVNSDDSYTCECLEGFRLAEDGKRCRRKDVCKSTHHGCEHICVNNGNSYICKCSEGFVLAEDGRRCKKCTEGPIDLVFVIDGSKSLGEENFEVVKQFVTGIIDSLTISPKAARVGLLQYSTQVHTEFTLRNFNSAKDMKKAVAHMKYMGKGSMTGLALKHMFERSFTQGEGARPLSTRVPRAAIVFTDGRAQDDVSEWASKAKANGITMYAVGVGKAIEEELQEIASEPTNKHLFYAEDFSTMDEISEKLKKGICEALEDSDGRQDSPAGELPKTVQQPTVQHRYLFEEDNLLRSTQKLSHSTKPSGSPLEEKHDQCKCENLIMFQNLANEEVRKLTQRLEEMTQRMEALENRLRYR

SEQ ID NO: 8334 - protein, 195 aa, Homo Sapiens
QCYSGYALAEDGKRCVAVDYCASENHGCEHECVNADGSYLCQCHEGFALNPDKKTCTKIDYCASSNHGCQHECVNTDDSYSCHCLKGFTLNPDKKTCRSLPFFPSGINYCALNKPGCEHECVNMEESYYCRCHRGYTLDPNGKTCSRVDHCAQQDHGCEQLCLNTEDSFVCQCSEGFLINEDLKTCSRVDYCLLS

SEQ ID NO: 8335 - protein, 720 aa, Homo Sapiens
  misc_feature (1)..(1): Xaa can be any naturally occurring amino acid
XAEVAAKARDTGILIFAIGVGQVDFNTLKSIGSEPHEDHVFLVANFSQIETLTSVFQKKLCTAHMCSTLEHNCAHFCINIPGSYVCRCKQGYILNSDQTTCRTVDYCASENHGCEHECVNADGSYLCQCHEGFALNPDKKTCTKIDYCASSNHGCQHECVNTDDSYSCHCLKGFTLNPDKKTCRRINYCALNKPGCEHECVNMEESYYCRCHRGYTLDPNGKTCSRVDHCAQQDHGCEQLCLNTEDSFVCQCSEGFLINEDLKTCSRVDYCLLSDHGCEYSCVNMDRSFACQCPEGHVLRSDGKTCAKLDSCALGDHGCEHSCVSSEDSFVCQCFEGYILREDGKTCRRKDVCQAIDHGCEHICVNSDDSYTCECLEGFRLAEDGKRCRRKDVCKSTHHGCEHICVNNGNSYICKCSEGFVLAEDGRRCKKCTEGPIDLVFVIDGSKSLGEENFEVVKQFVTGIIDSLTISPKAARVGLLQYSTQVHTEFTLRNFNSAKDMKKAVAHMKYMGKGSMTGLALKHMFERSFTQGEGARPLSTRVPRAAIVFTDGRAQDDVSEWASKAKANGITMYAVGVGKAIEEELQEIASEPTNKHLFYAEDFSTMDEISEKLKKGICEALEDSDGRQDSPAGELPKTVQQPTVQHRYLFEEDNLLRSTQKLSHSTKPSGSPLEEKHDQCKCENLIMFQNLANEEVRKLTQRLEEMTQRMEALENRLRYR

SEQ ID NO: 8336 - protein, 183 aa, Homo Sapiens
  misc_feature (1)..(1): Xaa can be any naturally occurring amino acid
XDSCALGDHGCEHSCVSSEDSFVCQCFEGYILREDGKTCRRKDVCQAIDHGCEHICVNSDDSYTCECLEGFRLAEDGKRCRKCTEGPIDLVFVIDGSKSLGEENFEVVKQFVTGIIDSLTISPKAARVGLLQYSTQVHTEFTLRNFNSAKDMKKAVAHMKYMGKGSMTGLALKHMFERSFTQG

SEQ ID NO: 8337 - protein, 131 aa, Homo Sapiens
  misc_feature (1)..(1): Xaa can be any naturally occurring amino acid
XEDSDGRQDSPAGELPKTVQQPTESEPVTINIQDLLSCSNFAVQHRYLFEEDNLLRSTQKLSHSTKPSGSPLEEKHDQCKCENLIMFQNLANEEVRKLTQRYILFLHYASVWNAKNIIKTSHTLCRFYQLK

SEQ ID NO: 8338 - protein, 176 aa, Homo Sapiens
  misc_feature (1)..(1): Xaa can be any naturally occurring amino acid
XFTQGEGARPLSTRVPRAAIVFTDGRAQDDVSEWASKAKANGITMYAVGVGKAIEEELQEIASEPTNKHLFYAEDFSTMDEISEKLKKGICEALEDSDGRQDSPAGELPKTVQQPTVQHRYLFEEDNLLRSTQKLSHSTKPSGSPLEEKHDQCKCENLIMFQNLANEEQRSSLSAL

SEQ ID NO: 8339 - protein, 181 aa, Homo Sapiens
  misc_feature (1)..(1): Xaa can be any naturally occurring amino acid
XSIGSEPHEDHVFLVANFSQIETLTSVFQKKLCIQDLCAMEDHNCEQLCVNVPGSFVCQCYSGYALAEDGKRCVAVDYCASENHGCEHECVNADGSYLCQCHEGFALNPDKKTCTKIDYCASSNHGCQHECVNTDDSYSCHCLKGFTLNPDKKTCRRINYCALNKPGCEHECVNMEESYYC

SEQ ID NO: 8340 - protein, 155 aa, Homo Sapiens
  misc_feature (1)..(1): Xaa can be any naturally occurring amino acid
XVDYCLLSDHGCEYSCVNMDRSFACQCPEGHVLRSDGKTCAKLDSCALGDHGCEHSCVSSEDSFVCQCFEGYILREDGKTCRRKDVCQAIDHGCEHICVNSDDSYTCECLEGFRLAEDGKRCRSKMSANQPTMAANTFVLIMGIPTSANAQRDLF

SEQ ID NO: 8341 - protein, 444 aa, Homo Sapiens
MPRPAPARRLPGLLLLLWPLLLLPSAAPDPVARPGFRRLETRGPGGSPGRRPSPAAPDGAPASGTSEPGRARGAGVCKSRPLDLVFIIDSSRSVRPLEFTKVKTFVSRIIDTLDIGPADTRVAVVNYASTVKIEFQLQAYTDKQSLKQAVGRITPLSTGTMSGLAIQTAMDEAFTVEAGAREPSSNIPKVAIIVTDGRPQDQVNEVAARAQASGIELYAVGVDRADMASLKMMASEPLEEHVFYVETYGVIEKLSSRFQETFCALDRCALNTHGCEHICVNDRSGSYHCECYEGYTLNEDRKTCSAQDKCALGTHGCQHICVNDRTGSHHCECYEGYTLNADKKTCSVRDKCALGSHGCQHICVSDGAASYHCDCYPGYTLNEDKKTCSATEEARRLVSTEDACGCEATLAFQDKVSSYLQRLNTKLDDILEKLKINEYGQIHR

SEQ ID NO: 8342 - protein, 486 aa, Homo Sapiens
MPRPAPARRLPGLLLLLWPLLLLPSAAPDPVARPGFRRLETRGPGGSPGRRPSPAAPDGAPASGTSEPGRARGAGVCKSRPLDLVFIIDSSRSVRPLEFTKVKTFVSRIIDTLDIGPADTRVAVVNYASTVKIEFQLQAYTDKQSLKQAVGRITPLSTGTMSGLAIQTAMDEAFTVEAGAREPSSNIPKVAIIVTDGRPQDQVNEVAARAQASGIELYAVGVDRADMASLKMMASEPLEEHVFYVETYGVIEKLSSRFQETFCALDPCVLGTHQCQHVCISDGEGKHHCECSQGYTLNADKKTCSALDRCALNTHGCEHICVNDRSGSYHCECYEGYTLNEDRKTCSAQDKCALGTHGCQHICVNDRTGSHHCECYEGYTLNADKKTCSVRDKCALGSHGCQHICVSDGAASYHCDCYPGYTLNEDKKTCSATEEARRLVSTEDACGCEATLAFQDKVSSYLQRLNTKLDDILEKLKINEYGQIHR

SEQ ID NO: 8343 - protein, 581 aa, Homo Sapiens
MRGLLCWPVLLLLLQPWETQLQLTGPRCHTGPLDLVFVIDSSRSVRPFEFETMRQFLMGLLRGLNVGPNATRVGVIQYSSQVQSVFPLRAFSRREDMERAIRDLVPLAQGTMTGLAIQYAMNVAFSVAEGARPPEERVPRVAVIVTDGRPQDRVAEVAAQARARGIEIYAVGVQRADVGSLRAMASPPLDEHVFLVESFDLIQEFGLQFQSRLCAIDLCAEGTHGCEHHCVNSPGSYFCHCQVGFVLQQDQRSCRAIDYCSFGNHSCQHECVSTPGGPRCHCREGHDLQPDGRSCQVRDLCNGVDHGCEFQCVSEGLSYRCLCPEGRQLQADGKSCNRCREGHVDLVLLVDGSKSVRPQNFELVKRFVNQIVDFLDVSPEGTRVGLVQFSSRVRTEFPLGRYGTAAEVKQAVLAVEYMERGTMTGLALRHMVEHSFSEAQGARPRALNVPRVGLVFTDGRSQDDISVWAARAKEEGIVMYAVGVGKAVEAELREIASEPAELHVSYAPDFGTMTHLLENLRGSICPEEGISAGTELRSPCECESLVEFQGRTLGALESLTLNLAQLTARLEDLENQLANQK

SEQ ID NO: 8344 - protein, 581 aa, Homo Sapiens; identical to SEQ ID NO: 8343

SEQ ID NO: 8345 - protein, 540 aa, Homo Sapiens
MRGLLCWPVLLLLLQPWETQLQLTGPRCHTGPLDLVFVIDSSRSVRPFEFETMRQFLMGLLRGLNVGPNATRVGVIQYSSQVQSVFPLRAFSRREDMERAIRDLVPLAQGTMTGLAIQYAMNVAFSVAEGARPPEERVPRVAVIVTDGRPQDRVAEVAAQARARGIEIYAVGVQRADVGSLRAMASPPLDEHVFLVESFDLIQEFGLQFQSRLCAIDYCSFGNHSCQHECVSTPGGPRCHCREGHDLQPDGRSCQVRDLCNGVDHGCEFQCVSEGLSYRCLCPEGRQLQADGKSCNRCREGHVDLVLLVDGSKSVRPQNFELVKRFVNQIVDFLDVSPEGTRVGLVQFSSRVRTEFPLGRYGTAAEVKQAVLAVEYMERGTMTGLALRHMVEHSFSEAQGARPRALNVPRVGLVFTDGRSQDDISVWAARAKEEGIVMYAVGVGKAVEAELREIASEPAELHVSYAPDFGTMTHLLENLRGSICPEEGISAGTELRSPCECESLVEFQGRTLGALESLTLNLAQLTARLEDLENQLANQK

SEQ ID NO: 8346 - protein, 622 aa, Homo Sapiens
MRGLLCWPVLLLLLQPWETQLQLTGPRCHTGPLDLVFVIDSSRSVRPFEFETMRQFLMGLLRGLNVGPNATRVGVIQYSSQVQSVFPLRAFSRREDMERAIRDLVPLAQGTMTGLAIQYAMNVAFSVAEGARPPEERVPRVAVIVTDGRPQDRVAEVAAQARARGIEIYAVGVQRADVGSLRAMASPPLDEHVFLVESFDLIQEFGLQFQSRLCGKDQCAEGGHGCQHQCVNAWAMFHCTCNPGYKLAADNKSCLAIDLCAEGTHGCEHHCVNSPGSYFCHCQVGFVLQQDQRSCRAIDYCSFGNHSCQHECVSTPGGPRCHCREGHDLQPDGRSCQVRDLCNGVDHGCEFQCVSEGLSYRCLCPEGRQLQADGKSCNRCREGHVDLVLLVDGSKSVRPQNFELVKRFVNQIVDFLDVSPEGTRVGLVQFSSRVRTEFPLGRYGTAAEVKQAVLAVEYMERGTMTGLALRHMVEHSFSEAQGARPRALNVPRVGLVFTDGRSQDDISVWAARAKEEGIVMYAVGVGKAVEAELREIASEPAELHVSYAPDFGTMTHLLENLRGSICPEEGISAGTELRSPCECESLVEFQGRTLGALESLTLNLAQLTARLEDLENQLANQK

SEQ ID NO: 8347 - protein, 499 aa, Homo Sapiens
MRGLLCWPVLLLLLQPWETQLQLTGPRCHTGPLDLVFVIDSSRSVRPFEFETMRQFLMGLLRGLNVGPNATRVGVIQYSSQVQSVFPLRAFSRREDMERAIRDLVPLAQGTMTGLAIQYAMNVAFSVAEGARPPEERVPRVAVIVTDGRPQDRVAEVAAQARARGIEIYAVGVQRADVGSLRAMASPPLDEHVFLVESFDLIQEFGLQFQSRLCVRDLCNGVDHGCEFQCVSEGLSYRCLCPEGRQLQADGKSCNRCREGHVDLVLLVDGSKSVRPQNFELVKRFVNQIVDFLDVSPEGTRVGLVQFSSRVRTEFPLGRYGTAAEVKQAVLAVEYMERGTMTGLALRHMVEHSFSEAQGARPRALNVPRVGLVFTDGRSQDDISVWAARAKEEGIVMYAVGVGKAVEAELREIASEPAELHVSYAPDFGTMTHLLENLRGSICPEEGISAGTELRSPCECESLVEFQGRTLGALESLTLNLAQLTARLEDLENQLANQK

SEQ ID NO: 8348 - protein, 121 aa, Homo Sapiens
MDFQRGKNLRYQLLQLVEPFGVISNHLILNKINEAFIEMATTEDAQAAVDYYTTTPALVFGKPVRVHLSQKYKRIKKPEGKPDQKFDQKQELGRVIHLSNLPHSGYSDSAVLKLAEPYGKI

SEQ ID NO: 8349 - protein, 6 aa, Homo Sapiens
MGDPFM

SEQ ID NO: 8350 - protein, 25 aa, Homo Sapiens
MGDPFMLQQSTNPAPGILGPPPPSF

SEQ ID NO: 8351 - protein, 81 aa, Homo Sapiens
MGDPFMLQQSTNPAPGILGPPPPSFHLGGPAVGPRGNLGAGNGNLQGPRHMQKGRVETSRVVHIMDFQRGKNLRYQLLQLV

SEQ ID NO: 8352 - protein, 86 aa, Homo Sapiens
MGDPFMLQQSTNPAPGILGPPPPSFHLGGPAVGPRGNLGAGNGNLQGPRHMQKGRVETSRVVHIMDFQRGKNLRYQLLQLVEPFGV

SEQ ID NO: 8353 - protein, 109 aa, Homo Sapiens
MGDPFMLQQSTNPAPGILGPPPPSFHLGGPAVGPRGNLGAGNGNLQGPRHMQKGRVETSRVVHIMDFQRGKNLRYQLLQLVEPFGVISNHLILNKINEAFIEMATTEDA

SEQ ID NO: 8354 - protein, 125 aa, Homo Sapiens
MGDPFMLQQSTNPAPGILGPPPPSFHLGGPAVGPRGNLGAGNGNLQGPRHMQKGRVETSRVVHIMDFQRGKNLRYQLLQLVEPFGVISNHLILNKINEAFIEMATTEDAQAAVDYYTTTPALVFG

SEQ ID NO: 8355 - protein, 509 aa, Homo Sapiens
MGDPFMLQQSTNPAPGILGPPPPSFHLGGPAVGPRGNLGAGNGNLQGPRHMQKGRVETSRVVHIMDFQRGKNLRYQLLQLVEPFGVISNHLILNKINEAFIEMATTEDAQAAVDYYTTTPALVFGKPVRVHLSQKYKRIKKPEGKPDQKFDQKQELGRVIHLSNLPHSGYSDSAVLKLAEPYGKIKNYILMRMKSQAFIEMETREDAMAMVDHCLKKALWFQGRCVKVDLSEKYKKLVLRIPNRGIDLLKKDKSRKRSYSPDGKESPSDKKSKTDGSQKTESSTEGKEQEEKSGEDGEKDTKDDQTEQEPNMLLESEDELLVDEEEAAALLESGSSVGDETDLANLGDVASDGKKEPSDKAVKKDGSASAAAKKKLKKVDKIEELDQENEAALENGIKNEENTEPGAESSENADDPNKDTSENADGQSDENKDDYTIPDEYRIGPYQPNVPVGIDYVIPKTGFYCKLCSLFYTNEEVAKNTHCSSLPHYQKLKKFLNKLAEERRQKKET

SEQ ID NO: 8356 - protein, 509 aa, Homo Sapiens; identical to SEQ ID NO: 8355

SEQ ID NO: 8357 - protein, 559 aa, Homo Sapiens
MLGAQWRRNQPSRAAEEWSQHINGASHSRRCQLLLEIYPEWNPDNDTGHTMGDPFMLQQSTNPAPGILGPPPPSFHLGGPAVGPRGNLGAGNGNLQGPRHMQKGRVETSRVVHIMDFQRGKNLRYQLLQLVEPFGVISNHLILNKINEAFIEMATTEDAQAAVDYYTTTPALVFGKPVRVHLSQKYKRIKKPEGKPDQKFDQKQELGRVIHLSNLPHSGYSDSAVLKLAEPYGKIKNYILMRMKSQAFIEMETREDAMAMVDHCLKKALWFQGRCVKVDLSEKYKKLVLRIPNRGIDLLKKDKSRKRSYSPDGKESPSDKKSKTDGSQKTESSTEGKEQEEKSGEDGEKDTKDDQTEQEPNMLLESEDELLVDEEEAAALLESGSSVGDETDLANLGDVASDGKKEPSDKAVKKDGSASAAAKKKLKKVDKIEELDQENEAALENGIKNEENTEPGAESSENADDPNKDTSENADGQSDENKDDYTIPDEYRIGPYQPNVPVGIDYVIPKTGFYCKLCSLFYTNEEVAKNTHCSSLPHYQKLKKFLNKLAEERRQKKET

SEQ ID NO: 8358 - protein, 172 aa, Homo Sapiens
MLGAQWRRNQPSRAAEVSGPGGKHAAGQGPRVRREILGEEEWSQHINGASHSRRCQLLLEIYPEWNPDNDTGHTMGDPFMLQQSTNPAPGILGPPPPSFHLGGPAVGPRGNLGAGNGNLQGPRHMQKGRVETSRVVHIMDFQRGKNLRYQLLQLVEPFGVISNHLILNKINE

SEQ ID NO: 8359 - protein, 283 aa, Homo Sapiens
MSKSFQQSSLSRDSQGHGRDLSAAGIGLLAAATQSLSMLLESEDELLVDEEEAAALLESGSSVGDETDLANLGDVASDGKKEPSDKAVKKDGSASAAAKKKLKKRRFPGSMEGFVTLDEVGDEEDSELQKLRKSGMAFKSGDKNDDGLVEIKVDKIEELDQENEAALENGIKNEENTEPGAESSENADDPNKDTSENADGQSDENKDDYTIPDEYRIGPYQPNVPVGIDYVIPKTGFYCKLCSLFYTNEEVAKNTHCSSLPHYQKLKKFLNKLAEERRQKKET

SEQ ID NO: 8360 - protein, 47 aa, Homo Sapiens
MSKSFQQSSLSRDSQGHGRDLSAAGIGLLAAATQSLSMPASLGRMNQ

SEQ ID NO: 8361 - protein, 78 aa, Homo Sapiens
MSKSFQQSSLSRDSQGHGRDLSAAGIGLLAAATQSLSMPASLGRMNQGTARLASLMNLGMSSSLNQQGAHSALSSAST

SEQ ID NO: 8362 - protein, 78 aa, Homo Sapiens; identical to SEQ ID NO: 8361

SEQ ID NO: 8363 - protein, 87 aa, Homo Sapiens
MSKSFQQSSLSRDSQGHGRDLSAAGIGLLAAATQSLSMPASLGRMNQGTARLASLMNLGMSSSLNQQGAHSALSSASTSSHNLQSIF

SEQ ID NO: 8364 - protein, 99 aa, Homo Sapiens
MSKSFQQSSLSRDSQGHGRDLSAAGIGLLAAATQSLSMPASLGRMNQGTARLASLMNLGMSSSLNQQGAHSALSSASTSSHNLQSIFNIGSRGPLPLSS

SEQ ID NO: 8365 - protein, 100 aa, Homo Sapiens
MSKSFQQSSLSRDSQGHGRDLSAAGIGLLAAATQSLSMPASLGRMNQGTARLASLMNLGMSSSLNQQGAHSALSSASTSSHNLQSIFNIGSRGPLPLSSQ

SEQ ID NO: 8366 - protein, 107 aa, Homo Sapiens
MSKSFQQSSLSRDSQGHGRDLSAAGIGLLAAATQSLSMPASLGRMNQGTARLASLMNLGMSSSLNQQGAHSALSSASTSSHNLQSIFNIGSRGPLPLSSQHRGDADQ

SEQ ID NO: 8367 - protein, 847 aa, Homo Sapiens
MSKSFQQSSLSRDSQGHGRDLSAAGIGLLAAATQSLSMPASLGRMNQGTARLASLMNLGMSSSLNQQGAHSALSSASTSSHNLQSIFNIGSRGPLPLSSQHRGDADQASNILASFGLSARDLDELSRYPEDKITPENLPQILLQLKRRRTEEGPTLSYGRDGRSATREPPYRVPRDDWEEKRHFRRDSFDDRGPSLNPVLDYDHGSRSQESGYYDRMDYEDDRLRDGERCRDDSFFGETSHNYHKFDSEYERMGRGPGPLQERSLFEKKRGAPPSSNIEDFHGLLPKGYPHLCSICDLPVHSNKEWSQHINGASHSRRCQLLLEIYPEWNPDNDTGHTMGDPFMLQQSTNPAPGILGPPPPSFHLGGPAVGPRGNLGAGNGNLQGPRHMQKGRVETSRVVHIMDFQRGKNLRYQLLQLVEPFGVISNHLILNKINEAFIEMATTEDAQAAVDYYTTTPALVFGKPVRVHLSQKYKRIKKPEGKPDQKFDQKQELGRVIHLSNLPHSGYSDSAVLKLAEPYGKIKNYILMRMKSQAFIEMETREDAMAMVDHCLKKALWFQGRCVKVDLSEKYKKLVLRIPNRGIDLLKKDKSRKRSYSPDGKESPSDKKSKTDGSQKTESSTEGKEQEEKSGEDGEKDTKDDQTEQEPNMLLESEDELLVDEEEAAALLESGSSVGDETDLANLGDVASDGKKEPSDKAVKKDGSASAAAKKKLKKVDKIEELDQENEAALENGIKNEENTEPGAESSENADDPNKDTSENADGQSDENKDDYTIPDEYRIGPYQPNVPVGIDYVIPKTGFYCKLCSLFYTNEEVAKNTHCSSLPHYQKLKKFLNKLAEERRQKKET

SEQ ID NO: 8368 - protein, 895 aa, Homo Sapiens
MSKSFQQSSLSRDSQGHGRDLSAAGIGLLAAATQSLSMPASLGRMNQGTARLASLMNLGMSSSLNQQGAHSALSSASTSSHNLQSIFNIGSRGPLPLSSQHRGDADQASNILASFGLSARDLDELSRYPEDKITPENLPQILLQLKRRRTEEGPTLSYGRDGRSATREPPYRVPRDDWEEKRHFRRDSFDDRGPSLNPVLDYDHGSRSQESGYYDRMDYEDDRLRDGERCRDDSFFGETSHNYHKFDSEYERMGRGPGPLQERSLFEKKRGAPPSSNIEDFHGLLPKGYPHLCSICDLPVHSNKEWSQHINGASHSRRCQLLLEIYPEWNPDNDTGHTMGDPFMLQQSTNPAPGILGPPPPSFHLGGPAVGPRGNLGAGNGNLQGPRHMQKGRVETSRVVHIMDFQRGKNLRYQLLQLVEPFGVISNHLILNKINEAFIEMATTEDAQAAVDYYTTTPALVFGKPVRVHLSQKYKRIKKPEGKPDQKFDQKQELGRVIHLSNLPHSGYSDSAVLKLAEPYGKIKNYILMRMKSQAFIEMETREDAMAMVDHCLKKALWFQGRCVKVDLSEKYKKLVLRIPNRGIDLLKKDKSRKRSYSPDGKESPSDKKSKTDGSQKTESSTEGKEQEEKSGEDGEKDTKDDQTEQEPNMLLESEDELLVDEEEAAALLESGSSVGDETDLANLGDVASDGKKEPSDKAVKKDGSASAAAKKKLKKRRFPGSMEGFVTLDEVGDEEDSELQKLRKSGMAFKSGDKNDDGLVEIKVDKIEELDQENEAALENGIKNEENTEPGAESSENADDPNKDTSENADGQSDENKDDYTIPDEYRIGPYQPNVPVGIDYVIPKTGFYCKLCSLFYTNEEVAKNTHCSSLPHYQKLKKFLNKLAEERRQKKET

SEQ ID NO: 8369 - protein, 847 aa, Homo Sapiens; identical to SEQ ID NO: 8367

SEQ ID NO: 8370 - protein, 895 aa, Homo Sapiens; identical to SEQ ID NO: 8368

SEQ ID NO: 8371 - protein, 847 aa, Homo Sapiens; identical to SEQ ID NO: 8367

SEQ ID NO: 8372 - protein, 794 aa, Homo Sapiens
MSKSFQQSSLSRDSQGHGRDLSAAGIGLLAAATQSLSMPASLGRMNQGTARLASLMNLGMSSSLNQQGAHSALSSASTSSHNLQSIFNIGSRGPLPLSSQHRGDADQASNILASFGLSARDLDELSRYPEDKITPENLPQILLQLKRRRTEEGPTLSYGRDGRSATREPPYRVPRDDWEEKRHFRRDSFDDRGPSLNPVLDYDHGSRSQESGYYDRMDYEDDRLRDGERCRDDSFFGETSHNYHKFDSEYERMGRGPGPLQERSLFEKKRGAPPSSNIEDFHGLLPKGYPHLCSICDLPVHSNKEWSQHINGASHSRRCQLLLEIYPEWNPDNDTGHTMGDPFMLQQSTNPAPGILGPPPPSFHLGGPAVGPRGNLGAGNGNLQGPRHMQKGRVETSRVVHIMDFQRGKNLRYQLLQLVEPFGVISNHLILNKINEAFIEMATTEDAQAAVDYYTTTPALVFGKPVRVHLSQKYKRIKKPEGKPDQKFDQKQELGRVIHLSNLPHSGYSDSAVLKLAEPYGKIKNYILMRMKSQAFIEMETREDAMAMVDHCLKKALWFQGRCVKVDLSEKYKKLVLRIPNRGIDLLKKDKSRKRSYSPDGKESPSDKKSKTDGSQKTESSTEGKEQEEKSGEDGEKDTKDDQTEQEPNMLLESEDELLVDEEEAAALLESGSSVGDETDLANLGDVASDGKKEPSDKAVKKDGSASAAAKKKLKKVDKIEELDQENEAALENGIKNEENTEPGAESSENADDPNKDTSENADGQSDENKDDYTIPDEYRIGPYQPNVPVEISE

SEQ ID NO: 8373 - protein, 433 aa, Homo Sapiens
MSKSFQQSSLSRDSQGHGRDLSAAGIGLLAAATQSLSMPASLGRMNQGTARLASLMNLGMSSSLNQQGAHSALSSASTSSHNLQSIFNIGSRGPLPLSSQHRGDADQASNILASFGLSARDLDELSRYPEDKITPENLPQILLQLKRRRTEEGPTLSYGRDGRSATREPPYRVPRDDWEEKRHFRRDSFDDRGPSLNPVLDYDHGSRSQESGYYDRMDYEDDRLRDGERCRDDSFFGETSHNYHKFDSEYERMGRGPGPLQERSLFEKKRGAPPSSNIEDFHGLLPKGYPHLCSICDLPVHSNKEWSQHINGASHSRRCQLLLEIYPEWNPDNDTGHTMGDPFMLQQSTNPAPGILGPPPPSFHLGGPAVGPRGNLGAGNGNLQGPRHMQKGRVETSRVVHIMDFQRGKNLRYQLLQLVEPFGVISNHLILNK

SEQ ID NO: 8374 - protein, 847 aa, Homo Sapiens; identical to SEQ ID NO: 8367

SEQ ID NO: 8375 - protein, 334 aa, Homo Sapiens
  misc_feature (1)..(1): Xaa can be any naturally occurring amino acid
XERCRDDSFFGETSHNYHKFDSEYERMGRGPGPLQERSLFEKKRGAPPSSNIEDFHGLLPKGYPHLCSICDLPVHSNKEWSQHINGASHSRRCQLLLEMGDPFMLQQSTNPAPGILGPPPPSFHLGGPAVGPRGNLGAGNGNLQGPRHMQKGRVETSRVVHIMDFQRGKNLRYQLLQLVEPFGVISNHLILNKINEAFIEMATTEDAQAAVDYYTTTPALVFGKPVRVHLSQKYKRIKKPEGKPDQKFDQKQELGRVIHLSNLPHSGYSDSAVLKLAEPYGKIKNYILMRMKSQAFIEMETREDAMAMVDHCLKKALWFQGRCVKVDLSEKYKK

SEQ ID NO: 8376 - protein, 235 aa, Homo Sapiens
AIQISQQTPYWHCRLLFQLAQLHTLEKDLVSACDLLGVGAEYARVVGSEYTRALFLLSKGMLLLMERKLQEVHPLLTLCGQIVENWQGNPIQKESLRVFFLVLQVTHYLDAGQVKSVKPCLKQLQQCIQTISTLHDDEILPSNPADLFHWLPKEHMCVLVYLVTVMHSMQAGYLEKAQKYTDKALMQLEKLKSKSVLDCSPILSSFQVILLEHIIMCRLVTGHKATALQEISQVC

SEQ ID NO: 8377 - protein, 183 aa, Homo Sapiens
KIRLCVHCLQAVFPFKPPQRIEARTHLQLGSVLYHHTKNSEQARSHLEKANSVDAAKPLLRKAIQISQQTPYWHCRLLFQLAQLHTLEKDLVSACDLLGVGAEYARVVGSEYTRALFLLSKGMLLLMERKLQEVHPLLTLCGQIVENWQGNPIQKESLRVFFLVLQVTHYLDAGQVKSVKPCL

SEQ ID NO: 8378 - protein, 613 aa, Homo Sapiens
MAAQAAAAAQAAAAQAAQAEAADSWYLALLGFAEHFRTSSPPKIRLCVHCLQAVFPFKPPQRIEARTHLQLGSVLYHHTKNSEQARSHLEKAWLISQQIPQFEDVKFEAASLLSELYCQENSVDAAKPLLRKAIQISQQTPYWHCRLLFQLAQLHTLEKDLVSACDLLGVGAEYARVVGSEYTRALFLLSKGMLLLMERKLQEVHPLLTLCGQIVENWQGNPIQKESLRVFFLVLQVTHYLDAGQVKSVKPCLKQLQQCIQTISTLHDDEILPSNPADLFHWLPKEHMCVLVYLVTVMHSMQAGYLEKAQKYTDKALMQLEKLKMLDCSPILSSFQVILLEHIIMCRLVTGHKATALQEISQVCQLCQQSPRLFSNHAAQLHTLLGLYCVSVNCMDNAEAQFTTALRLTNHQELWAFIVTNLASVYIREGNRHQEVLYSLLERINPDHSFPVSSHCLRAAAFYVRGLFSFFQGRYNEAKRFLRETLKMSNAEDLNRLTACSLVLLGHIFYVLGNHRESNNMVVPAMQLASKIPDMSVQLWSSALLRDLNKACGNAMDAHEAAQMHQNFSQQLLQDHIEACSLPEHNLITWTDGPPPVQFQAQNGPNTSLASLL

SEQ ID NO: 8379 - protein, 202 aa, Homo Sapiens
AGAGGGAAAVAAGGVVTTTASGKRIRKNHACEMCGKAFRDVYHLNRHKLSHSDEKPYQCPVCQQRFKRKDRMSYHVRSHDGAVHKPYNCSHCGKSFSRPDHLNSHVRQVHSTERPFKCEKCEAAFATKDRLRAHTVRHEEKVPCHVCGKMLSSAYISDHMKVHSQGPHHVCELCNKGTCRGLPGGPGAEGGRLARRLATDTG

SEQ ID NO: 8380 - protein, 454 aa, Homo Sapiens
MDPSNWSSFIFQGHAQNPLQVGAELQSRFFASQGCAQSPFQAAPAPPPTPQAPAAEPLQVDLLPVLAAAQESAAAAAAAAAAAAAVAAAPPAPAAASTVDTAALKQPPAPPPPPPPVSAPAAEAAPPASAATIAAAAATAVVAPTSTVAVAPVASALEKKTKSKGPYICALCAKEFKNGYNLRRHEAIHTGAKAGRVPSGAMKMPTMVPLSLLSVPQLSGAGGGGGEAGAGGGAAAVAAGGVVTTTASGKRIRKNHACEMCGKAFRDVYHLNRHKLSHSDEKPYQCPVCQQRFKRKDRMSYHVRSHDGAVHKPYNCSHCGKSFSRPDHLNSHVRQVHSTERPFKCEKCEAAFATKDRLRAHTVRHEEKVPCHVCGKMLSSAYISDHMKVHSQGPHHVCELCNKGTGEVCPMAAAAAAAAAAAAAAVAAPPTAVGSLSGAEGVPVSSQPLPSQPW

SEQ ID NO: 8381 - protein, 184 aa, Homo Sapiens
MFPVFPCTLLAPPFPVLGLDSRGVGGLMNSFPPPQGHAQNPLQVGAELQSRFFASQGCAQSPFQAAPAPPPTPQAPAAEPLQVDLLPVLAAAQDGGSGSSGSSSSPSHSCGLPLGGGGGACELSATSLPTLVSSKLVAGERGEWSRVPWYKLLSPLFSHQLLFPYQPRSLQKERRKKCFLRGIR

SEQ ID NO: 8382 - protein, 186 aa, Homo Sapiens
MFPVFPCTLLAPPFPVLGLDSRGVGGLMNSFPPPQGHAQNPLQVGAELQSRFFASQGCAQSPFQAAPAPPPTPQAPAAEPLQVDLLPVLAAAQDGSGGSGSSGSSSSPSHSCGLPLGGGGGACELSATSLPTLVSSKLVAGERGEWSRVPWYKLLSPLFSHQLLFPYQPRSLQKERRKKCFLRGIR

SEQ ID NO: 8383 - protein, 493 aa, Homo Sapiens
MFPVFPCTLLAPPFPVLGLDSRGVGGLMNSFPPPQGHAQNPLQVGAELQSRFFASQGCAQSPFQAAPAPPPTPQAPAAEPLQVDLLPVLAAAQESAAAAAAAAAAAAAVAAAPPAPAAASTVDTAALKQPPAPPPPPPPVSAPAAEAAPPASAATIAAAAATAVVAPTSTVAVAPVASALEKKTKSKGPYICALCAKEFKNGYNLRRHEAIHTGAKAGRVPSGAMKMPTMVPLSLLSVPQLSGAGGGGGEAGAGGGAAAVAAGGVVTTTASGKRIRKNHACEMCGKAFRDVYHLNRHKLSHSDEKPYQCPVCQQRFKRKDRMSYHVRSHDGAVHKPYNCSHCGKSFSRPDHLNSHVRQVHSTERPFKCEKCEAAFATKDRLRAHTVRHEEKVPCHVCGKMLSSAYISDHMKVHSQGPHHVCELCNKGFTTAAYLRIHAVKDHGLQAPRADRILCKLCSVHCKTPAQLAGHMQTHLGGAAPPVPGDAPQPQPTC

SEQ ID NO: 8384 - protein, 477 aa, Homo Sapiens
MFPVFPCTLLAPPFPVLGLDSRGVGGLMNSFPPPQGHAQNPLQVGAELQSRFFASQGCAQSPFQAAPAPPPTPQAPAAEPLQVDLLPVLAAAQESAAAAAAAAAAAAAVAAAPPAPAAASTVDTAALKQPPAPPPPPPPVSAPAAEAAPPASAATIAAAAATAVVAPTSTVAVAPVASALEKKTKSKGPYICALCAKEFKNGYNLRRHEAIHTGAKAGRVPSGAMKMPTMVPLSLLSVPQLSGAGGGGGEAGAGGGAAAVAAGGVVTTTASGKRIRKNHACEMCGKAFRDVYHLNRHKLSHSDEKPYQCPVCQQRFKRKDRMSYHVRSHDGAVHKPYNCSHCGKSFSRPDHLNSHVRQVHSTERPFKCEKCEAAFATKDRLRAHTVRHEEKVPCHVCGKMLSSAYISDHMKVHSQGPHHVCELCNKGTGEVCPMAAAAAAAAAAAAAAVAAPPTAVGSLSGAEGVPVSSQPLPSQPW

SEQ ID NO: 8385 - protein, 84 aa, Homo Sapiens
MFPVFPCTLLAPPFPVLGLDSRGVGGLMNSFPPPQGHAQNPLQVGAELQSRFFASQGCAQSPFQAGSPQQSRQTSALNRTALQM

SEQ ID NO: 8386 - protein, 172 aa, Homo Sapiens
MFPVFPCTLLAPPFPVLGLDSRGVGGLMNSFPPPQGHAQNPLQVGAELQSRFFASQGCAQSPFQKCEAAFATKDRLRAHTVRHEEKVPCHVCGKMLSSAYISDHMKVHSQGPHHVCELCNKGTGEVCPMAAAAAAAAAAAAAAVAAPPTAVGSLSGAEGVPVSSQPLPSQPW

SEQ ID NO: 8387 - protein, 252 aa, Homo Sapiens [sequence omitted]

SEQ ID NO: 8388 - protein, 79 aa, Homo Sapiens
MLSSAYISDHMKVHSQGPHHVCELCNKGFTTAAYLRIHAVKDHGLQAPRADRILCKLCSVHCKTPAQLAGHMQTHLGGA

SEQ ID NO: 8389 - protein, 94 aa, Homo Sapiens
MLSSAYISDHMKVHSQGPHHVCELCNKGFTTAAYLRIHAVKDHGLQAPRADRILCKLCSVHCKTPAQLAGHMQTHLGGAAPPVPGDAPQPQPTC

SEQ ID NO: 8390 - protein, 53 aa, Homo Sapiens
MLSSAYISDHMKVHSQGPHHVCELCNKGTCRGLPGGPGAEGGRLARRLATDTG

SEQ ID NO: 8391 - protein, 78 aa, Homo Sapiens
MLSSAYISDHMKVHSQGPHHVCELCNKGTGEVCPMAAAAAAAAAAAAAAVAAPPTAVGSLSGAEGVPVSSQPLPSQPW

SEQ ID NO: 8392 - protein, 152 aa, Homo Sapiens
SFSRCARGLGRPLGRGEGGTRRRPDHLNSHVRQVHSTERPFKCEKCEAAFATKDRLRAHTVRHEEKVPCHVCGKMLSSAYISDHMKVHSQGPHHVCELCNKGTGEVCPMAAAAAAAAAAAAAAVAAPPTAVGSLSGAEGVPVSSQPLPSQPW

SEQ ID NO: 8393 - protein, 196 aa, Homo Sapiens
  misc_feature (1)..(1): Xaa can be any naturally occurring amino acid
XGAVHKPYNCSHCGKSFSRPDHLNSHVRQVHSTERPFKCEKCEAAFATKDRLRAHTVRHEEKVPCHVCGKMLSSAYISDHMKVHSQGPHHVCELCNKGTGEVCPMAAAAAAAAAAAAAAVAAPPTAVGSLSGAEGVPVSSQPLPSQPCSSPGLVFSSLFPTTEEVVALAMSSCSCVPCMYPTLHPFLLRGPHYNKF

SEQ ID NO: 8394 - protein, 177 aa, Homo Sapiens [sequence omitted]

SEQ ID NO: 8395 - protein, 504 aa, Homo Sapiens
GMGAGPACPLPPLAGGEAFPFPSPEQGLALSGAGFPGMLGALPLPLSLGQPPPSPLLNHSLFGVLTGGGGQPPPEPLLPPPGGPGPPLAPGEPEGPSLLVASLLPPPPSDLLPPPSAPPSNLLASFLPLLALGPTAGDGEGSAEGAGGPSGEPFSGLGDLSPLLFPPLSAPPTLIALNSALLAATLDPPSGTPPQPCVLSAPQPGPPTSSVTTATTDPGASSLGKAPSNSGRPPQLLSPLLGASLLGDLSSLTSSPGALPSLLQPPGPLLSGQLGLQLLPGGGAPPPLSEASSPLACLLQSLQIPPEQPEAPCLPPESPASALEPEPARPPLSALAPPHGSPDPPVPELLTGRGSGKRGRRGGGGLRGINGEARPARGRKPGSRREPGRLALKWGTRGGFNGQMERSPRRTHHWQHNGELAEGGAEPKDPPPPGPHSEDLKVPPGVVRKSRRGRRRKYNPTRNSNSSRQDITLEPSPTARAAVPLPPRARPGRPAKNKRRKLAP

SEQ ID NO: 8396 - protein, 47 aa, Homo Sapiens
MNGGNESSGADRAGGPVATSVPIGWQRCVREGAVLYIRRICNLSTVL

SEQ ID NO: 8397 - protein, 45 aa, Homo Sapiens
MNGGNESSGADRAGGPVATSVPIGWQRCVREGAVLYISPSGTELS

SEQ ID NO: 8398 - protein, 53 aa, Homo Sapiens
MNGGNESSGADRAGGPVATSVPIGWQRCVREGAVLYISPSGTELSSLEQTRSY

SEQ ID NO: 8399 - protein, 53 aa, Homo Sapiens; identical to SEQ ID NO: 8398

SEQ ID NO: 8400 - protein, 73 aa, Homo Sapiens
MNGGNESSGADRAGGPVATSVPIGWQRCVREGAVLYISPSGTELSSLEQTRSYLLSDGTCKCGLECPLNVPKV

SEQ ID NO: 8401 - protein, 148 aa, Homo Sapiens
MNGGNESSGADRAGGPVATSVPIGWQRCVREGAVLYISPSGTELSSLEQTRSYLLSDGTCKCGLECPLNVPKVFNFDPLAPVTPGGAGVGPASEEDMTKLCNHRRKAVAMATLYRSMETTCSHSSPGEGASPQMFHTVSPGPPSARPP

SEQ ID NO: 8402 - protein, 1003 aa, Homo Sapiens
MNGGNESSGADRAGGPVATSVPIGWQRCVREGAVLYISPSGTELSSLEQTRSYLLSDGTCKCGLECPLNVPKVFNFDPLAPVTPGGAGVGPASEEDMTKLCNHRRKAVAMATLYRSMETTCSHSSPGEGASPQMFHTVSPGPPSARPPCRVPPTTPLNGGPGSLPPEPPSVSQAFPTLAGPGGLFPPRLADPVPSGGSSSPRFLPRGNAPSPAPPPPPAISLNAPSYNWGAALRSSLVPSDLGSPPAPHASSSPPSDPPLFHCSDALTPPPLPPSNNLPAHPGPASQPPVSSATMHLPLVLGPLGGAPTVEGPGAPPFLASSLLSAAAKAQHPPLPPPSTLQGRRPRAQAPSASHSSSLRPSQRRPRRPPTVFRLLEGRGPQTPRRSRPRAPAPVPQPFSLPEPSQPILPSVLSLLGLPTPGPSHSDGSFNLLGSDAHLPPPPTLSSGSPPQPRHPIQPSLPGTTSGSLSSVPGAPAPPAASKAPVVPSPVLQSPSEGLGMGAGPACPLPPLAGGEAFPFPSPEQGLALSGAGFPGMLGALPLPLSLGQPPPSPLLNHSLFGVLTGGGGQPPPEPLLPPPGGPGPPLAPGEPEGPSLLVASLLPPPPSDLLPPPSAPPSNLLASFLPLLALGPTAGDGEGSAEGAGGPSGEPFSGLGDLSPLLFPPLSAPPTLIALNSALLAATLDPPSGTPPQPCVLSAPQPGPPTSSVTTATTDPGASSLGKAPSNSGRPPQLLSPLLGASLLGDLSSLTSSPGALPSLLQPPGPLLSGQLGLQLLPGGGAPPPLSEASSPLACLLQSLQIPPEQPEAPCLPPESPASALEPEPARPPLSALAPPHGSPDPPVPELLTGRGSGKRGRRGGGGLRGINGEARPARGRKPGSRREPGRLALKWGTRGGFNGQMERSPRRTHHWQHNGELAEGGAEPKDPPPPGPHSEDLKVPPGVVRKSRRGRRRKYNPTRNSNSSRQDITLEPSPTARAAVPLPPRARPGRPAKNKRRKLAP

SEQ ID NO: 8403 - protein, 66 aa, Homo Sapiens
MTKLCNHRRKAVAMATLYRSMETTCSHSSPGEGASPQMFHTVSPGPPSARPPCRVPPTTPLNGGPG

SEQ ID NO: 8404 - protein, 27 aa, Homo Sapiens
  misc_feature (1)..(1): Xaa can be any naturally occurring amino acid
XARAAVPLPPRARPGRPAKNKRRKLAP

SEQ ID NO: 8405 - protein, 190 aa, Homo Sapiens
  misc_feature (1)..(1): Xaa can be any naturally occurring amino acid
XLLSGQLGLQLLPGGGAPPPLSEASSPLACLLQSLQQIPPEQPEAPCLPPESPASALEPEPARPPLSALAPPHGSPDPPVPELLTGRGSGKRGRRGGGGLRGINGEARPARGRKPGSRREPGRLALKWGTRGGFNGQMERSPRRTHHWQHNGELAEGGAEPKDPPPPGPHSEDLKVPPGVVRKSRRGRRR

SEQ ID NO: 8406 - protein, 248 aa, Homo Sapiens
MSLFPSLPLLLLSMVAASYSETVTCEDAQKTCPAVIACSSPGINGFPGKDGRDGTKGEKGEPGQGLRGLQGPPGKLGPPGNPGPSGSPGPKGQKGDPGKSPDGDSSLAASERKALQTEMARIKKWLTFSLGKQVGNKFFLTNGEIMTFEKVKALCVKFQASVATPRNAAENGAIQNLIKEEAFLGITDEKTEGQFVDLTGNRLTYTNWNEGEPNNAGSDEDCVLLLKNGQWNDVPCSTSHLAVCEFPI

SEQ ID NO: 8407 - protein, 90 aa, Homo Sapiens
MAMLAQQMQLANAMMPGAPLQPVPMFSVAPSLATNASAAAFNPYLGPVSPSLVPAEILPTAPMLVTGNPGVPVPAAAAAAAQKLMRTDRL

SEQ ID NO: 8408 - protein, 155 aa, Homo Sapiens
MAMLAQQMQLANAMMPGAPLQPVPMFSVAPSLATNASAAAFNPYLGPVSPSLVPAEILPTAPMLVTGNPGVPVPAAAAAAAQKLMRTDRLEVCREYQRGNCNRGENDCRFAHPADSTMIDTNDNTVTVCMDYIKGRCSREKCKYFHPPAHLQAKI

SEQ ID NO: 8409 - protein, 388 aa, Homo Sapiens
MAVSVTPIRDTKWLTLEVCREFQRGTCSRPDTECKFAHPSKSCQVENGRVIACFDSLKGRCSRENCKYLHPPPHLKTQLEINGRNNLIQQKNMAMLAQQMQLANAMMPGAPLQPVPMFSVAPSLATNASAAAFNPYLGPVSPSLVPAEILPTAPMLVTGNPGVPVPAAAAAAAQKLMRTDRLEVCREYQRGNCNRGENDCRFAHPADSTMIDTNDNTVTVCMDYIKGRCSREKCKYFHPPAHLQAKIKAAQYQVNQAAAAQAAATAAAMTQSAVKSLKRPLEATFDLGIPQAVLPPLPKRPALEKTNGATAVFNTGIFQYQQALANMQLQQHTAFLPPVPMVHGATPATVSAATTSATSVPFAATATANQIPIISAEHLTSHKYVTQM

SEQ ID NO: 8410 - protein, 400 aa, Homo Sapiens
MAVSVTPIRDTKWLTLEVCREFQRGTCSRPDTECKFAHPSKSCQVENGRVIACFDSLKGRCSRENCKYLHPPPHLKTQLEINGRNNLIQQKNMAMLAQQMQLANAMMPGAPLQPVPMFSVAPSLATNASAAAFNPYLGPVSPSLVPAEILPTAPMLVTGNPGVPVPAAAAAAAQKLMRTDRLEVCREYQRGNCNRGENDCRFAHPADSTMIDTNDNTVTVCMDYIKGRCSREKCKYFHPPAHLQAKIKAAQYQVNQAAAAQAAATAAAMTQSAVKSLKRPLEATFDLGIPQAVLPPLPKRPALEKTNGATAVFNTGIFQYQQALANMQLQQHTAFLPPGSILCMTPATSVVPMVHGATPATVSAATTSATSVPFAATATANQIPIISAEHLTSHKYVTQM

SEQ ID NO: 8411 - protein, 370 aa, Homo Sapiens
MAVSVTPIRDTKWLTLEVCREFQRGTCSRPDTECKFAHPSKSCQVENGRVIACFDSLKGRCSRENCKYLHPPPHLKTQLEINGRNNLIQQKNMAMLAQQMQLANAMMPGAPLQPVPMFSVAPSLATNASAAAFNPYLGPVSPSLVPAEILPTAPMLVTGNPGVPVPAAAAAAAQKLMRTDRLEVCREYQRGNCNRGENDCRFAHPADSTMIDTNDNTVTVCMDYIKGRCSREKCKYFHPPAHLQAKIKAAQYQVNQAAAAQAAATAAAMGIPQAVLPPLPKRPALEKTNGATAVFNTGIFQYQQALANMQLQQHTAFLPPVPMVHGATPATVSAATTSATSVPFAATATANQIPIISAEHLTSHKYVTQM

SEQ ID NO: 8412 - protein, 382 aa, Homo Sapiens
MAVSVTPIRDTKWLTLEVCREFQRGTCSRPDTECKFAHPSKSCQVENGRVIACFDSLKGRCSRENCKYLHPPPHLKTQLEINGRNNLIQQKNMAMLAQQMQLANAMMPGAPLQPVPMFSVAPSLATNASAAAFNPYLGPVSPSLVPAEILPTAPMLVTGNPGVPVPAAAAAAAQKLMRTDRLEVCREYQRGNCNRGENDCRFAHPADSTMIDTNDNTVTVCMDYIKGRCSREKCKYFHPPAHLQAKIKAAQYQVNQAAAAQAAATAAAMGIPQAVLPPLPKRPALEKTNGATAVFNTGIFQYQQALANMQLQQHTAFLPPGSILCMTPATSVVPMVHGATPATVSAATTSATSVPFAATATANQIPIISAEHLTSHKYVTQM

SEQ ID NO: 8413 - protein, 340 aa, Homo Sapiens
MAVSVTPIRDTKWLTLEVCREFQRGTCSRPDTECKFAHPSKSCQVENGRVIACFDSLKGRCSRENCKYLHPPPHLKTQLEINGRNNLIQQKNMAMLAQQMQLANAMMPGAPLQPVPMFSVAPSLATNASAAAFNPYLGPVSPSLVPAEILPTAPMLVTGNPGVPVPAAAAAAAQKLMRTDRLEVCREYQRGNCNRGENDCRFAHPADSTMIDTNDNTVTVCMDYIKGRCSREKCKYFHPPAHLQAKIKAAQYQVNQAAAAQAAATAAAMFPWCTVLRQPLCPQQQHLPQVFPSLQQPQPTSPILDASTLLGATSCPAAAGKMIPIISAEHLTSHKYVTQM

SEQ ID NO: 8414 - protein, 342 aa, Homo Sapiens
MAVSVTPIRDTKWLTLEVCREFQRGTCSRPDTECKFAHPSKSCQVENGRVIACFDSLKGRCSRENCKYLHPPPHLKTQLEINGRNNLIQQKNMAMLAQQMQLANAMMPGAPLQPVPMFSVAPSLATNASAAAFNPYLGPVSPSLVPAEILPTAPMLVTGNPGVPVPAAAAAAAQKLMRTDRLEVCREYQRGNCNRGENDCRFAHPADSTMIDTNDNTVTVCMDYIKGRCSREKCKYFHPPAHLQAKIKAAQYQVNQAAAAQAAATAAAMGIPQAVLPPLPKRPALEKTNGATAVFNTGIFQYQQALANMQLQQHTAFLPPGSILCMTPATSVDTHNICRTSD

SEQ ID NO: 8415 - protein, 340 aa, Homo Sapiens; identical to SEQ ID NO: 8413

SEQ ID NO: 8416 - protein, 342 aa, Homo Sapiens; identical to SEQ ID NO: 8414

SEQ ID NO: 8417 - protein, 388 aa, Homo Sapiens; identical to SEQ ID NO: 8409

SEQ ID NO: 8418 - protein, 348 aa, Homo Sapiens
MAVSVTPIRDTKWLTLEVCREFQRGTCSRPDTECKFAHPSKSCQVENGRVIACFDSLKGRCSRENCKYLHPPPHLKTQLEINGRNNLIQQKNMAMLAQQMQLANAMMPGAPLQPVPMFSVAPSLATNASAAAFNPYLGPVSPSLVPAEILPTAPMLVTGNPGVPVPAAAAAAAQKLMRTDRLEVCREYQRGNCNRGENDCRFAHPADSTMIDTNDNTVTVCMDYIKGRCSREKCKYFHPPAHLQAKIKAAQYQVNQAAAAQAAATAAAMTQSAVKSLKRPLEATFDLGIPQAVLPPLPKRPALEKTNGATAVFNTGIFQYQQALANMQLQQHTAFLPPDTHNICRTSD

SEQ ID NO: 8419 - protein, 314 aa, Homo Sapiens
MAVSVTPIRDTKWLTLEVCREFQRGTCSRPDTECKFAHPSKSCQVENGRVIACFDSLKGRCSRENCKYLHPPPHLKTQLEINGRNNLIQQKNMAMLAQQMQLANAMMPGAPLQPVVCREYQRGNCNRGENDCRFAHPADSTMIDTNDNTVTVCMDYIKGRCSREKCKYFHPPAHLQAKIKAAQYQVNQAAAAQAAATAAAMGIPQAVLPPLPKRPALEKTNGATAVFNTGIFQYQQALANMQLQQHTAFLPPGSILCMTPATSVVPMVHGATPATVSAATTSATSVPFAATATANQIPIISAEHLTSHKYVTQM

SEQ ID NO: 8420 - protein, 314 aa, Homo Sapiens; identical to SEQ ID NO: 8419

SEQ ID NO: 8421 - protein, 302 aa, Homo Sapiens
MAVSVTPIRDTKWLTLEVCREFQRGTCSRPDTECKFAHPSKSCQVENGRVIACFDSLKGRCSRENCKYLHPPPHLKTQLEINGRNNLIQQKNMAMLAQQMQLANAMMPGAPLQPVVCREYQRGNCNRGENDCRFAHPADSTMIDTNDNTVTVCMDYIKGRCSREKCKYFHPPAHLQAKIKAAQYQVNQAAAAQAAATAAAMGIPQAVLPPLPKRPALEKTNGATAVFNTGIFQYQQALANMQLQQHTAFLPPVPMVHGATPATVSAATTSATSVPFAATATANQIPIISAEHLTSHKYVTQM

SEQ ID NO: 8422 - protein, 343 aa, Homo Sapiens
MGRCSRENCKYLHPPPHLKTQLEINGRNNLIQQKNMAMLAQQMQLANAMMPGAPLQPVPMFSVAPSLATNASAAAFNPYLGPVSPSLVPAEILPTAPMLVTGNPGVPVPAAAAAAAQKLMRTDRLEVCREYQRGNCNRGENDCRFAHPADSTMIDTNDNTVTVCMDYIKGRCSREKCKYFHPPAHLQAKIKAAQYQVNQAAAAQAAATAAAMTQSAVKSLKRPLEATFDLGIPQAVLPPLPKRPALEKTNGATAVFNTGIFQYQQALANMQLQQHTAFLPPGSILCMTPATSVVPMVHGATPATVSAATTSATSVPFAATATANQIPIISAEHLTSHKYVTQM

SEQ ID NO: 8423 - protein, 58 aa, Homo Sapiens
MLGRCSRENCKYLHPPPHLKTQLEINGRNNLIQQKNMAMLAQQMQLANAMMPGAPLQP

SEQ ID NO: 8424 - protein, 210 aa, Homo Sapiens
QQMQLANAMMPGAPLQPVPMFSVAPSLATNASAAAFNPYLGPVSPSLVPAEILPTAPMLVTGNPGVPVPAAAAAAAQKLMRTDRLEVCREYQRGNCNRGENDCRFAHPADSTMIDTNDNTVTVCMDYIKGRCSREKCKYFHPPAHLQAKIKAAQYQVNQAAAAQAAATAAAMALANMQLQQHTAFLPPGSILCMTPATSVDTHNICRTSD

SEQ ID NO: 8425 - protein, 329 aa, Homo Sapiens
  misc_feature (1)..(1): Xaa can be any naturally occurring amino acid
XVSVTPIRDTKWLTLEVCREFQRGTCSRPDTECKFAHPSKSCQVENGRVIACFDSLKGRCSRENCKYLHPPPHLKTQLEINGRNNLIQQKNMAMLAQQMQLANAMMPGAPLQPVPMFSVAPSLATNASAAAFNPYLGPVSPSLVPAEILPTAPMLVTGNPGVPVPAAAAAAAQKLMRTDRLEVCREYQRGNCNRGENDCRFAHPADSTMIDTNDNTVTVCMDYIKGRCSREKCKYFHPPAHLQAKIKAAQYQVNQAAAAQAAATAAAMGIPQAVLPPLPKRPALEKTNGATAVFNTGIFQYQQALANMQLQQHTAFLPPDTHNICRTSD

SEQ ID NO: 8426 - protein, 56 aa, Homo Sapiens
MAAASAVSVLLVAAERNRWHRLPSLLLPPRLSIQDAVFSQKTWNLLNFVSKKELFL

SEQ ID NO: 8427 - protein, 598 aa, Homo Sapiens
MAAASAVSVLLVAAERNRWHRLPSLLLPPRTWVWRQRTMKYTTATDEAYSIGPAPSQQSYLSMEKIIQVAKTSAAQAIHPGCGFLSENMEFAELCKQEGIIFIGPPPSAIRDMGIKSTSKSIMAAAGVPVVEGYHGEDQSDQCLKEHARRIGYPVMIKAVRGGGGKGMRIVRSEQEFQEQLESARREAKKSFNDDAMLIEKFVDTPRHVEVQVFGDHHGNAVYLFERDCSVQRRHQKIIEEAPAPGIKSEVRKKLGEAAVRAAKAVNYVGAGTVEFIMDSKHNFCFMEMNTRLQVEHPVTEMITGTDLVEWQLRIAAGEKIPLSQEEITLQGHAFEARIYAEDPSNNFMPVAGPLVHLSTPRADPSTRIETGVRQGDEVSVHYDPMIAKLVVWAADRQAALTKLRYSLRQYNIVGLHTNIDFLLNLSGHPEFEAGNVHTDFIPQHHKQLLLSRKAAAKESLCQAALGLILKEKAMTDTFTLQAHDQFSPFSSSSGRRLNISYTRNMTLKDGKNNVAIAVTYNHDGSYSMQIEDKTFQVLGNLYSEGDCTYLKCSVNGVASKAKLIILENTIYLFSKEGSIEIDIPVPKYLSSVSSQET

SEQ ID NO: 8428 - protein, 47 aa, Homo Sapiens
MAAASAVSVLLVAAERNRWHRLPSLLLPPRTWVWRQRTMKYTTATGR

SEQ ID NO: 8429 - protein, 47 aa, Homo Sapiens; identical to SEQ ID NO: 8428

SEQ ID NO: 8430 - protein, 725 aa, Homo Sapiens
MAAASAVSVLLVAAERNRWHRLPSLLLPPRTWVWRQRTMKYTTATGRNITKVLIANRGEIACRVMRTAKKLGVQTVAVYSEADRNSMHVDMADEAYSIGPAPSQQSYLSMEKIIQVAKTSAAQAIHPGCGFLSENMEFAELCKQEGIIFIGPPPSAIRDMGIKSTSKSIMAAAGVPVVEGYHGEDQSDQCLKEHARRIGYPVMIKAVRGGGGKGMRIVRSEQEFQEQLESARREAKKSFNDDAMLIEKFVDTPRHVEVQVFGDHHGNAVYLFERDCSVQRRHQKIIEEAPAPGIKSEVRKKLGEAAVRAAKAVNYVGAGTVEFIMDSKHNFCFMEMNTRLQVEHPVTEMITGTDLVEWQLRIAAGEKIPLSQEEITLQGHAFEARIYAEDPSNNFMPVAGPLVHLSTPRADPSTRIETGVRQGDEVSVHYDPMIAKLVVWAADRQAALTKLRYSLRQYNIVGLHTNIDFLLNLSGHPEFEAGNVHTDFIPQHHKQLLLSRKAAAKESLCQAALGLILKEKAMTDTFTLQAHDQFSPFSSSSGRRLNISYTRNMTLKDGKNNVAIAVTYNHDGSYSMQIEDKTFQVLGNLYSEGDCTYLKCSVNGVASKAKLIILENTIYLFSKEGSIEIDIPVPKYLSSVSSQETQGGPLAPMTGTIEKVFVKAGDKVKAGDSLMVMIAMKMEHTIKSPKDGTVKKVFYREGAQANRHTPLVEFEEEESDKRESE

SEQ ID NO: 8431 - protein, 112 aa, Homo Sapiens
MAAASAVSVLLVAAERNRWHRLPSLLLPPRTWVWRQRTMKYTTATGRNITKVLIANRGEIACRVMRTAKKLGVQTVAVYSEADRNSMHVDMQDDLDFTEKIKLRFLPQNLLT

SEQ ID NO: 8432 - protein, 61 aa, Homo Sapiens
MAAASAVSVLLVAAERNRWHRLPSLLLPPRTWVWRQRTMKYTTATGYPSRMRFSLRKHGIC

SEQ ID NO: 8433 - protein, 61 aa, Homo Sapiens; identical to SEQ ID NO: 8432

SEQ ID NO: 8434 - protein, 616 aa, Homo Sapiens
MEKIIQVAKTSAAQAIHPGCGFLSENMEFAELCKQEGIIFIGPPPSAIRDMGIKSTSKSIMAAAGVPVVEGYHGEDQSDQCLKEHARRIGYPVMIKAVRGGGGKGMRIVRSEQEFQEQLESARREAKKSFNDDAMLIEKFVDTPRHVEVQVFGDHHGNAVYLFERDCSVQRRHQKIIEEAPAPGIKSEVRKKLGEAAVRAAKAVNYVGAGTVEFIMDSKHNFCFMEMNTRLQVEHPVTEMITGTDLVEWQLRIAAGEKIPLSQEEITLQGHAFEARIYAEDPSNNFMPVAGPLVHLSTPRADPSTRIETGVRQGDEVSVHYDPMIAKLVVWAADRQAALTKLRYSLRQYNIVGLHTNIDFLLNLSGHPEFEAGNVHTDFIPQHHKQLLLSRKAAAKESLCQAALGLILKEKAMTDTFTLQAHDQFSPFSSSSGRRLNISYTRNMTLKDGKNNVAIAVTYNHDGSYSMQIEDKTFQVLGNLYSEGDCTYLKCSVNGVASKAKLIILENTIYLFSKEGSIEIDIPVPKYLSSVSSQETQGGPLAPMTGTIEKVFVKAGDKVKAGDSLMVMIAMKMEHTIKSPKDGTVKKVFYREGAQANRHTPLVEFEEEESDKRESE

SEQ ID NO: 8435 - protein, 575 aa, Homo Sapiens
MEKIIQVAKTSAAQHIQSIMAAAGVPVVEGYHGEDQSDQCLKEHARRIGYPVMIKAVRGGGGKGMRIVRSEQEFQEQLESARREAKKSFNDDAMLIEKFVDTPRHVEVQVFGDHHGNAVYLFERDCSVQRRHQKIIEEAPAPGIKSEVRKKLGEAAVRAAKAVNYVGAGTVEFIMDSKHNFCFMEMNTRLQVEHPVTEMITGTDLVEWQLRIAAGEKIPLSQEEITLQGHAFEARIYAEDPSNNFMPVAGPLVHLSTPRADPSTRIETGVRQGDEVSVHYDPMIAKLVVWAADRQAALTKLRYSLRQYNIVGLHTNIDFLLNLSGHPEFEAGNVHTDFIPQHHKQLLLSRKAAAKESLCQAALGLILKEKAMTDTFTLQAHDQFSPFSSSSGRRLNISYTRNMTLKDGKNNVAIAVTYNHDGSYSMQIEDKTFQVLGNLYSEGDCTYLKCSVNGVASKAKLIILENTIYLFSKEGSIEIDIPVPKYLSSVSSQETQGGPLAPMTGTIEKVFVKAGDKVKAGDSLMVMIAMKMEHTIKSPKDGTVKKVFYREGAQANRHTPLVEFEEEESDKRESE

SEQ ID NO: 8436 - protein, 434 aa, Homo Sapiens
MKYTTATGRNITKVLIANRGEIACRVMRTAKKLGVQTVAVYSEADRNSMHVDMADEAYSIGPAPSQQSYLSMEKIIQVAKTSAAQAIHPGCGFLSENMEFAELCKQEGIIFIGPPPSAIRDMGIKSTSKSIMAAAGVPVVEGYHGEDQSDQCLKEHARRIGYPVMIKAVRGGGGKGMRIVRSEQEFQEQLESARREAKKSFNDDAMLIEKFVDTPRHVEVQVFGDHHGNAVYLFERDCSVQRRHQKIIEEAPAPGIKSEVRKKLGEAAVRAAKAVNYVGAGTVEFIMDSKHNFCFMEMNTRLQVEHPVTEMITGTDLVEWQLRIAAGEKIPLSQEEITLQGHAFEARIYAEDPSNNFMPVAGPLVHLSTPRADPSTRIETGVRQGDEVSVHYDPMIAKLVVWAADRQAALTKLRYSLRQYNINSLHFRLAVEED

SEQ ID NO: 8437 - protein, 434 aa, Homo Sapiens; identical to SEQ ID NO: 8436

SEQ ID NO: 8438 - protein, 119 aa, Homo Sapiens
MVLPLPWLSRYHFLRLLLPSWSLAPQGSHGCCSQNPKASMEEQTSSRGNGKMTSPPRGPGTHRTAELARAEELLEQQLELYQALLEGQEGAWEAQALVLKIQKLKEQMRRHQESLGGGA

SEQ ID NO: 8439 - protein, 78 aa, Homo Sapiens
LGRLNHVAIAVPDLEKAAAFYKNILGAQVDNINAAVMDLKKKKIRSLSEEVKIGAHGKPVIFLHPKDCGGVLVELEQA

SEQ ID NO: 8440 - protein, 176 aa, Homo Sapiens
MARVLKAAAANAVGLFSRLQAPIPTVRASSTSQPLDQVTGSVWNLGRLNHVAIAVPDLEKAAAFYKNILGAQVSEAVPLPEHGVSVVFVNLGNTKMELLHPLGRDSPIAGFLQKNKAGGMHHICIEVDNINAAVMDLKKKKIRSLSEEVKIGAHGKPVIFLHPKDCGGVLVELEQA

SEQ ID NO: 8441 - protein, 31 aa, Homo Sapiens
MELLHPLGRDSPIAGFLQKNKAGGMHHICIE

SEQ ID NO: 8442 - protein, 31 aa, Homo Sapiens; identical to SEQ ID NO: 8441

SEQ ID NO: 8443 - protein, 1067 aa, Homo Sapiens
MAEKGASRGTLRRLWSLPRRRRGTAGRSRPDEIMHQDIVPLCAADIQDQLKKRFAYLSGGRGQDGSPVITFPDYPAFSEIPDKEFQNVMTYLTSIPSLQDAGIGFILVIDRRRDKWTSVKASVLRIAASFPANLQLVLVLRPTGFFQRTLSDIAFKFNRDDFKMKVPVIMLSSVPDLHGYIDKSQLTEDLGGTLDYCHSRWLCQRTAIESFALMVKQTAQMLQSFGTELAETELPNDVQSTSSVLCAHTEKKDKAKEDLRLALKEGHSVLESLRELQAEGSEPSVNQDQLDNQATVQRLLAQLNETEAAFDEFWAKHQQKLEQCLQLRHFEQGFREVKAILDAASQKIATFTDIGNSLAHVEHLLRDLASFEEKSGVAVERARALSLDGEQLIGNKHYAVDSIRPKCQELRHLCDQFSAEIARRRGLLSKSLELHRRLETSMKWCDEGIYLLASQPVDKCQSQDGAEAALQEIEKFLETGAENKIQELNAIYKEYESILNQDLMEHVRKVFQKQASMEEVFHRRQASLKKLAARQTRPVQPVAPRPEALAKSPCPSPGIRRGSENSSSEGGALRRGPYRRAKSEMSESRQGRGSAGEEEESLAILRRHVMSELLDTERAYVEELLCVLEGYAAEMDNPLMAHLLSTGLHNKKDVLFGNMEEIYHFHNRIFLRELENYTDCPELVGRCFLERMEDFQIYEKYCQNKPRSESLWRQCSDCPFFQECQRKLDHKLSLDSYLLKPVQRITKYQLLLKEMLKYSRNCEGAEDLQEALSSILGILKAVNDSMHLIAITGYDGNLGDLGKLLMQGSFSVWTDHKRGHTKVKELARFKPMQRHLFLHEKAVLFCKKREENGEGYEKAPSYSYKQSLNMAAVGITENVKGDAKKFEIWYNAREEVYIVQAPTPEIKAAWVNEIRKVLTSQLQACREASQHRALEQSQSLPLPAPTSTSPSRGNSRNIKKLEERKTDPLSLEGYVSSAPLTKPPEKGKGWSKTSHSLEAPEDDGGWSSAEEQINSSDAEEDGGLGPKKLVPGKYTVVADHEKGGPDALRVRSGDVVELVQEGDEGLW

SEQ ID NO: 8444 - protein, 66 aa, Homo Sapiens
MFDCWRFILCKRPGSNSYSSPQRPNEAKKEETDHQIDVSDVIRLVQDTPEATAMATAPRRSQSPGL

SEQ ID NO: 8445 - protein, 1137 aa, Homo Sapiens
MFDCWRFILCKRPGSNSYSSPQRPNEAKKEETDHQIDVSDVIRLVQDTPEATAMATDEIMHQDIVPLCAADIQDQLKKRFAYLSGGRGQDGSPVITFPDYPAFSEIPDKEFQNVMTYLTSIPSLQDAGIGFILVIDRRRDKWTSVKASVLRIAASFPANLQLVLVLRPTGFFQRTLSDIAFKFNRDDFKMKVPVIMLSSVPDLHGYIDKSQLTEDLGGTLDYCHSRWLCQRTAIESFALMVKQTAQMLQSFGTELAETELPNDVQSTSSVLCAHTEKKDKAKEDLRLALKEGHSVLESLRELQAEGSEPSVNQDQLDNQATVQRLLAQLNETEAAFDEFWAKHQQKLEQCLQLRHFEQGFREVKAILDAASQKIATFTDIGNSLAHVEHLLRDLASFEEKSGVAVERARALSLDGEQLIGNKHYAVDSIRPKCQELRHLCDQFSAEIARRRGLLSKSLELHRRLETSMKWCDEGIYLLASQPVDKCQSQDGAEAALQEIEKFLETGAENKIQELNAIYKEYESILNQDLMEHVRKVFQKQASMEEVFHRRQASLKKLAARQTRPVQPVAPRPEALAKSPCPSPGIRRGSENSSSEGGALRRGPYRRAKSEMSESRQGRGSAGEEEESLAILRRHVMSELLDTERAYVEELLCVLEGYAAEMDNPLMAHLLSTGLHNKKDVLFGNMEEIYHFHNRIFLRELENYTDCPELVGRCFLERMEDFQIYEKYCQNKPRSESLWRQCSDCPFFQECQRKLDHKLSLDSYLLKPVQRITKYQLLLKEMLKYSRNCEGAEDLQEALSSILGILKAVNDSMHLIAITGYDGNLGDLGKLLMQGSFSVWTDHKRGHTKVKELARFKPMQRHLFLHEKAVLFCKKREENGEGYEKAPSYSYKQSLNMAAVGITENVKGDAKKFEIWYNAREEVYIVQAPTPEIKAAWVNEIRKVLTSQLQACREASQHRALEQSQSLPLPAPTSTSPSRGNSRNIKKLEERKTDPLSLEGYVSSAPLTKPPEKGKGWSKTSHSLEAPEDDGGWSSAEEQINSSDAEEDGGLGPKKLVPGKYTVVADHEKGGPDALRVRSGDVVELVQEGDEGLWYVRDPTTGKEGWVPASSLSVRLGPSGSAQCLSSSGKAHVPRAHP

SEQ ID NO: 8446 - protein, 64 aa, Homo Sapiens
MFDCWRFILCKRPGSNSYSSPQRPNEAKKEETDHQIDVSDVIRLVQDTPEATAMATEVSASRPQ

SEQ ID NO: 8447 - protein, 97 aa, Homo Sapiens
MGDGKAVRISVAEMKSYYLYSEWCSWLLSVAEDEIMHQDIVPLCAADIQDQLKKRFAYLSGGRGQDGSPVITFPDYPAFSEIPDKEFQNVMTYLTSI

SEQ ID NO: 8448 - protein, 136 aa, Homo Sapiens
MHQDIVPLCAADIQDQLKKRFAYLSGGRGQDGSPVITFPDYPAFSEIPDKEFQNVMTYLTSIPSLQDAGIGFILVIDRRRDKWTSVKASVLRIAASFPANLQLVLVLRPTGFFQRTLSDIAFKFNRDDFKMKVPVI

SEQ ID NO: 8449 - protein, 1096 aa, Homo Sapiens
MPLRGGAGPSPASHGPTHGPSDPRTCLPGRGAGGMRPHGRGALGCCGLCSFYTCHGAAGDEIMHQDIVPLCAADIQDQLKKRFAYLSGGRGQDGSPVITFPDYPAFSEIPDKEFQNVMTYLTSIPSLQDAGIGFILVIDRRRDKWTSVKASVLRIAASFPANLQLVLVLRPTGFFQRTLSDIAFKFNRDDFKMKVPVIMLSSVPDLHGYIDKSQLTEDLGGTLDYCHSRWLCQRTAIESFALMVKQTAQMLQSFGTELAETELPNDVQSTSSVLCAHTEKKDKAKEDLRLALKEGHSVLESLRELQAEGSEPSVNQDQLDNQATVQRLLAQLNETEAAFDEFWAKHQQKLEQCLQLRHFEQGFREVKAILDAASQKIATFTDIGNSLAHVEHLLRDLASFEEKSGVAVERARALSLDGEQLIGNKHYAVDSIRPKCQELRHLCDQFSAEIARRRGLLSKSLELHRRLETSMKWCDEGIYLLASQPVDKCQSQDGAEAALQEIEKFLETGAENKIQELNAIYKEYESILNQDLMEHVRKVFQKQASMEEVFHRRQASLKKLAARQTRPVQPVAPRPEALAKSPCPSPGIRRGSENSSSEGGALRRGPYRRAKSEMSESRQGRGSAGEEEESLAILRRHVMSELLDTERAYVEELLCVLEGYAAEMDNPLMAHLLSTGLHNKKDVLFGNMEEIYHFHNRIFLRELENYTDCPELVGRCFLERMEDFQIYEKYCQNKPRSESLWRQCSDCPFFQECQRKLDHKLSLDSYLLKPVQRITKYQLLLKEMLKYSRNCEGAEDLQEALSSILGILKAVNDSMHLIAITGYDGNLGDLGKLLMQGSFSVWTDHKRGHTKVKELARFKPMQRHLFLHEKAVLFCKKREENGEGYEKAPSYSYKQSLNMAAVGITENVKGDAKKFEIWYNAREEVYIVQAPTPEIKAAWVNEIRKVLTSQLQACREASQHRALEQSQSLPLPAPTSTSPSRGNSRNIKKLEERKTDPLSLEGYVSSAPLTKPPEKGKGWSKTSHSLEAPEDDGGWSSAEEQINSSDAEEDGGLGPKKLVPGKYTVVADHEKGGPDALRVRSGDVVELVQEGDEGLW

SEQ ID NO: 8450 - protein, 1125 aa, Homo Sapiens
MRFWLRTEEMALEEMVQRLNAVSKHTDEIMHQDIVPLCAADIQDQLKKRFAYLSGGRGQDGSPVITFPDYPAFSEIPDKEFQNVMTYLTSIPSLQDAGIGFILVIDRRRDKWTSVKASVLRIAASFPANLQLVLVLRPTGFFQRTLSDIAFKFNRDDFKMKVPVIMLSSVPDLHGYIDKSQLTEDLGGTLDYCHSRWLCQRTAIESFALMVKQTAQMLQSFGTELAETELPNDVQSTSSVLCAHTEKKDKAKEDLRLALKEGHSVLESLRELQAEGSEPSVNQDQLDNQATVQRLLAQLNETEAAFDEFWAKHQQKLEQCLQLRHFEQGFREVKAILDAASQKIATFTDIGNSLAHVEHLLRDLASFEEKSGVAVERARALSLDGEQLIGNKHYAVDSIRPKCQELRHLCDQFSAEIARRRGLLSKSLELHRRLETSMKWCDEGIYLLASQPVDKCQSQDGAEAALQEIEKFLETGAENKIQELNAIYKEYESILNQDLMEHVRKVFQKQASMEEVFHRRQASLKKLAARQTRPVQPVAPRPEALAKSPCPSPGIRRGSENSSSEGGALRRGPYRRAKSEMSESRQGRGSAGEEEESLAILRRHVMSELLDTERAYVEELLCVLEGYAAEMDNPLMAHLLSTGLHNKKDVLFGNMEEIYHFHNRIFLRELENYTDCPELVGRCFLERMEDFQIYEKYCQNKPRSESLWRQCSDCPFFQECQRKLDHKLSLDSYLLKPVQRITKYQLLLKEMLKYSRNCEGAEDLQEALSSILGILKAVNDSMHLIAITGYDGNLGDLGKLLMQGSFSVWTDHKRGHTKVKELARFKPMQRHLFLHEKAVLFCKKREENGEGYEKAPSYSYKQSLNMAAVGITENVKGDAKKFEIWYNAREEVYIVQAPTPEIKAAWVNEIRKVLTSQLQACREASQHRALEQSQSLPLPAPTSTSPSRGNSRNIKKLEERKTDPLSLEGYVSSAPLTKPPEKGKGWSKTSHSLEAPEDDGGWSSAEEQINSSDAEEDGGLGPKKLVPGKYTVVADHEKGGPDALRVRSGDVVELVQEGDEGLWYVRDPTTGKEGWVPASSLSVRLGPSGSAQCLSSSESSPGSAVLSNSSSCSEGGQAPFSDLQG

SEQ ID NO: 8451 - protein, 136 aa, Homo Sapiens
MTVRRLSLLCRDLWALWLLLKAGADEIMHQDIVPLCAADIQDQLKKRFAYLSGGRGQDGSPVITFPDYPAFSEIPDKEFQNVMTYLTSIPSGGQESSIRPVSCRLTWEGCRGGLSSDVLVPASRKMLRMSASHQTV

SEQ ID NO: 8452 - protein, 1123 aa, Homo Sapiens
MTVRRLSLLCRDLWALWLLLKAGADEIMHQDIVPLCAADIQDQLKKRFAYLSGGRGQDGSPVITFPDYPAFSEIPDKEFQNVMTYLTSIPSLQDAGIGFILVIDRRRDKWTSVKASVLRIAASFPANLQLVLVLRPTGFFQRTLSDIAFKFNRDDFKMKVPVIMLSSVPDLHGYIDKSQLTEDLGGTLDYCHSRWLCQRTAIESFALMVKQTAQMLQSFGTELAETELPNDVQSTSSVLCAHTEKKDKAKEDLRLALKEGHSVLESLRELQAEGSEPSVNQDQLDNQATVQRLLAQLNETEAAFDEFWAKHQQKLEQCLQLRHFEQGFREVKAILDAASQKIATFTDIGNSLAHVEHLLRDLASFEEKSGVAVERARALSLDGEQLIGNKHYAVDSIRPKCQELRHLCDQFSAEIARRRGLLSKSLELHRRLETSMKWCDEGIYLLASQPVDKCQSQDGAEAALQEIEKFLETGAENKIQELNAIYKEYESILNQDLMEHVRKVFQKQASMEEVFHRRQASLKKLAARQTRPVQPVAPRPEALAKSPCPSPGIRRGSENSSSEGGALRRGPYRRAKSEMSESRQGRGSAGEEEESLAILRRHVMSELLDTERAYVEELLCVLEGYAAEMDNPLMAHLLSTGLHNKKDVLFGNMEEIYHFHNRIFLRELENYTDCPELVGRCFLERMEDFQIYEKYCQNKPRSESLWRQCSDCPFFQECQRKLDHKLSLDSYLLKPVQRITKYQLLLKEMLKYSRNCEGAEDLQEALSSILGILKAVNDSMHLIAITGYDGNLGDLGKLLMQGSFSVWTDHKRGHTKVKELARFKPMQRHLFLHEKAVLFCKKREENGEGYEKAPSYSYKQSLNMAAVGITENVKGDAKKFEIWYNAREEVYIVQAPTPEIKAAWVNEIRKVLTSQLQACREASQHRALEQSQSLPLPAPTSTSPSRGNSRNIKKLEERKTDPLSLEGYVSSAPLTKPPEKGKGWSKTSHSLEAPEDDGGWSSAEEQINSSDAEEDGGLGPKKLVPGKYTVVADHEKGGPDALRVRSGDVVELVQEGDEGLWYVRDPTTGKEGWVPASSLSVRLGPSGSAQCLSSSESSPGSAVLSNSSSCSEGGQAPFSDLQG

SEQ ID NO: 8453 - protein, 984 aa, Homo Sapiens
MTVRRLSLLCRDLWALWLLLKAGADEIMHQDIVPLCAADIQDQLKKRFAYLSGGRGQDGSPVITFPDYPAFSEIPDKEFQNVMTYLTSIPSLQDAGIGFILVIDRRRDKWTSVKASVLRIAASFPANLQLVLVLRPTGFFQRTLSDIAFKFNRDDFKMKVPVIMLSSVPDLHGYIDKSQLTEDLGGTLDYCHSRWLCQRTAIESFALMVKQTAQMLQSFGTELAETELPNDVQSTSSVLCAHTEKKDKAKEDLRLALKEGHSVLESLRELQAEGSEPSVNQDQLDNQATVQRLLAQLNETEAAFDEFWAKHQQKLEQCLQLRHFEQGFREVKAILDAASQKIATFTDIGNSLAHVEHLLRDLASFEEKSGVAVERARALSLDGEQLIGNKHYAVDSIRPKCQELRHLCDQFSAEIARRRGLLSKSLELHRRLETSMKWCDEGIYLLASQPVDKCQSQDGAEAALQEIEKFLETGAENKIQELNAIYKEYESILNQDLMEHVRKVFQKQASMEEVFHRRQASLKKLAARQTRPVQPVAPRPEALAKSPCPSPGIRRGSENSSSEGGALRRGPYRRAKSEMSESRQGRGSAGEEEESLAILRRHVMSELLDTERAYVEELLCVLEGYAAEMDNPLMAHLLSTGLHNKKDVLFGNMEEIYHFHNRIFLRELENYTDCPELVGRCFLERMEDFQIYEKYCQNKPRSESLWRQCSDCPFFQECQRKLDHKLSLDSYLLKPVQRITKYQLLLKEMLKYSRNCEGAEDLQEALSSILGILKAVNDSMHLIAITGYDGNLGDLGKLLMQGSFSVWTDHKRGHTKVKELARFKPMQRHLFLHEKAVLFCKKREENGEGYEKAPSYSYKQSLNMAAVGITENVKGDAKKFEIWYNAREEVYIVQAPTPEIKAAWVNEIRKVLTSQLQACREASQHRALEQSQSLPLPAPTSTSPSRGNSRNIKKLEERKTDPLSLEGYVSSAPLTKPPEKGKEP

SEQ ID NO: 8454 - protein, 86 aa, Homo Sapiens
MWLSQRVLPPLPFPADAWEPSEVLGIFSQHRSHATTSESLTWTSTGTSDARTGVILQDAGIGFILVIDRRRDKWTSVKASVLRIAN

SEQ ID NO: 8455 - protein, 93 aa, Homo Sapiens
SPVITFPDYPAFSEIPDKEFQNVMTYLTSIPSILFMESAASEHWGQVAEALPFLPPGSARTAVTTSPRGPLPAPSQNVFPRSFSVTAVEFNSY

SEQ ID NO: 8456 - protein, 213 aa, Homo Sapiens
TSTGTSDARTGVILQDAGIGFILVIDRRRDKWTSVKASVLRIAASFPANLQLVLVLRPTGFFQRTLSDIAFKFNRDDFKMKVPVIMLSSVPDLHGYIDKSQLTEDLGGTLDYCHSRWLCQRTAIESFALMVKQTAQMLQSFGTELAETELPNDVQSTSSVLCAHTEKKDKAKVHGGCSGWKLWGAPVSQKLRGAPVGSCGGSFVPAGVCVSST

SEQ ID NO: 8457 - protein, 336 aa, Homo Sapiens
  misc_feature (1)..(1): Xaa can be any naturally occurring amino acid
XENGEGYEKAPSYSYKQSLNMAAVGITENVKGDAKKFEIWYNAREEVYIVQAPTPEIKAAWVNEIRKVLTSQLQACREASQHRALEQSQSLPLPAPTSTSPSRGNSRNIKKLEERKTDPLSLEGYVSSAPLTKPPEKGKDDTVTSSASESSALSRKRFTLQGFANLKGQKASPTSPDKKAKRHEVKSDPTPFGVRGWSKTSHSLEAPEDDGGWSSAEEQINSSDAEEDGGLGPKKLVPGKYTVVADHEKGGPDALRVRSGDVVELVQEGDEGLWYVRDPTTGKEGWVPASSLSVRLGPSGSAQCLSSSESSPGSAVLSNSSSCSEGGQAPFSDLQG

SEQ ID NO: 8458 - protein, 296 aa, Homo Sapiens
  misc_feature (1)..(1): Xaa can be any naturally occurring amino acid
XHLFLHEKAVLFCKKREENGEGYEKAPSYSYKQSLNMAAVGITENVKGDAKKFEIWYNAREEVYIVQAPTPEIKAAWVNEIRKVLTSQLQACREASQHRALEQSQSLPLPAPTSTSPSRGNSRNIKKLEERKTDPLSLEGYVSSAPLTKPPEKGKGWSKTSHSLEAPEDDGGWSSAEEQINSSDAEEDGGLGPKKLVPGKYTVVADHEKGGPDALRVRSGDVVELVQEGDEGLWYVRDPTTGKEGWVPASSLSVRLGPSGSAQCLSSSESSPGSAVLSNSSSCSEGGQAPFSDLQG

SEQ ID NO: 8459 - protein, 189 aa, Homo Sapiens
  misc_feature (1)..(1): Xaa can be any naturally occurring amino acid
XKKLEERKTDPLSLEGYVSSAPLTKPPEKGKASPTSPDKKAKRHEVKSDPTPFGVRGWSKTSHSLEAPEDDGGWSSAEEQINSSDAEEDGGLGPKKLVPGKYTVVADHEKGGPDALRVRSGDVVELVQEGDEGLWYVRDPTTGKEGWVPASSLSVRLGPSGSAQCLSSSESSPGSAVLSNSSSCSEGGQ

SEQ ID NO: 8460 - protein, 317 aa, Homo Sapiens
  misc_feature (1)..(1): Xaa can be any naturally occurring amino acid
XLGILKAVNDSMHLIAITGYDGNLGDLGKLLMQGSFSVWTDHKRGHTKVKELARFKPMQRHLFLHEKAVLFCKKREENGEGYEKAPSYSYKQSLNMAAVGITENVKGDAKKFEIWYNAREEVYIVQAPTPEIKAAWVNEIRKVLTSQLQACREASQHRALEQSQSLPLPAPTSTSPSRGNSRNIKKLEERKTDPLSLEGYVSSAPLTKPPEKGKDDTVTSSASESSALSRKRFTLQGFANLKASPTSPDKKAKRHEVKSDPTPFGVRGWSKTSHSLEAPEDDGGWSSAEEQINSSDAEEDGGLGPKKLVPGKYTVVA

SEQ ID NO: 8461 - protein, 151 aa, Homo Sapiens
  misc_feature (1)..(1): Xaa can be any naturally occurring amino acid
XQAPTPEIKAAWVNEIRKVLTSQLQACREASQHRALEQSQSLPLPAPTSTSPSRGNSRNIKKLEERKTDPLSLEGYVSSAPLTKPPEKGKDDTVTSSASESSALSRKRFTLQGFANLKGQKGWSKTSHSLEAPEDDGGWSSAEEQINSSDA

SEQ ID NO: 8462 - protein, 87 aa, Homo Sapiens
  misc_feature (1)..(1): Xaa can be any naturally occurring amino acid
XSAPLTKPPEKGKGWSKTSHSLEAPEDDGGWSSAEEQINSSDAEEDGGLGPKKLVPTQPPVEPTRGCTFLRGDSPHPPTLYVIECCH

SEQ ID NO: 8463 - protein, 69 aa, Homo Sapiens
  misc_feature (1)..(1): Xaa can be any naturally occurring amino acid
XSEIPDKEFQNVMTYLTSIPSLQDAGIGFILVIDRRRDKWTSVKASVLRIALRARCTESEPLHPGGSGI

SEQ ID NO: 8464 - protein, 793 aa, Homo Sapiens
  misc_feature (1)..(1): Xaa can be any naturally occurring amino acid
XSQKIATFTDIGNSLAHVEHLLRDLASFEEKSGVAVERARALSLDGEQLIGNKHYAVDSIRPKCQELRHLCDQFSAEIARRRGLLSKSLELHRRLETSMKWCDEGIYLLASQPVDKCQSQDGAEAALQEIEKFLETGAENKIQELNAIYKEYESILNQDLMEHVRKVFQKQASMEEVFHRRQASLKKLAARQTRPVQPVAPRPEALAKSPCPSPGIRRGSENSSSEGGALRRGPYRRAKSEMSESRQGRGSAGEEEESLAILRRHVMSELLDTERAYVEELLCVLEGYAAEMDNPLMAHLLSTGLHNKKDVLFGNMEEIYHFHNRIFLRELENYTDCPELVGRCFLERMEDFQIYEKYCQNKPRSESLWRQCSDCPFFQECQRKLDHKLSLDSYLLKPVQRITKYQLLLKEMLKYSRNCEGAEDLQEALSSILGILKAVNDSMHLIAITGYDGNLGDLGKLLMQGSFSVWTDHKRGHTKVKELARFKPMQRHLFLHEKAVLFCKKREENGEGYEKAPSYSYKQSLNMAAVGITENVKGDAKKFEIWYNAREEVYIVQAPTPEIKAAWVNEIRKVLTSQLQACREASQHRALEQSQSLPLPAPTSTSPSRGNSRNIKKLEERKTDPLSLEGYVSSAPLTKPPEKGKASPTSPDKKAKRHEVKSDPTPFGVRGWSKTSHSLEAPEDDGGWSSAEEQINSSDAEEDGGLGPKKLVPGKYTVVADHEKGGPDALRVRSGDVVELVQEGDEGLWYVRDPTTGKEGWVPASSLSVRLGPSGSAQCLSSSGKAHVPRAHP

SEQ ID NO: 8465 - protein, 94 aa, Homo Sapiens
MEHLEGVINKPEAEMSPQELQLHYFKMHDYDGNNLLDGLELSTAITHVHKEEGSEQAPLMSEDELINIIDGVLRDDDKNNDGYIDYAEFAKSLQ

SEQ ID NO: 8466 - protein, 94 aa, Homo Sapiens; identical to SEQ ID NO: 8465

SEQ ID NO: 8467 - protein, 94 aa, Homo Sapiens; identical to SEQ ID NO: 8465

SEQ ID NO: 8468 - protein, 127 aa, Homo Sapiens
MLSVCSCRTSSGMRSQWPSARQRSSSLSTFRHIMEHLEGVINKPEAEMSPQELQLHYFKMHDYDGNNLLDGLELSTAITHVHKEEGSEQAPLMSEDELINIIDGVLRDDDKNNDGYIDYAEFAKSLQ

SEQ ID NO: 8469 - protein, 61 aa, Homo Sapiens
MTMRSLLRTPFLCGLLWAFCAPGARAEEPAASFSQPGSMGLDKNTVHDQEHIMEHLEGVIN

SEQ ID NO: 8470 - protein, 146 aa, Homo Sapiens
MTMRSLLRTPFLCGLLWAFCAPGARAEEPAASFSQPGSMGLDKNTVHDQEHIMEHLEGVINKPEAEMSPQELQLHYFKMHDYDGNNLLDGLELSTAITHVHKEEGSEQAPLMSEDELINIIDGVLRDDDKNNDGYIDYAEFAKSLQ

SEQ ID NO: 8471 - protein, 146 aa, Homo Sapiens; identical to SEQ ID NO: 8470

SEQ ID NO: 8472 - protein, 146 aa, Homo Sapiens; identical to SEQ ID NO: 8470

SEQ ID NO: 8473 - protein, 146 aa, Homo Sapiens; identical to SEQ ID NO: 8470

SEQ ID NO: 8474 - protein, 146 aa, Homo Sapiens; identical to SEQ ID NO: 8470

SEQ ID NO: 8475 - protein, 146 aa, Homo Sapiens; identical to SEQ ID NO: 8470

SEQ ID NO: 8476 - protein, 90 aa, Homo Sapiens
SQPGSMGLDKNTVHDQEHIMEHLEGVINKPEAEMSPQELQLHYFKMHDYDGNNLLDGLELSTAITHVHKEANLCTELTLRRTGTFPIKEE

SEQ ID NO: 8477 - protein, 156 aa, Homo Sapiens
GPVGPQRVAEAGGGQLGSTAQGKCDKDNTEKDITQATNSHFTHGEMQDQSIWGNPSDGELIRTQPQRLPQLQTSAQVPSGEEIGKIKNGHTGLSNGNGIHHGAKHGSADNRKLSAPVSQKMHRKIQSSLSVNSDISKKSKVNAVFSQKTGSSPEVC

SEQ ID NO: 8478 - protein, 135 aa, Homo Sapiens
MQDQSIWGNPSDGELIRTQPQRLPQLQTSAQVPSGEEIGKIKNGHTGLSNGNGIHHGAKHGSADNRKLSAPVSQKMHRKIQSSLSVNSDISKKSKVNAVFSQKTGSSPEDCCVHCILACLFCEFLTLCNIVLGQA

SEQ ID NO: 8479 - protein, 246 aa, Homo Sapiens
MSGAGEALAPGPVGPQRVAEAGGGQLGSTAQGKCDKDNTEKDITQATNSHFTHGEMQDQSIWGNPSDGELIRTQPQRLPQLQTSAQVPSGEEIGKIKNGHTGLSNGNGIHHGAKHGSADNRKLSAPVSQKMHRKIQSSLSVNSDISKKSKVNAVFSQKTGSSPEDCCVHCILACLFCEFLTLCNIVLGQASCGICTSEACCCCCGDEMGDDCNCPCDMDCGIMDACCESSDCLEICMECCGICFPS

SEQ ID NO: 8480 - protein, 43 aa, Homo Sapiens
MSGAGEALAPGPVGPQRVAEAGGGQLGSTAQGLFSRSRTAAAL

SEQ ID NO: 8481 - protein, 43 aa, Homo Sapiens; identical to SEQ ID NO: 8480

SEQ ID NO: 8482 - protein, 156 aa, Homo Sapiens
PQRVAEAGGGQLGSTAQGKCDKDNTEKDITQATNSHFTHGEMQDQSIWGNPSDGELIRTQPQRLPQLQTSAQVPSGEEIGKIKNGHTGLSNGNGIHHGAKHGSADNRKLSAPVSQKMHRKIQSSLSVNSDISKKSKVNAVFSQKTGSSPEDKQEFW

SEQ ID NO: 8483 - protein, 355 aa, Homo Sapiens
VRGVRAATAAAVAATAASGLSRREAGGRAGAAAAVVRPPGRKCGRCRRLANFPGRKRRRRRRKGLGATTGGCGEAVSSLHPAPHSPSSVRPAGRRARRQRRGAGSAERPMSGAGEALAPGPVGPQRVAEAGGGQLGSTAQGKCDKDNTEKDITQATNSHFTHGEMQDQSIWGNPSDGELIRTQPQRLPQLQTSAQVPSGEEIGKIKNGHTGLSNGNGIHHGAKHGSADNRKLSAPVSQKMHRKIQSSLSVNSDISKKSKVNAVFSQKTGSSPEDCCVHCILACLFCEFLTLCNIVLGQASCGICTSEACCCCCGDEMGDDCNCPCDMDCGIMDACCESSDCLEICMECCGICFPS

SEQ ID NO: 8484 - protein, 355 aa, Homo Sapiens; identical to SEQ ID NO: 8483

SEQ ID NO: 8485 - protein, 973 aa, Homo Sapiens
MEVTCLLLLALIPFHCRGQGVYAPAQAQIVHAGQACVVKEDNISERVYTIREGDTLMLQCLVTGHPRPQVRWTKTAGSASDKFQETSVFNETLRIERIARTQGGRYYCKAENGVGVPAIKSIRVDVQYLDEPMLTVHQTVSDVRGNFYQEKTVFLRCTVNSNPPARFIWKRGSDTLSHSQDNGVDIYEPLYTQGETKVLKLKNLRPQDYASYTCQVSVRNVCGIPDKAITFRLTNTTAPPALKLSVNETLVVNPGENVTVQCLLTGGDPLPQLQWSHGPGPLPLGALAQGGTLSIPSVQARDSGYYNCTATNNVGNPAKKTVNLLVRSMKNATFQITPDVIKESENIQLGQDLKLSCHVDAVPQEKVTYQWFKNGKPARMSKRLLVTRNDPELPAVTSSLELIDLHFSDYGTYLCMASFPGAPVPDLSVEVNISSETVPPTISVPKGRAVVTVREGSPAELQCEVRGKPRPPVLWSRVDKEAALLPSGLPLEETPDGKLRLERVSRDMSGTYRCQTARYNGFNVRPREAQVQLNVQFPPEVEPSSQDVRQALGRPVLLRCSLLRGSPQRIASAVWRFKGQLLPPPPVVPAAAEAPDHAELRLDAVTRDSSGSYECSVSNDVGSAACLFQVSAKAYSPEFYFDTPNPTRSHKLSKNYSYVLQWTQREPDAVDPVLNYRLSIRQLNQHNAVVKAIPVRRVEKGQLLEYILTDLRVPHSYEVRLTPYTTFGAGDMASRIIHYTEPINSPNLSDNTCHFEDEKICGYTQDLTDNFDWTRQNALTQNPKRSPNTGPPTDISGTPEGYYMFIETSRPRELGDRARLVSPLYNASAKFYCVSFFYHMYGKHIGSLNLLVRSRNKGALDTHAWSLSGNKGNVWQQAHVPISPSGPFQIIFEGVRGPGYLGDIAIDDVTLKKGECPRKQTDPNKGARREGGGGAESGGSCAWRGFLSVEGGCLGLNRGSECLSDGNHVALTV

SEQ ID NO: 8486 - protein, 955 aa, Homo Sapiens
MEVTCLLLLALIPFHCRGQGVYAPAQAQIVHAGQACVVKEDNISERVYTIREGDTLMLQCLVTGHPRPQVRWTKTAGSASDKFQETSVFNETLRIERIARTQGGRYYCKAENGVGVPAIKSIRVDVQYLDEPMLTVHQTVSDVRGNFYQEKTVFLRCTVNSNPPARFIWKRGSDTLSHSQDNGVDIYEPLYTQGETKVLKLKNLRPQDYASYTCQVSVRNVCGIPDKAITFRLTNTTAPPALKLSVNETLVVNPGENVTVQCLLTGGDPLPQLQWSHGPGPLPLGALAQGGTLSIPSVQARDSGYYNCTATNNVGNPAKKTVNLLVRSMKNATFQITPDVIKESENIQLGQDLKLSCHVDAVPQEKVTYQWFKNGKPARMSKRLLVTRNDPELPAVTSSLELIDLHFSDYGTYLCMASFPGAPVPDLSVEVNISSETVPPTISVPKGRAVVTVREGSPAELQCEVRGKPRPPVLWSRVDKEAALLPSGLPLEETPDGKLRLERVSRDMSGTYRCQTARYNGFNVRPREAQVQLNVQFPPEVEPSSQDVRQALGRPVLLRCSLLRGSPQRIASAVWRFKGQLLPPPPVVPAAAEAPDHAELRLDAVTRDSSGSYECSVSNDVGSAACLFQVSAKAYSPEFYFDTPNPTRSHKLSKNYSYVLQWTQREPDAVDPVLNYRLSIRQLNQHNAVVKAIPVRRVEKGQLLEYILTDLRVPHSYEVRLTPYTTFGAGDMASRIIHYTEPINSPNLSDNTCHFEDEKICGYTQDLTDNFDWTRQNALTQNPKRSPNTGPPTDISGTPEGYYMFIETSRPRELGDRARLVSPLYNASAKFYCVSFFYHMYGKHIGSLNLLVRSRNKGALDTHAWSLSGNKGNVWQQAHVPISPSGPFQIIFEGVRGPGYLGDIAIDDVTLKKGECPRKQTDPNKVVVMPGSGAPCQSSPQLWGPMAIFLLALQR

SEQ ID NO: 8487 - protein, 77 aa, Homo Sapiens
MLQCLVTGHPRPQVRWTKTAGSASDKFQETSVFNETLRIERIARTQGGRYYCKAENGVGVPAIKSIRVDVQYLDEPM

SEQ ID NO: 8488 - protein, 129 aa, Homo Sapiens
MLQCLVTGHPRPQVRWTKTAGSASDKFQETSVFNETLRIERIARTQGGRYYCKAENGVGVPAIKSIRVDVQYLDEPMLTVHQTVSDVRGNFYQEKTVFLRCTVNSNPPARFIWKRGSDTLSHSQDNGVD

SEQ ID NO: 8489 - protein, 87 aa, Homo Sapiens
  misc_feature (1)..(1): Xaa can be any naturally occurring amino acid
XHKLSKNYSYVLQWTQREPDAVDPVLNYRLSIRQLNQHNAVVKAIPVRRVEKGQLLEYILTDLRVPHSYETTPATLRMRRSVAIPRT

SEQ ID NO: 8490 - protein, 160 aa, Homo Sapiens
  misc_feature (1)..(1): Xaa can be any naturally occurring amino acid
XNQHNAVVKAIPVRRVEKGQLLEYILTDLRVPHSYEVRLTPYTTFGAGDMASRIIHYTEHNTCHFEDEKICGYTQDLTDNFDWTRQNALTQNPKRSPNTGPPTDISGTPEGYYMFIETSRPRELGDRARLVSPLYNASAKFYCVSFFYHMYGKHIGSLNL

SEQ ID NO: 8491 - protein, 87 aa, Homo Sapiens
MQHRGFLLLTLLALLALTSAVAKKKADCKYKFENWGACDGGTGTKVRQGTLKKARYNAQCQETIRVTKPCTPKTKAKAKAKKGKGKD

SEQ ID NO: 8492 - protein, 49 aa, Homo Sapiens
MQHRGFLLLTLLALLALTSAVAKKKDKVKKGGPGSECAEWAWGPCTPSS

SEQ ID NO: 8493 - protein, 131 aa, Homo Sapiens
MQHRGFLLLTLLALLALTSAVAKKKDKVKKGGPGSECAEWAWGPCTPSSKDCGVGFREGTCGAQTQRIRCRVPCNWKKEFGADCKYKFENWGACDGGTGTKVRQGTLKKARYNAQCQETIRVTKPCTPKTK

SEQ ID NO: 8494 - protein, 143 aa, Homo Sapiens
MQHRGFLLLTLLALLALTSAVAKKKDKVKKGGPGSECAEWAWGPCTPSSKDCGVGFREGTCGAQTQRIRCRVPCNWKKEFGADCKYKFENWGACDGGTGTKVRQGTLKKARYNAQCQETIRVTKPCTPKTKAKAKAKKGKGKD

SEQ ID NO: 8495 - protein, 143 aa, Homo Sapiens; identical to SEQ ID NO: 8494

SEQ ID NO: 8496 - protein, 143 aa, Homo Sapiens; identical to SEQ ID NO: 8494

SEQ ID NO: 8497 - protein, 143 aa, Homo Sapiens; identical to SEQ ID NO: 8494

SEQ ID NO: 8498 - protein, 143 aa, Homo Sapiens; identical to SEQ ID NO: 8494

SEQ ID NO: 8499 - protein, 156 aa, Homo Sapiens
MQHRGFLLLTLLALLALTSAVAKKKDKVKKGGPGSECAEWAWGPCTPSSKDCGVGFREGTCGAQTQRIRCRVPCNWKKEFGADCKYKFENWGACDGGTGTKVRQGTLKKARYNAQCQETIRVTKPCTPKTKAKAKGQRKEKGVGLSRGAAPPPPRL

SEQ ID NO: 8500 - protein, 152 aa, Homo Sapiens
MQHRGFLLLTLLALLALTSAVAKKKEEGALQCSVPGDHPRHQALHPQDQSKGQSQEREGKGLDAKPGCQGAPGVTWGLAHALPLPGPRCDPPVPSVCSLALINHALPCPSHSPAPPLSAQSGEGQGILGSLSLPQSNVSPRARFCSSPQFHY

SEQ ID NO: 8501 - protein, 123 aa, Homo Sapiens
MGVTCVSQMPVAEGKSVQQTVELLTRKLEMLGAEKQGTFCVDCETYHTAASTLGSQGQTGKLMYVMHNSEYPLSCFALFENGPCLIADTNFDVLMVKLKGFFQSAKASKIETRGTRWSMAPVW

SEQ ID NO: 8502 - protein, 212 aa, Homo Sapiens
MGVTCVSQMPVAEGKSVQQTVELLTRKLEMLGAEKQGTFCVDCETYHTAASTLGSQGQTGKLMYVMHNSEYPLSCFALFENGPCLIADTNFDVLMVKLKGFFQSAKASKIETRGTRYQYCDFLVKVGTVTMGPSARGISVEVEYGPCVVASDCWSLLLEFLQSFLGSHTPGAPAVFGNRHDAVYGPADTMVQYMELFNKIRKQQQVPVAGIR

SEQ ID NO: 8503 - protein, 145 aa, Homo Sapiens
MGVTCVSQMPVAEGKSVQQTVELLTRKLEMLGAEKQGTFCVDCETYHTAASTLGSQGQTGKLMYVMHNSEYPLSCFALFENGPCLIADTNFDVLMVKLKGFFQSAKASKIETRGTRYQYCDFLVKVGTVTMGPSARGISVEVRPW

SEQ ID NO: 8504 - protein, 61 aa, Homo Sapiens [sequence omitted]

SEQ ID NO: 8505 - protein, 140 aa, Homo Sapiens
MPVAEGKSVQQTVELLTRKLEMLGAEKQGTFCVDCETYHTAASTLGSQGQTGKLMYVMHNSEYPLSCFALFENGPCLIADTNFDVLMVKLKGFFQSAKASKIETRGTRYQYCDFLVKVGTVTMGPSARGISVEVEYGPCV

SEQ ID NO: 8506 - protein, 1140 aa, Homo Sapiens
MVISLNSCLSFICLLLCHWIGTASPLNLEDPNVCSHWESYSVTVQESYPHPFDQIYYTSCTDILNWFKCTRHRVSYRTAYRHGEKTMYRRKSQCCPGFYESGEMCVPHCADKCVHGRCIAPNTCQCEPGWGGTNCSSACDGDHWGPHCTSRCQCKNGALCNPITGACHCAAGFRGWRCEDRCEQGTYGNDCHQRCQCQNGATCDHVTGECRCPPGYTGAFCEDLCPPGKHGPQCEQRCPCQNGGVCHHVTGECSCPSGWMGTVCGQPCPEGRFGKNCSQECQCHNGGTCDAATGQCHCSPGYTGERCQDECPVGTYGVLCAETCQCVNGGKCYHVSGACLCEAGFAGERCEARLCPEGLYGIKCDKRCPCHLENTHSCHPMSGECACKPGWSGLYCNETCSPGFYGEACQQICSCQNGADCDSVTGKCTCAPGFKGIDCSTPCPLGTYGINCSSRCGCKNDAVCSPVDGSCTCKAGWHGVDCSIRCPSGTWGFGCNLTCQCLNGGACNTLDGTCTCAPGWRGEKCELPCQDGTYGLNCAERCDCSHADGCHPTTGHCRCLPGWSGVHCDSVCAEGRWGPNCSLPCYCKNGASCSPDDGICECAPGFRGTTCQRICSPGFYGHRCSQTCPQCVHSSGPCHHITGLCDCLPGFTGALCNEVCPSGRFGKNCAGICTCTNNGTCNPIDRSCQCYPGWIGSDCSQPCPPAHWGPNCIHTCNCHNGAFCSAYDGECKCTPGWTGLYCTQRCPLGFYGKDCALICQCQNGADCDHISGQCTCRTGFMGRHCEQKCPSGTYGYGCRQICDCLNNSTCDHITGTCYCSPGWKGARCDQAGVIIVGNLNSLSRTSTALPADSYQIGAIAGIIILVLVVLFLLALFIIYRHKQKGKESSMPAVTYTPAMRVVNADYTISGTLPHSNGGNANSHYFTNPSYHTLTQCATSPHVNNRDRMTVTKSKNNQLFVNLKNVNPGKRGPVGDCTGTLPADWKHGGYLNELGAFGLDRSYMGKSLKDLGKNSEYNSSNCSLSSSENPYATIKDPPVLIPKSSECGYVEMKSPARRDSPYAEINNSTSANRNVYEVEPTVSVVQGVFSNNGRLSQDPYDLPKNSHIPCHYDLLPVRDSSSSPKQEDSGGSSSNSSSSSE

SEQ ID NO: 8507 - protein, 567 aa, Homo Sapiens
MVISLNSCLSFICLLLCHWIGTASPLNLEDPNVCSHWESYSVTVQESYPHPFDQIYYTSCTDILNWFKCTRHRVSYRTAYRHGEKTMYRRKSQCCPGFYESGEMCVPHCADKCVHGRCIAPNTCQCEPGWGGTNCSSACDGDHWGPHCTSRCQCKNGALCNPITGACHCAAGFRGWRCEDRCEQGTYGNDCHQRCQCQNGATCDHVTGECRCPPGYTGAFCEDLCPPGKHGPQCEQRCPCQNGGVCHHVTGECSCPSGWMGTVCGQPCPEGRFGKNCSQECQCHNGGTCDAATGQCHCSPGYTGERCQDECPVGTYGVLCAETCQCVNGGKCYHVSGACLCEAGFAGERCEARLCPEGLYGIKCDKRCPCHLENTHSCHPMSGECACKPGWSGLYCNETCSPGFYGEACQQICSCQNGADCDSVTGKCTCAPGFKGIDCSTPCPLGTYGINCSSRCGCKNDAVCSPVDGSCTCKAGWHGVDCSIRCPSGTWGFGCNLTCQCLNGGACNTLDGTCTCAPGWRGEKCELPCQDGTYGLNCAERCDCSHADGCHPTTGHCRCLPGWSGLF

SEQ ID NO: 8508 - protein, 1140 aa, Homo Sapiens; identical to SEQ ID NO: 8506

SEQ ID NO: 8509 - protein, 567 aa, Homo Sapiens; identical to SEQ ID NO: 8507

SEQ ID NO: 8510 - protein, 1229 aa, Homo Sapiens
MGASRDRGLAALWCLGLLGGLARVAGTHYRYLWRGCYPCHLGQAGYPVSAGDQRPDVDECRTHNGGCQHRCVNTPGSYLCECKPGFRLHTDSRTCLAINSCALGNGGCQHHCVQLTITRHRCQCRPGFQLQEDGRHCVRRSPCANRNGSCMHRCQVVRGLARCECHVGYQLAADGKACEDVDECAAGLAQCAHGCLNTQGSFKCVCHAGYELGADGRQCYRIEMEIVNSCEANNGGCSHGCSHTSAGPLCTCPRGYELDTDQRTCIDVDDCADSPCCQQVCTNNPGGYECGCYAGYRLSADGCGCEDVDECASSRGGCEHHCTNLAGSFQCSCEAGYRLHEDRRGCSPLEEPMVDLDGELPFVRPLPHIAVLQDELPQLFQDDDVGADEEEAELRGEHTLTEKFVCLDDSFGHDCSLTCDDCRNGGTCLLGLDGCDCPEGWTGLICNETCPPDTFGKNCSFSCSCQNGGTCDSVTGACRCPPGVSGTNCEDGCPKGYYGKHCRKKCNCANRGRCHRLYGACLCDPGLYGRFCHLTCPPWAFGPGCSEECQCVQPHTQSCDKRDGSCSCKAGFRGERCQAECELGYFGPGCWQACTCPVGVACDSVSGECGKRCPAGFQGEDCGQECPVGTFGVNCSSSCSCGGAPCHGVTGQCRCPPGRTGEDCEADCPEGRWGLGCQEICPACQHAARCDPETGACLCLPGFVGSRCQDVCPAGWYGPSCQTRCSCANDGHCHPATGHCSCAPGWTGFSCQRACDTGHWGPDCSHPCNCSAGHGSCDAISGLCLCEAGYVGPRCEQQCPQGHFGPGCEQRCQCQHGAACDHVSGACTCPAGWRGTFCEHACPAGFFGLDCRSACNCTAGAACDAVNGSCLCPAGRRGPRCAEKCLPRDVRAGCRHSGGCLNGGLCDPHTGRCLCPAGWTGDKCQSPCLRGWFGEACAQRCSCPPGAACHHVTGACRCPPGFTGSGCEQGCPPGRYGPGCEQLCGCLNGGSCDAATGACRCPTGFLGTDCNLTCPQGRFGPNCTHVCGCGQGAACDPVTGTCLCPPGRAGVRCERGCPQNRFGVGCEHTCSCRNGGLCHASNGSCSCGLGWTGRHCELACPPGRYGAACHLECSCHNNSTCEPATGTCRCGPGFYGQACEHRRSGATCNLDCRRGQFGPSCTLHCDCGGGADCDPVSGQCHCVDGYMGPTCREGGPLRLPENPSLAQGSAGTLPASSRPTSRSGGPARH

SEQ ID NO: 8511 - protein, 1541 aa, Homo Sapiens
MSFLEEARAAGRAVVLALVLLLLPAVPVGASVPPRPLLPLQPGMPHVCAEQELTLVGRRQPCVQALSHTVPVWKAGCGWQAWCVGHERRTVYYMGYRQVYTTEARTVLRCCRGWMQQPDEEGCLSAECSASLCFHGGRCVPGSAQPCHCPPGFQGPRCQYDVDECRTHNGGCQHRCVNTPGSYLCECKPGFRLHTDSRTCLAINSCALGNGGCQHHCVQLTITRHRCQCRPGFQLQEDGRHCVRRSPCANRNGSCMHRCQVVRGLARCECHVGYQLAADGKACEDVDECAAGLAQCAHGCLNTQGSFKCVCHAGYELGADGRQCYRIEMEIVNSCEANNGGCSHGCSHTSAGPLCTCPRGYELDTDQRTCIDVDDCADSPCCQQVCTNNPGGYECGCYAGYRLSADGCGCEDVDECASSRGGCEHHCTNLAGSFQCSCEAGYRLHEDRRGCSPLEEPMVDLDGELPFVRPLPHIAVLQDELPQLFQDDDVGADEEEAELRGEHTLTEKFVCLDDSFGHDCSLTCDDCRNGGTCLLGLDGCDCPEGWTGLICNETCPPDTFGKNCSFSCSCQNGGTCDSVTGACRCPPGVSGTNCEDGCPKGYYGKHCRKKCNCANRGRCHRLYGACLCDPGLYGRFCHLTCPPWAFGPGCSEECQCVQPHTQSCDKRDGSCSCKAGFRGERCQAECELGYFGPGCWQACTCPVGVACDSVSGECGKRCPAGFQGEDCGQECPVGTFGVNCSSSCSCGGAPCHGVTGQCRCPPGRTGEDCEADCPEGRWGLGCQEICPACQHAARCDPETGACLCLPGFVGSRCQDVCPAGWYGPSCQTRCSCANDGHCHPATGHCSCAPGWTGFSCQRACDTGHWGPDCSHPCNCSAGHGSCDAISGLCLCEAGYVGPRCEQQCPQGHFGPGCEQRCQCQHGAACDHVSGACTCPAGWRGTFCEHACPAGFFGLDCRSACNCTAGAACDAVNGSCLCPAGRRGPRCAETCPAHTYGHNCSQACACFNGASCDPVHGQCHCAPGWMGPSCLQACPAGLYGDNCRHSCLCQNGGTCDPVSGHCACPEGWAGLACEKECLPRDVRAGCRHSGGCLNGGLCDPHTGRCLCPAGWTGDKCQSPCLRGWFGEACAQRCSCPPGAACHHVTGACRCPPGFTGSGCEQACPPGSFGEDCAQMCQCPGENPACHPATGTCSCAAGYHGPSCQQRCPPGRYGPGCEQLCGCLNGGSCDAATGACRCPTGFLGTDCNLTCPQGRFGPNCTHVCGCGQGAACDPVTGTCLCPPGRAGVRCERGCPQNRFGVGCEHTCSCRNGGLCHASNGSCSCGLGWTGRHCELACPPGRYGAACHLECSCHNNSTCEPATGTCRCGPGFYGQACEHPCPPGFHGAGCQGLCWCQHGAPCDPISGRCLCPAGFHGHFCERGCEPGSFGEGCHQRCDCDGGAPCDPVTGLCLCPPGRSGATCNLDCRRGQFGPSCTLHCDCGGGADCDPVSGQCHCVDGYMGPTCREGGPLRLPENPSLAQGSAGTLPASSRPTSRSGGPARH

SEQ ID NO: 8512 - protein, 1323 aa, Homo Sapiens
MSFLEEARAAGRAVVLALVLLLLPAVPVGASVPPRPLLPLQPGMPHVCAEQELTLVGRRQPCVQALSHTVPVWKAGCGWQAWCVGHERRTVYYMGYRQVYTTEARTVLRCCRGWMQQPDEEGCLSDVGECANANGGCAGRCRDTVGGFYCRWPPPSHQLQGDGETCQDVDECRTHNGGCQHRCVNTPGSYLCECKPGFRLHTDSRTCLAINSCALGNGGCQHHCVQLTITRHRCQCRPGFQLQEDGRHCVRRSPCANRNGSCMHRCQVVRGLARCECHVGYQLAADGKACEDVDECAAGLAQCAHGCLNTQGSFKCVCHAGYELGADGRQCYRIEMEIVNSCEANNGGCSHGCSHTSAGPLCTCPRGYELDTDQRTCIDVDDCADSPCCQQVCTNNPGGYECGCYAGYRLSADGCGCEDVDECASSRGGCEHHCTNLAGSFQCSCEAGYRLHEDRRGCSPLEEPMVDLDGELPFVRPLPHIAVLQDELPQLFQDDDVGADEEEAELRGEHTLTEKFVCLDDSFGHDCSLTCDDCRNGGTCLLGLDGCDCPEGWTGLICNETCPPDTFGKNCSFSCSCQNGGTCDSVTGACRCPPGVSGTNCEDGCPKGYYGKHCRKKCNCANRGRCHRLYGACLCDPGLYGRFCHLTCPPWAFGPGCSEECQCVQPHTQSCDKRDGSCSCKAGFRGERCQAECELGYFGPGCWQACTCPVGVACDSVSGECGKRCPAGFQGEDCGQECPVGTFGVNCSSSCSCGGAPCHGVTGQCRCPPGRTGEDCEADCPEGRWGLGCQEICPACQHAARCDPETGACLCLPGFVGSRCQDVCPAGWYGPSCQTRCSCANDGHCHPATGHCSCAPGWTGFSCQRACDTGHWGPDCSHPCNCSAGHGSCDAISGLCLCEAGYVGPRCEQQCPQGHFGPGCEQRCQCQHGAACDHVSGACTCPAGWRGTFCEHACPAGFFGLDCRSACNCTAGAACDAVNGSCLCPAGRRGPRCAETCPAHTYGHNCSQACACFNGASCDPVHGQCHCAPGWMGPSCLQACPAGLYGDNCRHSCLCQNGGTCDPVSGHCACPEGWAGLACEKECLPRDVRAGCRHSGGCLNGGLCDPHTGRCLCPAGWTGDKCQSPCAKGTFGPHCEGRCACRWGGPCHLATGACLCPPGWRGAPGVRMPACGAGLERPVPSAAAARLALPATTSLGPAAVPLASLAPAASRPAHPAALGRTVRRCASVPVRTRPATLPPGPAHVLLATTAPAASNDVRPGGMGQAVNSCVGVSTGAPVMRPRGPAAAPLGSSGRTATSPVRRAASAPTAPTCVGVGRGRPATL

SEQ ID NO: 8513 - protein, 248 aa, Homo Sapiens
  misc_feature (1)..(1): Xaa can be any naturally occurring amino acid
XDAATGACRCPTGFLGTDCNLTCPQGRFGPNCTHVCGCGQGAACDPVTGTCLCPPGRAGVRCERGCPQNRFGVGCEHTCSCRNGGLCHASNGSCSCGLGWTGRHCELACPPGRYGAACHLECSCHNNSTCEPATGTCRCGPGFYGQACEHPCPPGFHGAGCQGLCWCQHGAPCDPISGRCLCPAGFHGHFCERDCRRGQFGPSCTLHCDCGGGADCDPVSGQCHCVDGYMGPTCREGGPLRLPENPSL

SEQ ID NO: 8514 - protein, 1274 aa, Homo Sapiens
MAVRQAATAGTPGPRREEEAALLFERAHYRHDPRWLLPVTPRLCLACALELLPDPGVSLVRKKHMLSCFQDALVRHTSLVTQLVSQDQRVCIHFISVLFGLLCSMEDGSVTDLCIEVLIQITTQLKLEQTIRCLLDECHKELCNMPSMRGSLATLTLLGKLVDAIPALADELVMEHGNLMEHLLRGLVYPSEGIQASVCYLYGKLYSSPVAAEMLSGHFREKLFPLFLSILDGAQTKELQINCLGLLRQLLKYDLFVSMIMNQDGLGESAKNIEGSSGNTSLPLVLKKLLLSRDETLQVASAHCITAVLVHSPAKHASAFIHADIPEFLFEHLSSSSEVLVWSSCNCLTLLVEEPLFFSKCHTVYGIEAVVRSLQGSLKMNNIELHKQGLLLFAEILTRQPEEIKLFTSSAMCRDAGRALQEAVSSPVLEVAAEALKATSAFLRKDHQSTPPVQYGELQALLEAMLNRCAEFSQTLLSRRPLGHASSRDSEKAILQRGKFLLSTLEGFRSACRLAIEFQSEPSAQENPFTAPSAKKEDTLEAFSEFLLSACDSLCIPMVMRHLEQTTHPALMEVFLSILHNLFVIVPHMKEKFSKKLASSSFIRLTLELKARFCSGLSHSALNQVCSNFLYYMCLNLLSAPEKTGPPSKEELSAVSELLQHGLPQISSRSPESLAFLSDRQYMEGAARQRQYCILLLFYLAYIHEDRFVSEAELFEAVQSFLLSLQDQGERPPLVVFKASIYLLAICQDKDNTLRETMVSAIRKFLEGIPDLQLVYTHHPLLLRFFLLYPELMSRYGHRVLELWFFWEESSYEELDDVTSAGQPALPASLVVLFQLLRSIPSILLILLDLIYSSPVDTAHKVLISLRTFLRRNEDIQVGGLIRGHFLLILQRLLVEHGASPSGASGNLPLLLSLLSLMQLRNVSEQELDSVAMKLLHQVSKLCGKCSPTDVDILQPSFNFLYWSLHQTTPSSQKRAAAVLLSSTGLMELLEKMLALTLAKADSPRTALLCSAWLLTASFSAQQHKGSLQVHQTLSVEMDQVLKALSFPKKKAALLSAAILCFLRTALRQSFSSALVALVPSGAQPLPATKDTVLAPLRMSQVRSLVIGLQNLLVQKDPLLSQACVGCLEALLDYLDARSPDIALHVASQPWNRFLLFTLLDAGENSFLRPEILRLMTLFMRYRSSSVLSHEEVGDVLQGVALADLSTLSNTTLQALHGFFQQLQSMGHLADHSMAQTLQASLEGLPPSTSSGQPPLQDMLCLGGVAVSLSHIRN

SEQ ID NO: 8515 - protein, 238 aa, Homo Sapiens
MLALTLAKADSPRTALLCSAWLLTASFSAQQHKGSLQVHQTLSVEMDQVLKALSFPKKKAALLSAAILCFLRTALRQSFSSALVALVPSGAQPLPATKDTVLAPLRMSQVRSLVIGLQNLLVQKDPLLSQACVGCLEALLDYLDARSPDIALHVASQPWNRFLLFTLLDAGENSFLRPEILRLMTLLQSMGHLADHSMAQTLQASLEGLPPSTSSGQPPLQDMLCLGGVAVSLSHIRN

SEQ ID NO: 8516 - protein, 506 aa, Homo Sapiens
MNQDGLGESAKNIEGSSGNTSLPLVLKKLLLSRDETLQVASAHCITAVLVHSPAKHASAFIHADIPEFLFEHLSSSSEVLVWSSCNCLTLLVEEPLFFSKCHTVYGIEAVVRSLQGSLKMNNIELHKQGLLLFAEILTRQPEEIKLFTSSAMCRDAGRALQEAVSSPVLEVAAEALKATSAFLRKDHQSTPPVQYGELQALLEAMLNRCAEFSQTLLSRRPLGHASSRDSEKAILQRGKFLLSTLEGFRSACRLAIEFQSEPSAQENPFTAPSAKKEDTLEAFSEFLLSACDSLCIPMVMRHLEQTTHPALMEVFLSILHNLFVIVPHMKEKFSKKLASSSFIRLTLELKARFCSGLSHSALNQVCSNFLYYMCLNLLSAPEKTGPPSKEELSAVSELLQHGLPQISSRSPESLAFLSDRQYMEGAARQRQYCILLLFYLAYIHEDRFVSEAELFEAVQSFLLSLQDQGERPPLVVFKASIYLLAICQDKDNTLREQLHCSLISIS

SEQ ID NO: 8517 - protein, 63 aa, Homo Sapiens
  misc_feature (1)..(1): Xaa can be any naturally occurring amino acid
XRSSSVLSHEELQSMGHLADHSMAQTLQASLEGLPPSTSSGQPPLQDMLCLGGVAVSLSHIRN

SEQ ID NO: 8518 - protein, 385 aa, Homo Sapiens
MDVQKWYLRTSKLALALAIIRSKPADKSSREYTEHLAMLLSEEQSKWRSKVEILEAEVMQLRQKLLVSRLCSGSFKSGYVSSQLEAQEPKSSESTLTSMEDSGCDLSNEQRTESSDLSQHFVESCTPTHFPPLPLVKRPCAILQNPLSSHMQFLQYLLELKNLTESGNLKRDLTHFEKDSSTVSDSVFQLLDGLITFYRNPKLPFSRFWTEAVGTLASLISDYNLSSHILKKCSKKLEEFEKTLLHAILGNNHINQFQVQHYVSQSLVTLGNCSLLRKSIISLLLSEVNGFADDLGAINQEQASYDVSRYENIFYLFWVLEQLLQKETEEGNTSSIGHDDQEIKKFLQKHDETIFQLSDAFPLFTFYLWRVGILLSSAQIETLRK

SEQ ID NO: 8519 - protein, 325 aa, Homo Sapiens
MAQGLRLQGSRRKGRHPLFPLLALIFEKCELATCTPREPGVAGGDVCSSESFNEDIAVFAKQIRAEKPLFSSNPELDNLMIQAIQVLRFHLLELEKVHELCDNFCHRYISCLKGKMPIDLVIDDREGGSKSDSEDITRSANLTDQPSWNRDHDDTASTRSGGTPGPSSGGHTSHSGDNSSEQGDGLDNSVASPSTGDDDDPDKDKKRHKKRGIFPKVATNIMRAWLFQHLTHPYPSEEQKKQLAQDTGLTILQVNNWFINARRRIVQPMIDQSNRAVSQGTPYNPDGQPMGGFVMDGQQHMGIRAPGPMSGMGMNMGMEGQWHYM

SEQ ID NO: 8520 - protein, 390 aa, Homo Sapiens
MAQRYDDLPHYGGMDGVGIPSTMYGDPHAARSMQPVHHLNHGPPLHSHQYPHTAHTNAMAPSMGSSVNDALKRDKDAIYGHPLFPLLALIFEKCELATCTPREPGVAGGDVCSSESFNEDIAVFAKQIRAEKPLFSSNPELDNLMIQAIQVLRFHLLELEKVHELCDNFCHRYISCLKGKMPIDLVIDDREGGSKSDSEDITRSANLTDQPSWNRDHDDTASTRSGGTPGPSSGGHTSHSGDNSSEQGDGLDNSVASPSTGDDDDPDKDKKRHKKRGIFPKVATNIMRAWLFQHLTHPYPSEEQKKQLAQDTGLTILQVNNWFINARRRIVQPMIDQSNRAVSQGTPYNPDGQPMGGFVMDGQQHMGIRAPGPMSGMGMNMGMEGQWHYM

SEQ ID NO: 8521 - protein, 370 aa, Homo Sapiens
MAQRYDDLPHYGGMDGVGIPSTMYGDPHAARSMQPVHHLNHGPPLHSHQYPHTAHTNAMAPSMGSSVNDALKRDKDAIYGHPLFPLLALIFEKCELATCTPREPGVAGGDVCSSESFNEDIAVFAKQIRAEKPLFSSNPELDNLMIQAIQVLRFHLLELEKVHELCDNFCHRYISCLKGKMPIDLVIDDREGGSKSDSEDITRSANLTDQPSWNRDHDDTASTRSGGTPGPSSGGHTSHSGDNSSEQGDGLDNSVASPSTGDDDDPDKDKKRHKKRGIFPKVATNIMRAWLFQHLTHPYPSEEQKKQLAQDTGLTILQVNNWFINARRRIVQPMIDQSNRAGKSPIVTVFKSRKRKPSSSHSPGGPLPGK

SEQ ID NO: 8522 - protein, 378 aa, Homo Sapiens
MAQRYDDLPHYGGMDGVGIPSTMYGDPHAARSMQPVHHLNHGPPLHSHQYPHTAHTNAMAPSMGSSVNDALKRDKDAIYGHPLFPLLALIFEKCELATCTPREPGVAGGDVCSSESFNEDIAVFAKQIRAEKPLFSSNPELDNLMIQAIQVLRFHLLELEKVHELCDNFCHRYISCLKGKMPIDLVIDDREGGSKSDSEDITRSANLTDQPSWNRDHDDTASTRSGGTPGPSSGGHTSHSGDNSSEQGDGLDNSVASPSTGDDDDPDKDKKRHKKRGIFPKVATNIMRAWLFQHLTHPYPSEEQKKQLAQDTGLTILQVNNWFINARRRIVQPMIDQSNRAVSQGTPYNPDGQPMGGFVMDGQQHMGIRAPGKTLFLW

SEQ ID NO: 8523 - protein, 463 aa, Homo Sapiens
MQYDDLPHYGGMDGVGIPSTMYGDPHAARSMQPVHHLNHGPPLHSHQYPHTAHTNAMAPSMGSSVNDALKRDKDAIYGHPLFPLLALIFEKCELATCTPREPGVAGGDVCSSESFNEDIAVFAKQIRAEKPLFSSNPELDNLMIQAIQVLRFHLLELEKVHELCDNFCHRYISCLKGKMPIDLVIDDREGGSKSDSEDITRSANLTDQPSWNRDHDDTASTRSGGTPGPSSGGHTSHSGDNSSEQGDGLDNSVASPSTGDDDDPDKDKKRHKKRGIFPKVATNIMRAWLFQHLTHPYPSEEQKKQLAQDTGLTILQVNNWFINARRRIVQPMIDQSNRAVSQGTPYNPDGQPMGGFVMDGQQHMGIRAPGLQSMPGEYVARGGPMGVSMGQPSYTQPQMPPHPAQLRHGPPMHTYIPGHPHHPTVMMHGGPPHPGMPMSASSPTVLNTGDPTMSGQVMDIHAQ

SEQ ID NO: 8524 - protein, 121 aa, Homo Sapiens
  misc_feature (1)..(1): Xaa can be any naturally occurring amino acid
XLCFESPEISRPVFPCLQMIQAIQVLRFHLLELEKVHELCDNFCHRYISCLKGKMPIDLVIDDREGGSKSDSEDITRSANLTDQPSWNRDHDDTASTRSGGTPGPSSGGHTSHSGDNSSEQ

SEQ ID NO: 8525 - protein, 126 aa, Homo Sapiens
FPKVATNIMRAWLFQHLSAGAGRHVIAPSLRLPWSPSWGAQRRSEAPVLPDVCLGLGSPSPGPRWARPWGSDCGRPGRQSDSCWWLQHPYPSEEQKKQLAQDTGLTILQVNNWFINARRRIVQPMI

SEQ ID NO: 8526 - protein, 404 aa, Homo Sapiens
MARRYDELPHYPGIVDGPAALASFPETVPAVPGPYGPHRPPQPLPPGLDSDGLKREKDEIYGHPLFPLLALVFEKCELATCSPRDGAGAGLGTPPGGDVCSSDSFNEDIAAFAKQVRSERPLFSSNPELDNLMIQAIQVLRFHLLELEKGKMPIDLVIEDRDGGCREDFEDYPASCPSLPDQNNMWIRDHEDSGSVHLGTPGPSSGGLASQSGDNSSDQGDGLDTSVASPSSGGEDEDLDQERRRNKKRGIFPKVATNIMRAWLFQHLSRRSEAPVLPDVCLGLGSPSPGPRWARPWGSDCGRPGRQSDSCWWLQHPYPSEEQKKQLAQDTGLTILQVNNWFINARRRIVQPMIDQSNRTGQGAAFSPEGQPIGGYTETQPHVAVRPPGSVGMSLNLEGEWHYL

SEQ ID NO: 8527 - protein, 358 aa, Homo Sapiens
MARRYDELPHYPGIVDGPAALASFPETVPAVPGPYGPHRPPQPLPPGLDSDGLKREKDEIYGHPLFPLLALVFEKCELATCSPRDGAGAGLGTPPGGDVCSSDSFNEDIAAFAKQVRSERPLFSSNPELDNLMIQAIQVLRFHLLELEKGKMPIDLVIEDRDGGCREDFEDYPASCPSLPDQNNMWIRDHEDSGSVHLGTPGPSSGGLASQSGDNSSDQGDGLDTSVASPSSGGEDEDLDQERRRNKKRGIFPKVATNIMRAWLFQHLSHPYPSEEQKKQLAQDTGLTILQVNNWFINARRRIVQPMIDQSNRTGQGAAFSPEGQPIGGYTETQPHVAVRPPGSVGMSLNLEGEWHYL

SEQ ID NO: 8528 - protein, 375 aa, Homo Sapiens
MARRYDELPHYPGIVDGPAALASFPETVPAVPGPYGPHRPPQPLPPGLDSDGLKREKDEIYGHPLFPLLALVFEKCELATCSPRDGAGAGLGTPPGGDVCSSDSFNEDIAAFAKQVRSERPLFSSNPELDNLMIQAIQVLRFHLLELEKVHDLCDNFCHRYITCLKGKMPIDLVIEDRDGGCREDFEDYPASCPSLPDQNNMWIRDHEDSGSVHLGTPGPSSGGLASQSGDNSSDQGDGLDTSVASPSSGGEDEDLDQERRRNKKRGIFPKVATNIMRAWLFQHLSHPYPSEEQKKQLAQDTGLTILQVNNWFINARRRIVQPMIDQSNRTGQGAAFSPEGQPIGGYTETQPHVAVRPPGSVGMSLNLEGEWHYL

SEQ ID NO: 8529 - protein, 421 aa, Homo Sapiens
MARRYDELPHYPGIVDGPAALASFPETVPAVPGPYGPHRPPQPLPPGLDSDGLKREKDEIYGHPLFPLLALVFEKCELATCSPRDGAGAGLGTPPGGDVCSSDSFNEDIAAFAKQVRSERPLFSSNPELDNLMIQAIQVLRFHLLELEKVHDLCDNFCHRYITCLKGKMPIDLVIEDRDGGCREDFEDYPASCPSLPDQNNMWIRDHEDSGSVHLGTPGPSSGGLASQSGDNSSDQGDGLDTSVASPSSGGEDEDLDQERRRNKKRGIFPKVATNIMRAWLFQHLSRRSEAPVLPDVCLGLGSPSPGPRWARPWGSDCGRPGRQSDSCWWLQHPYPSEEQKKQLAQDTGLTILQVNNWFINARRRIVQPMIDQSNRTGQGAAFSPEGQPIGGYTETQPHVAVRPPGSVGMSLNLEGEWHYL

SEQ ID NO: 8530 - protein, 421 aa, Homo Sapiens; identical to SEQ ID NO: 8529

SEQ ID NO: 8531 - protein, 221 aa, Homo Sapiens [sequence omitted]

SEQ ID NO: 8532 - protein, 463 aa, Homo Sapiens
MCTLCTTMRGSYRRCPWISLSVCLSLCLCHCLLTPLSPSLFPPSQTLPSLPLGPPAHMSGISAWTGSSLPTEAAPGDLEGFKLGGSDTWGPQYDELPHYPGIVDGPAALASFPETVPAVPGPYGPHRPPQPLPPGLDSDGLKREKDEIYGHPLFPLLALVFEKCELATCSPRDGAGAGLGTPPGGDVCSSDSFNEDIAAFAKQVRSERPLFSSNPELDNLMIQAIQVLRFHLLELEKVHDLCDNFCHRYITCLKGKMPIDLVIEDRDGGCREDFEDYPASCPSLPDQNNMWIRDHEDSGSVHLGTPGPSSGGLASQSGDNSSDQGDGLDTSVASPSSGGEDEDLDQERRRNKKRGIFPKVATNIMRAWLFQHLSHPYPSEEQKKQLAQDTGLTILQVNNWFINARRRIVQPMIDQSNRTGQGAAFSPEGQPIGGYTETQPHVAVRPPGSVGMSLNLEGEWHYL

SEQ ID NO: 8533 - protein, 250 aa, Homo Sapiens
PPPSLSTPALPPWVAPPSTPVPPQVHDLCDNFCHRYITCLKGKMPIDLVIEDRDGGCREDFEDYPASCPSLPDQNNMWIRDHEDSGSVHLGTPGPSSGGLASQSGDNSSDQGDGLDTSVASPSSGGEDEDLDQERRRNKKRGIFPKVATNIMRAWLFQHLSHPYPSEEQKKQLAQDTGLTILQVNNWFINARRRIVQPMIDQSNRTGQGAAFSPEGQPIGGYTETQPHVAVRPPGSVGMSLNLEGEWHYL

SEQ ID NO: 8534 - protein, 178 aa, Homo Sapiens
  misc_feature (1)..(1): Xaa can be any naturally occurring amino acid
XGLSLPSQVRSERPLFSSNPELDNLGKMPIDLVIEDRDGGCREDFEDYPASCPSLPDQNNMWIRDHEDSGSVHLGTPGPSSGGLASQSGDNSSDQGDGLDTSVASPSSGGEDEDLDQERRRNKKRGIFPKVATNIMRAWLFQHLSRRSEAPVLPDVCLGLGSPSPGPRWARPWGSDCG

SEQ ID NO: 8535 - protein, 302 aa, Homo Sapiens
MRGPSGALWLLLALRTVLGGMEVRWCATSDPEQHKCGNMSEAFREAGIQPSLLCVRGTSADHCVQLIAAQEADAITLDGGAIYEAGKEHGLKPVVGEVYDQEVGTSYYAVAVVRRSSHVTIDTLKGVKSCHTGINRTVGWNVPVGYLVESGRLSVMGCDVLKAVSDYFGGSCVPGAGETSYSESLCRLCRGDSSGEGVCDKSPLERYYDYSGAFRCLAEGAGDVAFVKHSTVLENTDESPSRRQTWTRSEEEEGECPAHEEARRTMRSSAGQAWKWAPVHRPQDESDKGEFGKRAKSRDMLG

SEQ ID NO: 8536 - protein, 738 aa, Homo Sapiens
MRGPSGALWLLLALRTVLGGMEVRWCATSDPEQHKCGNMSEAFREAGIQPSLLCVRGTSADHCVQLIAAQEADAITLDGGAIYEAGKEHGLKPVVGEVYDQEVGTSYYAVAVVRRSSHVTIDTLKGVKSCHTGINRTVGWNVPVGYLVESGRLSVMGCDVLKAVSDYFGGSCVPGAGETSYSESLCRLCRGDSSGEGVCDKSPLERYYDYSGAFRCLAEGAGDVAFVKHSTVLENTDGKTLPSWGQALLSQDFELLCRDGSRADVTEWRQCHLARVPAHAVVVRADTDGGLIFRLLNEGQRLFSHEGSSFQMFSSEAYGQKDLLFKDSTSELVPIATQTYEAWLGHEYLHAMKGLLCDPNRLPPYLRWCVLSTPEIQKCGDMAVAFRRQRLKPEIQCVSAKSPQHCMERIQAEQVDAVTLSGEDIYTAGKTYGLVPAAGEHYAPEDSSNSYYVVAVVRRDSSHAFTLDELRGKRSCHAGFGSPAGWDVPVGALIQRGFIRPKDCDVLTAVSEFFNASCVPVNNPKNYPSSLCALCVGDEQGRNKCVGNSQERYYGYRGAFRCLVENAGDVAFVRHTTVFDNTNGHNSEPWAAELRSEDYELLCPNGARAEVSQFAACNLAQIPPHAVMVRPDTNIFTVYGLLDKAQDLFGDDHNKNGFKMFDSSNYHGQDLLFKDATVRAVPVGEKTTYRGWLGLDYVAALEGMSSQQCSGAAAPAPGAPLLPLLLPALAARLLPPAL

SEQ ID NO: 8537 - protein, 181 aa, Homo Sapiens
MRGPSGALWLLLALRTVLGGMEVRWCATSDPEQHKCGNMSEAFREAGIQPSLLCVRGTSADHCVQLIAAQEADAITLDGGAIYEAGKEHGLKPVVGEVYDQEVGTSYYAVAVVRRSSHVTIDTLKGVKSCHTGINRTVGWNVPVGYLVESGRLSVMGCDVLKGPKRGADLHPESSQVAHQP

SEQ ID NO: 8538 - protein, 96 aa, Homo Sapiens
MRVFCVGLLLFSVTWAAPTFQPQTEKTKQSCVEEQRAPQASLLQNSGSQNLPDPHPMPRPTSRSASGPVAAGVILMDLSRKKKTKTILVFTIWARE

SEQ ID NO: 8539 - protein, 556 aa, Homo Sapiens
MRVFCVGLLLFSVTWAAPTFQPQTEKTKQSCVEEQRITYKGHYEKHGHYVFKCVYMSPEKKNQTDVKQEEKNKDNIGFHHLGKRINQELSSKENIVQERKKDLSLSEASENKGSSKSQNYFTNRQRLNKEYSISNKENTHNGLRMSIYPKSTGNKGFEDGDDAISKLHDQEEYGAALIRNNMQHIMGPVTAIKLLGEENKENTPRNVLNIIPASMNYAKAHSKDKKKPQRDSQAQKSPVKSKSTHRIQHNIDYLKHLSKVKKIPSDFEGSGYTDLQERGDNDISPFSGDGQPFKDIPGKGEATGPDLEGKDIQTGFAGPSEAESTHLDTKKPGYNEIPEREENGGNTIGTRDETAKEADAVDVSLVEGSNDIMGSTNFKELPGREGNRVDAGSQNAHQGKVEFHYPPAPSKEKRKEGSSDAAESTNYNEIPKNGKGSTRKGVDHSNRNQATLNEKQRFPSKGKSQGLPIPSRGLDNEIKNEMDSFNGPSHENIITHGRKYHYVPHRQNNSTRNKGMPQGKGSWGRQPHSNRRFSSRRRDDSSESSDSGSSSESDGD

SEQ ID NO: 8540 - protein, 525 aa, Homo Sapiens
MRVFCVGLLLFSVTWAAPTFQPQTEKTKQSCVEEQRQEEKNKDNIGFHHLGKRINQELSSKENIVQERKKDLSLSEASENKGSSKSQNYFTNRQRLNKEYSISNKENTHNGLRMSIYPKSTGNKGFEDGDDAISKLHDQEEYGAALIRNNMQHIMGPVTAIKLLGEENKENTPRNVLNIIPASMNYAKAHSKDKKKPQRDSQAQKSPVKSKSTHRIQHNIDYLKHLSKVKKIPSDFEGSGYTDLQERGDNDISPFSGDGQPFKDIPGKGEATGPDLEGKDIQTGFAGPSEAESTHLDTKKPGYNEIPEREENGGNTIGTRDETAKEADAVDVSLVEGSNDIMGSTNFKELPGREGNRVDAGSQNAHQGKVEFHYPPAPSKEKRKEGSSDAAESTNYNEIPKNGKGSTRKGVDHSNRNQATLNEKQRFPSKGKSQGLPIPSRGLDNEIKNEMDSFNGPSHENIITHGRKYHYVPHRQNNSTRNKGMPQGKGSWGRQPHSNRRFSSRRRDDSSESSDSGSSSESDGD

SEQ ID NO: 8541 - protein, 525 aa, Homo Sapiens; identical to SEQ ID NO: 8540

SEQ ID NO: 8542 - protein, 412 aa, Homo Sapiens
MSIYPKSTGNKGFEDGDDAISKLHDQEEYGAALIRNNMQHIMGPVTAIKLLGEENKENTPRNVLNIIPASMNYAKAHSKDKKKPQRDSQAQKSPVKSKSTHRIQHNIDYLKHLSKVKKIPSDFEGSGYTDLQERGDNDISPFSGDGQPFKDIPGKGEATGPDLEGKDIQTGFAGPSEAESTHLDTKKPGYNEIPEREENGGNTIGTRDETAKEADAVDVSLVEGSNDIMGSTNFKELPGREGNRVDAGSQNAHQGKVEFHYPPAPSKEKRKEGSSDAAESTNYNEIPKNGKGSTRKGVDHSNRNQATLNEKQRFPSKGKSQGLPIPSRGLDNEIKNEMDSFNGPSHENIITHGRKYHYVPHRQNNSTRNKGMPQGKGSWGRQPHSNRRFSSRRRDDSSESSDSGSSSESDGD

SEQ ID NO: 8543 - protein, 412 aa, Homo Sapiens; identical to SEQ ID NO: 8542

SEQ ID NO: 8544 - protein, 501 aa, Homo Sapiens
MSPEKKNQTDVKQEEKNKDNIGFHHLGKRINQELSSKENIVQERKKDLSLSEASENKGSSKSQNYFTNRQRLNKEYSISNKENTHNGLRMSIYPKSTGNKGFEDGDDAISKLHDQEEYGAALIRNNMQHIMGPVTAIKLLGEENKENTPRNVLNIIPASMNYAKAHSKDKKKPQRDSQAQKSPVKSKSTHRIQHNIDYLKHLSKVKKIPSDFEGSGYTDLQERGDNDISPFSGDGQPFKDIPGKGEATGPDLEGKDIQTGFAGPSEAESTHLDTKKPGYNEIPEREENGGNTIGTRDETAKEADAVDVSLVEGSNDIMGSTNFKELPGREGNRVDAGSQNAHQGKVEFHYPPAPSKEKRKEGSSDAAESTNYNEIPKNGKGSTRKGVDHSNRNQATLNEKQRFPSKGKSQGLPIPSRGLDNEIKNEMDSFNGPSHENIITHGRKYHYVPHRQNNSTRNKGMPQGKGSWGRQPHSNRRFSSRRRDDSSESSDSGSSSESDGD

SEQ ID NO: 8545 - protein, 80 aa, Homo Sapiens
MAASRWARKAVVLLCASDLLLLLLLLPPPGSCAAEGSPGTPDESTPPPRKKKKDIRDYNDADMARLLEQWEANTCPTSTH

SEQ ID NO: 8546 - protein, 234 aa, Homo Sapiens
MAASRWARKAVVLLCASDLLLLLLLLPPPGSCAAEGSPGTPDESTPPPRKKKKDIRDYNDADMARLLEQWEKDDDIEEGDLPEHKRPSAPVDFSKIDPSKPESILKMTKKGKTLMMFVTVSGSPTEKETEEITSLWQGSLFNANYDVQRFIVGSDRAIFMLRDGSYAWEIKDFLVGQDRCADVTLEGQVYPGKGGGSKEKNKTKQDKGKKKKEGDLKSRSSKEENRAGNKREDL

SEQ ID NO: 8547 - protein, 234 aa, Homo Sapiens; identical to SEQ ID NO: 8546

SEQ ID NO: 8548 - protein, 234 aa, Homo Sapiens; identical to SEQ ID NO: 8546

SEQ ID NO: 8549 - protein, 138 aa, Homo Sapiens
MAASRWARKAVVLLCASDLLLLLLLLPPPGSCAAEGSPGTPDESTPPPRKKKKDIRDYNDADMARLLEQWETPEPLPVLPEVPSTCACLSSASLIWTCFSHLSPHALVKRVWPPAKQGLGGKESPASAWLPHRGGELK

SEQ ID NO: 8550 - protein, 173 aa, Homo Sapiens
LLSHDYGDIVAQELLYRYKQNRSGRLTIKSLCLSNGGIFPETHRPLLLQKLLKDGGVLSPILTRLMNFFLWDMWAGIRNNDGNLVIDSLLQYINQRKKFRRRWVGALASVTIPIHFIYGPLDPVNPYPEFLELYRKTLPRSTVSILDDHISHYPQLEDPMGFLNAYMGFINSF

SEQ ID NO: 8551 - protein, 118 aa, Homo Sapiens
MREWWVQVGLLAVPLLAAYLHIPPPQLSPALHSWKSSGKFFTYKGLRIFYQDSVGVVGSPEIVVLLHGFPTSSYDWYKIWEGLTLRFHRVIALDFLGFGFSDKPRPHHYSIFEQASIV

SEQ ID NO: 8552 - protein, 160 aa, Homo Sapiens
MREWWVQVGLLAVPLLAAYLHIPPPQLSPALHSWKSSGKFFTYKGLRIFYQDSVGVVGSPEIVVLLHGFPTSSYDWYKIWEGLTLRFHRVIALDFLGFGFSDKPRPHHYSIFEQASIVEALLRHLGLQNRRINLLSHDYGDIVAQELLYRYKQNRSGRLT

SEQ ID NO: 8553 - protein, 169 aa, Homo Sapiens
MREWWVQVGLLAVPLLAAYLHIPPPQLSPALHSWKSSGKFFTYKGLRIFYQDSVGVVGSPEIVVLLHGFPTSSYDWYKIWEGLTLRFHRVIALDFLGFGFSDKPRPHHYSIFEQASIVEALLRHLGLQNRRINLLSHDYGDIVAQELLYRYKQNRSGRLTIKSLCLSNG

SEQ ID NO: 8554 - protein, 188 aa, Homo Sapiens
MREWWVQVGLLAVPLLAAYLHIPPPQLSPALHSWKSSGKFFTYKGLRIFYQDSVGVVGSPEIVVLLHGFPTSSYDWYKIWEGLTLRFHRVIALDFLGFGFSDKPRPHHYSIFEQASIVEALLRHLGLQNRRINLLSHDYGDIVAQELLYRYKQNRSGRLTIKSLCLSNGGIFPETHRPLLLQKLLKDG

SEQ ID NO: 8555 - protein, 292 aa, Homo Sapiens
MREWWVQVGLLAVPLLAAYLHIPPPQLSPALHSWKSSGKFFTYKGLRIFYQDSVGVVGSPEIVVLLHGFPTSSYDWYKIWEGLTLRFHRVIALDFLGFGFSDKPRPHHYSIFEQASIVEALLRHLGLQNRRINLLSHDYGDIVAQELLYRYKQNRSGRLTIKSLCLSNGGIFPETHRPLLLQKLLKDGGVLSPILTRLMNFFVFSRGLLQYINQRKKFRRRWVGALASVTIPIHFIYGPLDPVNPYPEFLELYRKTLPRSTVSILDDHISHYPQLEDPMGFLNAYMGFINSF

SEQ ID NO: 8556 - protein, 292 aa, Homo Sapiens; identical to SEQ ID NO: 8555

SEQ ID NO: 8557 - protein, 292 aa, Homo Sapiens; identical to SEQ ID NO: 8555

SEQ ID NO: 8558 - protein, 213 aa, Homo Sapiens
MREWWVQVGLLAVPLLAAYLHIPPPQLSPALHSWKSSGKFFTYKGLRIFYQDSVGVVGSPEIVVLLHGFPTSSYDWYKIWEGLTLRFHRVIALDFLGFGFSDKPRPHHYSIFEQASIVEALLRHLGLQNRRINLLSHDYGDIVAQELLYRYKQNRSGRLTIKSLCLSNGGIFPETHRPLLLQKLLKDGGVLSPILTRLMNFFVFSRGLTPVFG

SEQ ID NO: 8559 - protein, 326 aa, Homo Sapiens
MREWWVQVGLLAVPLLAAYLHIPPPQLSPALHSWKSSGKFFTYKGLRIFYQDSVGVVGSPEIVVLLHGFPTSSYDWYKIWEGLTLRFHRVIALDFLGFGFSDKPRPHHYSIFEQASIVEALLRHLGLQNRRINLLSHDYGDIVAQELLYRYKQNRSGRLTIKSLCLSNGGIFPETHRPLLLQKLLKDGGVLSPILTRLMNFFVFSRGLTPVFGPYTRPSESELWDMWAGIRNNDGNLVIDSLLQYINQRKKFRRRWVGALASVTIPIHFIYGPLDPVNPYPEFLELYRKTLPRSTVSILDDHISHYPQLEDPMGFLNAYMGFINSF

SEQ ID NO: 8560 - protein, 326 aa, Homo Sapiens; identical to SEQ ID NO: 8559

SEQ ID NO: 8561 - protein, 326 aa, Homo Sapiens; identical to SEQ ID NO: 8559

SEQ ID NO: 8562 - protein, 325 aa, Homo Sapiens
MVRRDRLRRMREWWVQVGLLAVPLLAAYLHIPPPQLSPALHSWKSSGKFFTYKGLRIFYQDSVGVVGSPEIVVLLHGFPTSSYDWYKIWEGLTLRFHRVIALDFLGFGFSDKPASIVEALLRHLGLQNRRINLLSHDYGDIVAQELLYRYKQNRSGRLTIKSLCLSNGGIFPETHRPLLLQKLLKDGGVLSPILTRLMNFFVFSRGLTPVFGPYTRPSESELWDMWAGIRNNDGNLVIDSLLQYINQRKKFRRRWVGALASVTIPIHFIYGPLDPVNPYPEFLELYRKTLPRSTVSILDDHISHYPQLEDPMGFLNAYMGFINSF

SEQ ID NO: 8563 - protein, 335 aa, Homo Sapiens
MVRRDRLRRMREWWVQVGLLAVPLLAAYLHIPPPQLSPALHSWKSSGKFFTYKGLRIFYQDSVGVVGSPEIVVLLHGFPTSSYDWYKIWEGLTLRFHRVIALDFLGFGFSDKPRPHHYSIFEQASIVEALLRHLGLQNRRINLLSHDYGDIVAQELLYRYKQNRSGRLTIKSLCLSNGGIFPETHRPLLLQKLLKDGGVLSPILTRLMNFFVFSRGLTPVFGPYTRPSESELWDMWAGIRNNDGNLVIDSLLQYINQRKKFRRRWVGALASVTIPIHFIYGPLDPVNPYPEFLELYRKTLPRSTVSILDDHISHYPQLEDPMGFLNAYMGFINSF

SEQ ID NO: 8564 - protein, 158 aa, Homo Sapiens
AVKGEVLKVGNKSCENIHLHSEAVLCTVPNDLLKLNSELNIEWKQAISSTVLGKVIVQPDQNFTGLIAGVVSISTALLLLLGFFLWLKKRKQIKDQFPNSSQNGSCRQVQYPLTDMSPILTSGDSDISSPLLQNTVHIDLSALNPELVQAVQHVVIGP

SEQ ID NO: 8565 - protein, 214 aa, Homo Sapiens
AVKLKIDLANRETSIFSYREDPIVYEIHPTKSFISGGSTITGVGKNLNSVSVPRMVINVHEAGRNFTVACQHRSNSEIICCTTPSLQQLNLQLPLKTKAFFMLDGILSKYFDLIYVHNPVFKPFEKPVMISMGNENVLEIKGNDIDPEAVKGEVLKVGNKSCENIHLHSEAVLCTVPNDLLKLNSELNIEVGFLHSSHDVNKEASVIMLFSGLK

SEQ ID NO: 8566 - protein, 1408 aa, Homo Sapiens
MKAPAVLAPGILVLLFTLVQRSNGECKEALAKSEMNVNMKYQLPNFTAETPIQNVILHEHHIFLGATNYIYVLNEEDLQKVAEYKTGPVLEHPDCFPCQDCSSKANLSGGVWKDNINMALVVDTYYDDQLISCGSVNRGTCQRHVFPHNHTADIQSEVHCIFSPQIEEPSQCPDCVVSALGAKVLSSVKDRFINFFVGNTINSSYFPDHPLHSISVRRLKETKDGFMFLTDQSYIDVLPEFRDSYPIKYVHAFESNNFIYFLTVQRETLDAQTFHTRIIRFCSINSGLHSYMEMPLECILTEKRKKRSTKKEVFNILQAAYVSKPGAQLARQIGASLNDDILFGVFAQSKPDSAEPMDRSAMCAFPIKYVNDFFNKIVNKNNVRCLQHFYGPNHEHCFNRTLLRNSSGCEARRDEYRTEFTTALQRVDLFMGQFSEVLLTSISTFIKGDLTIANLGTSEGRFMQVVVSRSGPSTPHVNFLLDSHPVSPEVIVEHTLNQNGYTLVITGKKITKIPLNGLGCRHFQSCSQCLSAPPFVQCGWCHDKCVRSEECLSGTWTQQICLPAIYKVFPNSAPLEGGTRLTICGWDFGFRRNNKFDLKKTRVLLGNESCTLTLSESTMNTLKCTVGPAMNKHFNMSIIISNGHGTTQYSTFSYVDPVITSISPKYGPMAGGTLLTLTGNYLNSGNSRHISIGGKTCTLKSVSNSILECYTPAQTISTEFAVKLKIDLANRETSIFSYREDPIVYEIHPTKSFISTWWKEPLNIVSFLFCFASGGSTITGVGKNLNSVSVPRMVINVHEAGRNFTVACQHRSNSEIICCTTPSLQQLNLQLPLKTKAFFMLDGILSKYFDLIYVHNPVFKPFEKPVMISMGNENVLEIKGNDIDPEAVKGEVLKVGNKSCENIHLHSEAVLCTVPNDLLKLNSELNIEWKQAISSTVLGKVIVQPDQNFTGLIAGVVSISTALLLLLGFFLWLKKRKQIKDLGSELVRYDARVHTPHLDRLVSARSVSPTTEMVSNESVDYRATFPEDQFPNSSQNGSCRQVQYPLTDMSPILTSGDSDISSPLLQNTVHIDLSALNPELVQAVQHVVIGPSSLIVHFNEVIGRGHFGCVYHGTLLDNDGKKIHCAVKSLNRITDIGEVSQFLTEGIIMKDFSHPNVLSLLGICLRSEGSPLVVLPYMKHGDLRNFIRNETHNPTVKDLIGFGLQVAKGMKYLASKKFVHRDLAARNCMLDEKFTVKVADFGLARDMYDKEYYSVHNKTGAKLPVKWMALESLQTQKFTTKSDVWSFGVLLWELMTRGAPPYPDVNTFDITVYLLQGRRLLQPEYCPDPLYEVMLKCWHPKAEMRPSFSELVSRISAIFSTFIGEHYVHVNATYVNVKCVAPYPSLLSSEDNADDEVDTRPASFWETS

SEQ ID NO: 8567 - protein, 1390 aa, Homo Sapiens
MKAPAVLAPGILVLLFTLVQRSNGECKEALAKSEMNVNMKYQLPNFTAETPIQNVILHEHHIFLGATNYIYVLNEEDLQKVAEYKTGPVLEHPDCFPCQDCSSKANLSGGVWKDNINMALVVDTYYDDQLISCGSVNRGTCQRHVFPHNHTADIQSEVHCIFSPQIEEPSQCPDCVVSALGAKVLSSVKDRFINFFVGNTINSSYFPDHPLHSISVRRLKETKDGFMFLTDQSYIDVLPEFRDSYPIKYVHAFESNNFIYFLTVQRETLDAQTFHTRIIRFCSINSGLHSYMEMPLECILTEKRKKRSTKKEVFNILQAAYVSKPGAQLARQIGASLNDDILFGVFAQSKPDSAEPMDRSAMCAFPIKYVNDFFNKIVNKNNVRCLQHFYGPNHEHCFNRTLLRNSSGCEARRDEYRTEFTTALQRVDLFMGQFSEVLLTSISTFIKGDLTIANLGTSEGRFMQVVVSRSGPSTPHVNFLLDSHPVSPEVIVEHTLNQNGYTLVITGKKITKIPLNGLGCRHFQSCSQCLSAPPFVQCGWCHDKCVRSEECLSGTWTQQICLPAIYKVFPNSAPLEGGTRLTICGWDFGFRRNNKFDLKKTRVLLGNESCTLTLSESTMNTLKCTVGPAMNKHFNMSIIISNGHGTTQYSTFSYVDPVITSISPKYGPMAGGTLLTLTGNYLNSGNSRHISIGGKTCTLKSVSNSILECYTPAQTISTEFAVKLKIDLANRETSIFSYREDPIVYEIHPTKSFISGGSTITGVGKNLNSVSVPRMVINVHEAGRNFTVACQHRSNSEIICCTTPSLQQLNLQLPLKTKAFFMLDGILSKYFDLIYVHNPVFKPFEKPVMISMGNENVLEIKGNDIDPEAVKGEVLKVGNKSCENIHLHSEAVLCTVPNDLLKLNSELNIEWKQAISSTVLGKVIVQPDQNFTGLIAGVVSISTALLLLLGFFLWLKKRKQIKDLGSELVRYDARVHTPHLDRLVSARSVSPTTEMVSNESVDYRATFPEDQFPNSSQNGSCRQVQYPLTDMSPILTSGDSDISSPLLQNTVHIDLSALNPELVQAVQHVVIGPSSLIVHFNEVIGRGHFGCVYHGTLLDNDGKKIHCAVKSLNRITDIGEVSQFLTEGIIMKDFSHPNVLSLLGICLRSEGSPLVVLPYMKHGDLRNFIRNETHNPTVKDLIGFGLQVAKGMKYLASKKFVHRDLAARNCMLDEKFTVKVADFGLARDMYDKEYYSVHNKTGAKLPVKWMALESLQTQKFTTKSDVWSFGVLLWELMTRGAPPYPDVNTFDITVYLLQGRRLLQPEYCPDPLYEVMLKCWHPKAEMRPSFSELVSRISAIFSTFIGEHYVHVNATYVNVKCVAPYPSLLSSEDNADDEVDTRPASFWETS

SEQ ID NO: 8568 - protein, 764 aa, Homo Sapiens
MKAPAVLAPGILVLLFTLVQRSNGECKEALAKSEMNVNMKYQLPNFTAETPIQNVILHEHHIFLGATNYIYVLNEEDLQKVAEYKTGPVLEHPDCFPCQDCSSKANLSGGVWKDNINMALVVDTYYDDQLISCGSVNRGTCQRHVFPHNHTADIQSEVHCIFSPQIEEPSQCPDCVVSALGAKVLSSVKDRFINFFVGNTINSSYFPDHPLHSISVRRLKETKDGFMFLTDQSYIDVLPEFRDSYPIKYVHAFESNNFIYFLTVQRETLDAQTFHTRIIRFCSINSGLHSYMEMPLECILTEKRKKRSTKKEVFNILQAAYVSKPGAQLARQIGASLNDDILFGVFAQSKPDSAEPMDRSAMCAFPIKYVNDFFNKIVNKNNVRCLQHFYGPNHEHCFNRTLLRNSSGCEARRDEYRTEFTTALQRVDLFMGQFSEVLLTSISTFIKGDLTIANLGTSEGRFMQVVVSRSGPSTPHVNFLLDSHPVSPEVIVEHTLNQNGYTLVITGKKITKIPLNGLGCRHFQSCSQCLSAPPFVQCGWCHDKCVRSEECLSGTWTQQICLPAIYKVFPNSAPLEGGTRLTICGWDFGFRRNNKFDLKKTRVLLGNESCTLTLSESTMNTLKCTVGPAMNKHFNMSIIISNGHGTTQYSTFSYVDPVITSISPKYGPMAGGTLLTLTGNYLNSGNSRHISIGGKTCTLKSVSNSILECYTPAQTISTEFAVKLKIDLANRETSIFSYREDPIVYEIHPTKSFIRHVNIALIQR

SEQ ID NO: 8569 - protein, 190 aa, Homo Sapiens
MKSKSKSLAECFPYDKPLIMKAPAVLAPGILVLLFTLVQRSNGECKEALAKSEMNVNMKYQLPNFTAETPIQNVILHEHHIFLGATNYIYVLNEEDLQKVAEYKTGPVLEHPDCFPCQDCSSKANLSGGVWKDNINMALVVDTYYDDQLISCGSVNRGTCQRHVFPHNHTADIQSEVHCIFSPQIEEPSQ

SEQ ID NO: 8570 - protein, 187 aa, Homo Sapiens
LAPAARAGYSEERCSWRGSGLTQEPGSVGQLALACAEGAVEWLYPAGALRLTLGGPDPRARPGIACLRPVRPFAGAQVFAERAGGALELLLAEGPGPAGGRCVRWGPRERRALFLQATPHQDISRRVAAFRFELREDGRPELPPQAHGLGVDGACRPCSDAELLLAACTSDFGECPRHGGSLEPAFP

SEQ ID NO: 8571 - protein, 69 aa, Homo Sapiens
MGFPAAALLCALCCGLLAPAARAGYSEERCSWRGRPRRTRTSAAAWPPSALSCARTGAPSCPRRPTVSA

SEQ ID NO: 8572 - protein, 293 aa, Homo Sapiens
MGFPAAALLCALCCGLLAPAARAGYSEERCSWRGSGLTQEPGSVGQLALACAEGAVEWLYPAGALRLTLGGPDPRARPGIACLRPVRPFAGAQVFAERAGGALELLLAEGPGPAGGRCVRWGPRERRALFLQATPHQDISRRVAAFRFELREDGRPELPPQAHGLGVDGACRPCSDAELLLAACTSDFVIHGIIHGVTHDVELQESVITVVAARVLRQTPPLFQAGRSGDQGLTSIRTPLRCGVHPGPGTFLFMGWSRFGEARLGCAPRFQEFRRAYEAARAAHLHPCEVALH

SEQ ID NO: 8573 - protein, 160 aa, Homo Sapiens
MLGCICQMGVQEGGPGQLIARHGPQAHVCVHSCLGGACRPCSDAELLLAACTSDFVIHGIIHGVTHDVELQESVITVVAARVLRQTPPLFQAGRSGDQGLTSIRTPLRCGVHPGPGTFLFMGWSRFGEARLGCAPRFQEFRRAYEAARAAHLHPCEVALH

SEQ ID NO: 8574 - protein, 175 aa, Homo Sapiens
  misc_feature (1)..(1): Xaa can be any naturally occurring amino acid
XAVEWLYPAGALRLTLGGPDPRARPGIACLRPVRPFAGAQVFAERAGGALELLLAEGPGPAGGRCVRWGPRERRALFLQATPHQDISRRVAAFRFELREDGRPELPPQAHGLGVDGACRPCSDAELLLAACTSDFVIHGIIHGVTHDVELQESVITVGGPTALEVMGLSIRTLFT

SEQ ID NO: 8575 - protein, 311 aa, Homo Sapiens
MRGAARAAWGRAGQPWPRPPAPGPPPPPLPLLLLLLAGLLGGAGAQYSSDRCSWKGSGLTHEAHRKEVEQVYLRCAAGAVEWMYPTGALIVNLRPNTFSPARHLTVCIRSFTDSSGANIYLEKTGELRLLVPDGDGRPGRVQCFGLEQGGLFVEATPQQDIGRRTTGFQYELVRRHRASDLHELSAPCRPCSDTEVLLAVCTSDFAVRGSIQQVTHEPERQDSAIHLRVSRLYRQKSRVFEPVPEGDGHWQGRVRTLLECGVRPGHGDFLFTGHMHFGEARLGCAPRFKDFQRMYRDAQERGLNPCEVGTD

SEQ ID NO: 8576 - protein, 229 aa, Homo Sapiens
MYPTGALIVNLRPNTFSPARHLTVCIRSFTDSSGANIYLEKTGELRLLVPDGDGRPGRVQCFGLEQGGLFVEATPQQDIGRRTTGFQYELVRRHRASDLHELSAPCRPCSDTEVLLAVCTSDFAVRGSIQQVTHEPERQDSAIHLRVSRLYRQKSRVFEPVPEGDGHWQGRVRTLLECGVRPGHGDFLFTGHMHFGEARLGCAPRFKDFQRMYRDAQERGLNPCEVGTD

SEQ ID NO: 8577 - protein, 229 aa, Homo Sapiens; identical to SEQ ID NO: 8576

SEQ ID NO: 8578 - protein, 90 aa, Homo Sapiens
RTAVRGSIQQVTHEPERQDSAIHLRVSRLYRQKSRVFEPVPEGDGHWQGRVRTLLECGARLGCAPRFKDFQRMYRDAQERGLNPCEVGTD

SEQ ID NO: 8579 - protein, 456 aa, Homo Sapiens
MAAALKCLLTLGRWCPGLGVAPQARALAALVPGVTQVDNKSGFLQKRPHRQHPGILKLPHVRLPQALANGAQLLLLGSAGPTMENQVQTLTSYLWSRHLPVEPEELQRRARHLEKKFLENPDLSQTEEKLRGAVLHALRKTTYHWQELSYTEGLSLVYMAARLDGGFAAVSRAFHEIRARNPAFQPQTLMDFGSGTGSVTWAAHSIWGQSLREYMCVDRSAAMLVLAEKLLKGGSESGEPYIPGVFFRQFLPVSPKVQFDVVVSAFSLSELPSKADRTEVVQTLWRKTGHFLVLVENGTKAGHSLLMDARDLVLKGKEKSPLDPRPGFVFAPCPHELPCPQLTNLACSFSQAYHPIPFSWNKKPKEEKFSMVILARGSPEEAHRWPRITQPVLKRPRHVHCHLCCPDGHMQHAVLTARRHGRDLYRCARVSSWGDLLPVLTPSAFPPSTAQDPSES

SEQ ID NO: 8580 - protein, 478 aa, Homo Sapiens
MAAALKCLLTLGRWCPGLGVAPQARALAALVPGVTQVDNKSGFLQKRPHRQHPGILKLPHVRLPQALANGAQLLLLGSAGPTMENQVQTLTSYLWSRHLPVEPEELQRRARHLEKKFLENPDLSQTEEKLRGAVLHALRKTTYHWQELSYTEGLSLVYMAARLDGGFAAVSRAFHEIRARNPAFQPQTLMDFGSGTGSVTWAAHSIWGQSLREYMCVDRSAAMLVLAEKLLKGGSESGEPYIPGVFFRQFLPVSPKVQFDVVVSAFSLSELPSKADRTEVVQTLWRKTGHFLVLVENGTKAGHSLLMDARDLVLKGKEKSPLDPRPGFVFAPCPHELPCPQLTNLACSFSQAYHPIPFSWNKKPKEEKFSMVILARGSPEEAHRWPRITQPVLKRPRHVHCHLCCPDGHMQHAVLTARRHGRYGGCDQNQWDVAGSCSPRQHLFPQGFVSLCPCQLLGRSFTCAYSVCVSSIYGSGSL

SEQ ID NO: 8581 - protein, 447 aa, Homo Sapiens
MAAALKCLLTLGRWCPGLGVAPQARALAALVPGVTQVDNKSGFLQKRPHRQHPGILKLPHVRLPQALANGAQLLLLGSAGPTMENQVQTLTSYLWSRHLPVEPEELQRRARHLEKKFLENPDLSQTEEKLRGAVLHALRKTTYHWQELSYTEGLSLVYMAARLDGGFAAVSRAFHEIRARNPAFQPQTLMDFGSGTGSVTWAAHSIWGQSLREYMCVDRSAAMLVLAEKLLKGGSESGEPYIPGVFFRQFLPVSPKVQFDVVVSAFSLSELPSKADRTEVVQTLWRKTGHFLVLVENGTKAGHSLLMDARDLVLKGKEKSPLDPRPGFVFAPCPHELPCPQLTNLACSFSQAYHPIPFSWNKKPKEEKFSMVILARGSPEEAHRWPRITQPVLKRPRHVHCHLCCPDGHMQHAVLTARRHGSSWGDLLPVLTPSAFPPSTAQDPSES

SEQ ID NO: 8582 - protein, 158 aa, Homo Sapiens
MAAALKCLLTLGRWCPGLGVAPQARALAALVPGVTQVDNKSGFLQKRPHRQHPGILKLPHVRLPQALANGAQLLLLGSAGPTMENQVQTLTSYLWSRHLPVEPEELQRRARHLEKKFLENPGPDFQSLFSPQTYLRQRRNFVEQCYTHYVKLPTIGKN

SEQ ID NO: 8583 - protein, 158 aa, Homo Sapiens; identical to SEQ ID NO: 8582

SEQ ID NO: 8584 - protein, 158 aa, Homo Sapiens; identical to SEQ ID NO: 8582

SEQ ID NO: 8585 - protein, 102 aa, Homo Sapiens
MENQVQTLTSYLWSRHLPVEPEELQRRARHLEKKFLENPDLSQTEEKLRGAVLHALRKTTYHWQELSYTEGLSLVYMAARLDGGFAAVSRAFHEIRARNPAF

SEQ ID NO: 8586 - protein, 140 aa, Homo Sapiens
MENQVQTLTSYLWSRHLPVEPEELQRRARHLEKKFLENPDLSQTEEKLRGAVLHALRKTTYHWQELSYTEGLSLVYMAARLDGGFAAVSRAFHEIRARNPAFQPQTLMDFGSGTGSVTWAAHSIWGQSLREYMCVDRSAA

SEQ ID NO: 8587 - protein, 174 aa, Homo Sapiens
MENQVQTLTSYLWSRHLPVEPEELQRRARHLEKKFLENPDLSQTEEKLRGAVLHALRKTTYHWQELSYTEGLSLVYMAARLDGGFAAVSRAFHEIRARNPAFQPQTLMDFGSGTGSVTWAAHSIWGQSLREYMCVDRSAAMLVLAEKLLKGGSESGEPYIPGVFFRQFLPVSPK

SEQ ID NO: 8588 - protein, 186 aa, Homo Sapiens
MVPRPWSGSPGPGECLHSLLSERLWICRDISAQRRSAPGSPRPSDCQQLSFLPGNQPTFLCLQALAALVPGVTQVDNKSGFLQKRPHRQHPGILKLPHVRLPQALANGAQLLLLGSAGPTMENQVQTLTSYLWSRHLPVEPEELQRRARHLEKKFLENPDLSQTEEKLRGAVLHALRKTTYHWQEL

SEQ ID NO: 8589 - protein, 123 aa, Homo Sapiens
  misc_feature (1)..(1): Xaa can be any naturally occurring amino acid
XPGFVFAPCPHELPCPQLTNLACSFSQAYHPIPFSWNKKPKEEKFSMVILARGSPEEAHRWPRITQPVLKRPRHVHCHLCCPDGHMQHAVLTARRHGSSWGDLLPVLTPSAFPPSTAQDPSES

SEQ ID NO: 8590 - protein, 366 aa, Homo Sapiens
MARERPPGRGCGVLRRCLLGAVLLFGLRLCAELRRAGPGSPTRSAPPGPAWRPPGPHLPPAPGQPRGASRRQVTYVRSGRRAPPGGGGSGTPEPGCCAPRGRPRRKGPRWHIDLQPWAGSAQSLDEEAWRFLRYISTTQIACNHMNTDSLATDSSPTHKPWSVCLDDRFNLAHQIRNKQCRLYSLGLGSDDTHFEVSMANNGCEVHRFDPSVKSAHILESQHLWYHRLSIDWRDPHPAVAAQKPHSNTRKLGSILNEFGHHKIDVLKADLESAEWKVLENLILEDVLEQIGQLIFEIHLHWPGFEVSGSDSSVVRFWYSLLKELEQKDFRLFHSYKDLSKPQLFLKKDIFNASSCYTLSWVNTRWK

SEQ ID NO: 8591 - protein, 244 aa, Homo Sapiens
MDILVPLLQLLVLLLTLPLHLMALLGCWQPLCKSYFPYLMAVLTPKSNRKMESKKRELFSQIKGLTGASGKVALLELGCGTGANFQFYPPGCRVTCLDPNPHFEKFLTKSMAENRHLQYERFVVAPGEDMRQLADGSMDVVVCTLVLCSVQSPRKVLQEVRRVLRPGGVLFFWEHVAEPYGSWAFMWQQVFEPTWKHIGDGCCLTRETWKDLENAQFSEIQMERQPPPLKWLPVGPHIMGKAVK

SEQ ID NO: 8592 - protein, 276 aa, Homo Sapiens
MDILVPLLQLLVLLLTLPLHLMALLGCWQPLCKSYFPYLMAVLTPKSNRKMESKKRELFSQIKGLTGASGKVALLELGCGTGANFQFYPPGCRVTCLDPNPHFEKFLTKSMAENRHLQYERFVVAPGEDMRQLADGSMDVVVCTLVLCSVQSPRKVLQEVRRVLRPGGVLFFWEHVAEPYGSWAFMWQQVFEPTWKHIGDGCCLTRETWKDLENAQFSEIQMERQPPPLKWLPVGPHIMGKAVKSFPSSKALICSFPSLQLEQATHQPIYLPLRGT

SEQ ID NO: 8593 - protein, 243 aa, Homo Sapiens
MDRKTTSWDTKFYEKWYVCNREKLCESLQAVFVQSYLDQGTQIFLNNSIEKSGWLFIQLYHSFVSSVFSLFMSRTSINGLLGRGSMFVFSPDQFQRLLKINPDWKTHRLLDLGAGDGEVTKIMSPHFEEIYATELSETMIWQLQKKKYRVLGINEWQNTGFQYDVISCLNLLDRCDQPLTLLKDIRSVLEPTRGRVILALVLPFHPYVENVGGKWEKPSEILEIKGQNWEEQVNSLPEVFRKA

SEQ ID NO: 8594 - protein, 61 aa, Homo Sapiens
MRLLAGWLCLSLASVWLARRMWTLRSPLTRSLGMCATERNYANHSRLSLFRVTLIKEHRSS

SEQ ID NO: 8595 - protein, 74 aa, Homo Sapiens
MRLLAGWLCLSLASVWLARRMWTLRSPLTRSLYVNMTSGPGGPAAAAGGRKENHQVARKRLNVCVFTRSVSETA

SEQ ID NO: 8596 - protein, 317 aa, Homo Sapiens
MRLLAGWLCLSLASVWLARRMWTLRSPLTRSLYVNMTSGPGGPAAAAGGRKENHQWYVCNREKLCESLQAVFVQSYLDQGTQIFLNNSIEKSGWLFIQLYHSFVSSVFSLFMSRTSINGLLGRGSMFVFSPDQFQRLLKINPDWKTHRLLDLGAGDGEVTKIMSPHFEEIYATELSETMIWQLQKKKYRVLGINEWQNTGFQYDVISCLNLLDRCDQPLTLLKDIRSVLEPTRGRVILALVLPFHPYVENGGKWEKPSEILEIKGQNWEEQVNSLPEVFRKAGFVIEAFTRLPYLCEGDMYNDYYVLDDAVFVLKPV

SEQ ID NO: 8597 - protein, 318 aa, Homo Sapiens
MRLLAGWLCLSLASVWLARRMWTLRSPLTRSLYVNMTSGPGGPAAAAGGRKENHQWYVCNREKLCESLQAVFVQSYLDQGTQIFLNNSIEKSGWLFIQLYHSFVSSVFSLFMSRTSINGLLGRGSMFVFSPDQFQRLLKINPDWKTHRLLDLGAGDGEVTKIMSPHFEEIYATELSETMIWQLQKKKYRVLGINEWQNTGFQYDVISCLNLLDRCDQPLTLLKDIRSVLEPTRGRVILALVLPFHPYVENVGGKWEKPSEILEIKGQNWEEQVNSLPEVFRKAGFVIEAFTRLPYLCEGDMYNDYYVLDDAVFVLKPV

SEQ ID NO: 8598 - protein, 139 aa, Homo Sapiens
MSRTSINGLLGRGSMFVFSPDQFQRLLKINPDWKTHRLLDLGAGDGEVTKIMSPHFEEIYATELSETMIWQLQKKKYRVLGINEWQNTGFQYDVISCLNLLDRCDQPLTLLKDIRSVLEPTRGRVILALVLPFHPYVEN

SEQ ID NO: 8599 - protein, 282 aa, Homo Sapiens
MWTLRSPLTRSLYVKENHQWYVCNREKLCESLQAVFVQSYLDQGTQIFLNNSIEKSGWLFIQLYHSFVSSVFSLFMSRTSINGLLGRGSMFVFSPDQFQRLLKINPDWKTHRLLDLGAGDGEVTKIMSPHFEEIYATELSETMIWQLQKKKYRVLGINEWQNTGFQYDVISCLNLLDRCDQPLTLLKDIRSVLEPTRGRVILALVLPFHPYVENVGGKWEKPSEILEIKGQNWEEQVNSLPEVFRKAGFVIEAFTRLPYLCEGDMYNDYYVLDDAVFVLKPV

SEQ ID NO: 8600 - protein, 128 aa, Homo Sapiens
  misc_feature (1)..(1): Xaa can be any naturally occurring amino acid
XPDQFQRLLKINPDWKTHRLLDLGAGDGEVTKIMSPHFEEIYATELSETMIWQLQKKKYRVLGINEWQNTGFQYDVISCLNLLDRCDQPLTLLKDIRSVLEPTRGRVILALVLPFHPYVENGKCGQSG

SEQ ID NO: 8601 - protein, 125 aa, Homo Sapiens
  misc_feature (1)..(1): Xaa can be any naturally occurring amino acid
XSYLDQGTQIFLNNSIEKSGWLFIQLYHSFVSSVFSLFMSRTSINGVLGINEWQNTGFQYDVISCLNLLDRCDQPLTLLKDIRSVLEPTRGRVILALVLPFHPYVENVGGKWEKPSEILEIKGQN

SEQ ID NO: 8602 - protein, 489 aa, Homo Sapiens
MPSGSSAALALAAAGVLYGGDDAQGMMAAMLSHAYGPGGCGAAAAALNGEQAALLRRKSVNTTECVPVPSSEHVAEIVGRQGCKIKALRAKTNTYIKTPVRGEEPIFVVTGRKEDVAMAKREILSAAEHFSMIRASRNKNGPALGGLSCSPNLPGQTTVQVRVPYRVVGLVVGPKGATIKRIQQQTHTYIVTPSRDKEPVFEVTGMPENVDRAREEIEMHIAMRTGNYIELNEENDFHYNGTDVSFEGGTLGSAWLSSNPVPPSRARMISNYRNDSSSSLGSGSTDSYFGSNRLADFSPTSPFSTGNFWFGDTLPSVGSEDLAVDSPAFDSLPTSAQTIWTPFEPVNPLSGFGSDPSGNMKTQRRGSQPSTPRLSPTFPESIEHPLARRVRSDPPSTGNHVGLPIYIPAFSNGTNSYSSSNGGSTSSSPPESRRKHDCVICFENEVIAALVPCGHNLFCMECANKICEKRTPSCPVCQTAVTQAIQIHS

SEQ ID NO: 8603 - protein, 659 aa, Homo Sapiens
MPSGSSAALALAAAPAPLPQPPPPPPPPPPPLPPPSGGPELEGDGLLLRERLAALGLDDPSPAEPGAPALRAPAAAAQGQARRAAELSPEERAPPGRPGAPEAAELELEEDEEEGEEAELDGDLLEEEELEEAEEEDRSSLLLLSPPAATASQTQQIPGGSLGSVLLPAARFDAREAAAAAAAAGVLYGGDDAQGMMAAMLSHAYGPGGCGAAAAALNGEQAALLRRKSVNTTECVPVPSSEHVAEIVGRQGCKIKALRAKTNTYIKTPVRGEEPIFVVTGRKEDVAMAKREILSAAEHFSMIRASRNKNGPALGGLSCSPNLPGQTTVQVRVPYRVVGLVVGPKGATIKRIQQQTHTYIVTPSRDKEPVFEVTGMPENVDRAREEIEMHIAMRTGNYIELNEENDFHYNGTDVSFEGGTLGSAWLSSNPVPPSRARMISNYRNDSSSSLGSGSTDSYFGSNRLADFSPTSPFSTGNFWFGDTLPSVGSEDLAVDSPAFDSLPTSAQTIWTPFEPVNPLSGFGSDPSGNMKTQRRGSQPSTPRLSPTFPESIEHPLARRVRSDPPSTGNHVGLPIYIPAFSNGTNSYSSSNGGSTSSSPPESRRKHDCVICFENEVIAALVPCGHNLFCMECANKICEKRTPSCPVCQTAVTQAIQIHS

SEQ ID NO: 8604 - protein, 115 aa, Homo Sapiens
YGGDDAQGMMAAMLSHAYGPGGCGAAAAALNGEQAALLRRKSVNTTECVPVPSSEHVAEIVGRQGECRGGEVQLGMAPGVGGETRERSVGRKRRTRRGPQVHREGVWEEPRVDQM

SEQ ID NO: 8605 - protein, 183 aa, Homo Sapiens
MRAAYLFLLFLPAGLLAQGQYDLDPLPPFPDHVQYTHYSDQIDNPDYYDYQEVTPRPSEEQFQFQSQQQVQQEVIPAPTPEPGNAELEPTEPGPLDCREEQYPCTRLYSIHRPCKQCLNEVCFYSLRRVYVINKEICVRTVCAHEELLRADLCRDKFSKCGVMASSGLCQSVAASCARSCGSC

SEQ ID NO: 8606 - protein, 182 aa, Homo Sapiens
MRAAYLFLLFLPGLLAQGQYDLDPLPPFPDHVQYTHYSDQIDNPDYYDYQEVTPRPSEEQFQFQSQQQVQQEVIPAPTPEPGNAELEPTEPGPLDCREEQYPCTRLYSIHRPCKQCLNEVCFYSLRRVYVINKEICVRTVCAHEELLRADLCRDKFSKCGVMASSGLCQSVAASCARSCGSC

SEQ ID NO: 8607 - protein, 17 aa, Homo Sapiens
MKLHCCLFTLVASIIVP

SEQ ID NO: 8608 - protein, 109 aa, Homo Sapiens
MKLHCCLFTLVASIIVPAAFVLEDVDFDQMVSLEANRSSYNASFPSSFELSASSHSDDDVIIAKEGTSVSIECLLTASHYEDVHWHNSKGQQLDGRSRGGKWLVSDNFL

SEQ ID NO: 8609 - protein, 123 aa, Homo Sapiens
MKLHCCLFTLVASIIVPAAFVLEDVDFDQMVSLEANRSSYNASFPSSFELSASSHSDDDVIIAKEGTSVSIECLLTASHYEDVHWHNSKGQQLDGRSRGGKWLVSDNFLNITNVAFDDRGLYT

SEQ ID NO: 8610 - protein, 362 aa, Homo Sapiens
MKLHCCLFTLVASIIVPAAFVLEDVDFDQMVSLEANRSSYNASFPSSFELSASSHSDDDVIIAKEGTSVSIECLLTASHYEDVHWHNSKGQQLDGRSRGGKWLVSDNFLNITNVAFDDRGLYTCFVTSPIRASYSVTLRVIFTSGDMSVYYMIVCLIAFTITLILNVTRLCMMSSHLRKTEKAINEFFRTEGAEKLQKAFEIAKRIPIITSAKTLELAKVTQFKTMEFARYIEELARSVPLPPLILNCRAFVEEMFEAVRVDDPDDLGERIKERPALNAQGGIYVINPEMGRSNSPGGDSDDGSLNEQGQEIAVQVSVHLQSETKSIDTESQGSSHFSPPDDIGSAESNCNYKDGAYENCQL

SEQ ID NO: 8611 - protein, 216 aa, Homo Sapiens
MSVYYMIVCLIAFTITLILNVTRLCMMSSHLRKTEKAINEFFRTEGAEKLQKAFEIAKRIPIITSAKTLELAKVTQFKTMEFARYIEELARSVPLPPLILNCRAFVEEMFEAVRVDDPDDLGERIKERPALNAQGGIYVINPEMGRSNSPGGDSDDGSLNEQGQEIAVQVSVHLQSETKSIDTESQGSSHFSPPDDIGSAESNCNYKDGAYENCQL

SEQ ID NO: 8612 - protein, 73 aa, Homo Sapiens
MDRLKSHLTVCFLPSVPFLILVSTLATAKSVTNSTLNGTNVVLGSVPVIIARTDHIIVKEGNSALINCSVYGI

SEQ ID NO: 8613 - protein, 90 aa, Homo Sapiens
MDRLKSHLTVCFLPSVPFLILVSTLATAKSVTNSTLNGTNVVLGSVPVIIARTDHIIVKEGNSALINCSVYGIPDPQFKWYNSIGKLLKE

SEQ ID NO: 8614 - protein, 98 aa, Homo Sapiens
MDRLKSHLTVCFLPSVPFLILVSTLATAKSVTNSTLNGTNVVLGSVPVIIARTDHIIVKEGNSALINCSVYGIPDPQFKWYNSIGKLLKEEEDEKERG

SEQ ID NO: 8615 - protein, 409 aa, Homo Sapiens
MDRLKSHLTVCFLPSVPFLILVSTLATAKSVTNSTLNGTNVVLGSVPVIIARTDHIIVKEGNSALINCSVYGIPDPQFKWYNSIGKLLKEEEDEKERGGGKWQMHDSGLLNITKVSFSDRGKYTCVASNIYGTVNNTVTLRVIFTSGDMGVYYMVVCLVAFTIVMVLNITRLCMMSSHLKKTEKAINEFFRTEGAEKLQKAFEIAKRIPIITSAKTLELAKVTQFKTMEFARYIEELARSVPLPPLIMNCRTIMEEIMEVVGLEEQGQNFVRHTPEGQEAADRDEVYTIPNSLKRSDSPAADSDASSLHEQPQQIAIKVSVHPQSKKEHADDQEGGQFEVKDVEETELSAEHSPETAEPSTDVTSTELTSEEPTPVEVPDKVLPPAYLEATEPAVTHDKNTCIIYESHV

SEQ ID NO: 8616 - protein, 102 aa, Homo Sapiens
MDRLKSHLTVCFLPSVPFLILVSTLATAKSVTNSTLNGTNVVLGSVPVIIARTDHIIVKEGNSALINCSVYGIPDPQFKWYNSIGKLLKEEEDEKERGGGRL

SEQ ID NO: 8617 - protein, 102 aa, Homo Sapiens; identical to SEQ ID NO: 8616

SEQ ID NO: 8618 - protein, 44 aa, Homo Sapiens
MHDSGLLNITKVSFSDRGKYTCVASNIYGTVNNTVTLRVIFTSG

SEQ ID NO: 8619 - protein, 64 aa, Homo Sapiens
MHDSGLLNITKVSFSDRGKYTCVASNIYGTVNNTVTLRVIFTSGDMGVYYMVVCLVAFTIVMVL

SEQ ID NO: 8620 - protein, 157 aa, Homo Sapiens
MHDSGLLNITKVSFSDRGKYTCVASNIYGTVNNTVTLRVIFTSGDMGVYYMVVCLVAFTIVMVLNITRLCMMSSHLKKTEKAINEFFRTEGAEKLQKAFEIAKRIPIITSAKTLELAKVTQFKTMEFARYIEELARSVPLPPLIMNCRTIMEEIMEV

SEQ ID NO: 8621 - protein, 306 aa, Homo Sapiens
MHDSGLLNITKVSFSDRGKYTCVASNIYGTVNNTVTLRVIFTSGDMGVYYMVVCLVAFTIVMVLNITRLCMMSSHLKKTEKAINEFFRTEGAEKLQKAFEIAKRIPIITSAKTLELAKVTQFKTMEFARYIEELARSVPLPPLIMNCRTIMEEIMEVVGLEEQGQNFVRHTPEGQEAADRDEVYTIPNSLKRSDSPAADSDASSLHEQPQQIAIKVSVHPQSKKEHADDQEGGQFEVKDVEETELSAEHSPETAEPSTDVTSTELTSEEPTPVEVPDKVLPPAYLEATEPAVTHDKNTCIIYESHV

SEQ ID NO: 8622 - protein, 279 aa, Homo Sapiens
MGELSPLQRPLATEGTMKAQGVLLKLALLALPLLLLLSTPPCAPQVSGIRGDALERFCLQQPLDCDDIYAQGYQSDGVYLIYPSGPSVPVPVFCDMTTEGGKWTVFQKRFNGSVSFFRGWNDYKLGFGRADGEYWLGLQNMHLLTLKQKYELRVDLEDFENNTAYAKYADFSISPNAVSAEEDGYTLFVAGFEDGGAGDSLSYHSGQKFSTFDRDQDLFVQNCAALSSGAFWFRSCHFANLNGFYLGGSHLSYANGINWAQWKGFYYSLKRTEMKIRRA

SEQ ID NO: 8623 - protein, 255 aa, Homo Sapiens
MKALLALPLLLLLSTPPCAPQVSGIRGDALERFCLQQPLDCDDIYAQGYQSDGVYLIYPSGPSVPVPVFCDMTTEGGKWTVFQKRFNGSVSFFRGWNDYKLGFGRADGEYWLGLQNMHLLTLKQKYELRVDLEDFENNTAYAKYADFSISPNAVSAEEDGYTLFVAGFEDGGAGDSLSYHSGQKFSTFDRDQDLFVQNCAALSSGAFWFRSCHFANLNGFYLGGSHLSYANGINWAQWKGFYYSLKRTEMKIRRA

SEQ ID NO: 8624 - protein, 280 aa, Homo Sapiens
MVGANAKRTGDLWSWEGAVLTLSAHRQALLALPLLLLLSTPPCAPQVSGIRGDALERFCLQQPLDCDDIYAQGYQSDGVYLIYPSGPSVPVPVFCDMTTEGGKWTVFQKRFNGSVSFFRGWNDYKLGFGRADGEYWLGLQNMHLLTLKQKYELRVDLEDFENNTAYAKYADFSISPNAVSAEEDGYTLFVAGFEDGGAGDSLSYHSGQKFSTFDRDQDLFVQNCAALSSGAFWFRSCHFANLNGFYLGGSHLSYANGINWAQWKGFYYSLKRTEMKIRRA

SEQ ID NO: 8625 - protein, 151 aa, Homo Sapiens
MSLLGPKVLLFLAAFIITSDDVTQATPETFTEDPNLVNDPATDETVLAVLADIAPSTDDLECWDEKFTCTRLYSVHRPVKQCIHQLCFTSLRRMYIVNKEICSRLVCKEHEAMKDELCRQMAGLPPRRLRRSNYFRLPPCENVDLQRPNGL

SEQ ID NO: 8626 - protein, 148 aa, Homo Sapiens
MSLLGPKVLLFLAAFIITSDWIPLGVNSQRGDDVTQATPETFTEDPNLVNDPATDETECWDEKFTCTRLYSVHRPVKQCIHQLCFTSLRRMYIVNKEICSRLVCKEHEAMKDELCRQMAGLPPRRLRRSNYFRLPPCENVDLQRPNGL

SEQ ID NO: 8627 - protein, 91 aa, Homo Sapiens
MSLLGPKVLLFLAAFIITSDWIPLGVNSQRGDDVTQATPETFTEDPNLVNDPATDETVLAVLADIAPSTDDLASLSEKNTTAECWDEKFTC

SEQ ID NO: 8628 - protein, 173 aa, Homo Sapiens
MSLLGPKVLLFLAAFIITSDWIPLGVNSQRGDDVTQATPETFTEDPNLVNDPATDETVLAVLADIAPSTDDLASLSEKNTTAECWDEKFTCTRLYSVHRPVKQCIHQLCFTSLRRMYIVNKEICSRLVCKEHEAMKDELCRQMAGLPPRRLRRSNYFRLPPCENVDLQRPNGL

SEQ ID NO: 8629 - protein, 138 aa, Homo Sapiens
MSLLGPKVLLFLAAFIITSDWIPLGVNSQRGDDVTQATPETFTEDPNLVNDPATDETVLAVLADIAPSTDDLASLSEKNTTAECWDEKFTCTRLYSVHRPVKQCIHQLCFTSLRRMYIVNKEICSRLVCKEHEAMKDP

SEQ ID NO: 8630 - protein, 109 aa, Homo Sapiens
MSLLGPKVLLFLAAFIITSDWIPLGVNSQRGDDVTQATPETFTEDPNLVNDPATDETVLAVLADIAPSTDDLDELCRQMAGLPPRRLRRSNYFRLPPCENVDLQRPNGL

SEQ ID NO: 8631 - protein, 163 aa, Homo Sapiens
MSLLGPKVLLFLAAFIITSDWIPLGVNSQRGDDVTQATPETFTEDPNLVNDPATDETVLAVLADIAPSTDDLECWDEKFTCTRLYSVHRPVKQCIHQLCFTSLRRMYIVNKEICSRLVCKEHEAMKDELCRQMAGLPPRRLRRSNYFRLPPCENVDLQRPNGL

SEQ ID NO: 8632 - protein, 163 aa, Homo Sapiens; identical to SEQ ID NO: 8631

SEQ ID NO: 8633 - protein, 128 aa, Homo Sapiens
MSLLGPKVLLFLAAFIITSDWIPLGVNSQRGDDVTQATPETFTEDPNLVNDPATDETVLAVLADIAPSTDDLECWDEKFTCTRLYSVHRPVKQCIHQLCFTSLRRMYIVNKEICSRLVCKEHEAMKDP

SEQ ID NO: 8634 - protein, 163 aa, Homo Sapiens
  misc_feature (1)..(1): Xaa can be any naturally occurring amino acid
XLAAFIITSDWIPLGVNSQRGDDVTQATPETFTEDPNLVNDPATDETVLAVLADIAPSTDDLASLSEKNTTAECWDEKFTCTRLYSVHRPVKQCIHQLCFTSLRRMYIVNKEICSRLVCKEHEAMKDELCRQMAGLPPRRLRRSNYFRLPPCENVDLQRPNGL

SEQ ID NO: 8635 - protein, 79 aa, Homo Sapiens
YSVHRPVKQCIHQLCFTSLRRMYIVNKEICSRLVCKEHEAMKDELCRQMAGLPPRRLRRSNYFRLPPCENVDLQRPNGL

SEQ ID NO: 8636 - protein, 75 aa, Homo Sapiens
FDFIHDVNKKHKEFVGNWNKNAVHVNLFETPVEAQYVRLYPTSCHTACTLRFELLGCELNARKADLRRGADDREQ

SEQ ID NO: 8637 - protein, 268 aa, Homo Sapiens
MPRPRLLAALCGALLCAPSLLVALDICSKNPCHNGGLCEEISQEVRGDVFPSYTCTCLKGYAGNHCETKCVEPLGLENGNIANSQIAASSVRVTFLGLQHWVPELARLNRAGMVNAWTPSSNDDNPWIQVNLLRRMWVTGVVTQGASRLASHEYLKAFKVAYSLNGHEFDFIHDVNKKHKEFVGNWNKNAVHVNLFETPVEAQYVRLYPTSCHTACTLRFELLGCELNAATRPGACISSAGTPPMHGWTSRATSTPGLRGATVTISGC

SEQ ID NO: 8638 - protein, 335 aa, Homo Sapiens
MPRPRLLAALCGALLCAPSLLVALDICSKNPCHNGGLCEEISQEVRGDVFPSYTCTCLKGYAGNHCETKCVEPLGLENGNIANSQIAASSVRVTFLGLQHWVPELARLNRAGMVNAWTPSSNDDNPWIQVNLLRRMWVTGVVTQGASRLASHEYLKAFKVAYSLNGHEFDFIHDVNKKHKEFVGNWNKNAVHVNLFETPVEAQYVRLYPTSCHTACTLRFELLGCELNGCANPLGLKNNSIPDKQITASSSYKTWGLHLFSWNPSYARLDKQGNFNAWVAGSYGNDQWLQIFPGNWDNHSHKKNLFETPILARYVRILPVAWHNRIALRLELLGC

SEQ ID NO: 8639 - protein, 387 aa, Homo Sapiens
MPRPRLLAALCGALLCAPSLLVALDICSKNPCHNGGLCEEISQEVRGDVFPSYTCTCLKGYAGNHCETKCVEPLGLENGNIANSQIAASSVRVTFLGLQHWVPELARLNRAGMVNAWTPSSNDDNPWIQVNLLRRMWVTGVVTQGASRLASHEYLKAFKVAYSLNGHEFDFIHDVNKKHKEFVGNWNKNAVHVNLFETPVEAQYVRLYPTSCHTACTLRFELLGCELNGCANPLGLKNNSIPDKQITASSSYKTWGLHLFSWNPSYARLDKQGNFNAWVAGSYGNDQWLQVDLGSSKEVTGIITQGARNFGSVQFVASYKVAYSNDSANWTEYQDPRTGSSKIFPGNWDNHSHKKNLFETPILARYVRILPVAWHNRIALRLELLGC

SEQ ID NO: 8640 - protein, 387 aa, Homo Sapiens; identical to SEQ ID NO: 8639

SEQ ID NO: 8641 - protein, 343 aa, Homo Sapiens
MPRPRLLAALCGALLCAPSLLVALECVEPLGLENGNIANSQIAASSVRVTFLGLQHWVPELARLNRAGMVNAWTPSSNDDNPWIQVNLLRRMWVTGVVTQGASRLASHEYLKAFKVAYSLNGHEFDFIHDVNKKHKEFVGNWNKNAVHVNLFETPVEAQYVRLYPTSCHTACTLRFELLGCELNGCANPLGLKNNSIPDKQITASSSYKTWGLHLFSWNPSYARLDKQGNFNAWVAGSYGNDQWLQVDLGSSKEVTGIITQGARNFGSVQFVASYKVAYSNDSANWTEYQDPRTGSSKIFPGNWDNHSHKKNLFETPILARYVRILPVAWHNRIALRLELLGC

SEQ ID NO: 8642 - protein, 25 aa, Homo Sapiens
MPRPRLLAALCGALLCAPSLLVALG

SEQ ID NO: 8643 - protein, 43 aa, Homo Sapiens
MAAEFDTFLASGLRWFCHVDDDNYVNPRALLQLLRAFPLARDV

SEQ ID NO: 8644 - protein, 132 aa, Homo Sapiens
MAAEFDTFLASGLRWFCHVDDDNYVNPRALLQLLRAFPLARDVYVGRPSLNRPIHASEPQPHNRTRLVQFWFATGGAGFCINRKLALKMAPWASGSRFMDTSALIRLPDDCTMGYIIECKLGGRLQPSPLFH

SEQ ID NO: 8645 - protein, 130 aa, Homo Sapiens
MQCRLPRGLAGALLTLLCMGLLCLRYHLNLSPQRVQGTPELSQPNPGPPKLQLHDVFIAVKTTRAFHRLRLELLLDTWVSRTREQGPTLWSPTAPRNTATQLCPARWLLSSTPSWPVGLGGSAMWTMTTM

SEQ ID NO: 8646 - protein, 321 aa, Homo Sapiens
MQCRLPRGLAGALLTLLCMGLLCLRYHLNLSPQRVQGTPELSQPNPGPPKLQLHDVFIAVKTTRAFHRLRLELLLDTWVSRTREQTFVFTDSPDKGLQERLGSHLVVTNCSAEHSHPALSCKMAAEFDTFLASGLRWFCHVDDDNYVNPRALLQLLRAFPLARDVYVGRPSLNRPIHASEPQPHNRTRLVQFWFATGGAGFCINRKLALKMAPWASGSRFMDTSALIRLPDDCTMGYIIECKLGGRLQPSPLFHSHLETLQLLRTAQLPEQVTLSYGVFEGKLNVIKLQGPFSPEEDPSRFRSLHCLLYPDTPWCPQLGAR

SEQ ID NO: 8647 - protein, 118 aa, Homo Sapiens
MQCRLPRGLAGALLTLLCMGLLCLRYHLNLSPQRVQGTPELSQPNPGPPKLQLHDVFIAVKTTRAFHRLRLELLLDTWVSRTREQTFVFTDSPDKGLQERLGSPDSSSLLQGPTLWSP

SEQ ID NO: 8648 - protein, 127 aa, Homo Sapiens
MQCRLPRGLAGALLTLLCMGLLCLRYHLNLSPQRVQGTPELSQPNPGPPKLQLHDVFIAVKTTRAFHRLRLELLLDTWVSRTREQVTNICLHRQPRQRPPGETGVPPCGHQLLRGTQPPSSVLQDGC

SEQ ID NO: 8649 - protein, 307 aa, Homo Sapiens
MQCRLPRGLAGALLTLLCMGLLCLRYHLNLSPQRVQGTPELSQPNPGPPKLQLHDVFIAVKTTRAFHRLRLELLLDTWVSRTREQVTRSHLVVTNCSAEHSHPALSCKMAAEFDTFLASGLRWFCHVDDDNYVNPRALLQLLRAFPLARDVYVGRPSLNRPIHASEPQPHNRTRLVQFWFATGGAGFCINRKLALKMAPWASGSRFMDTSALIRLPDDCTMGYIIECKLGGRLQPSPLFHSHLETLQLLRTAQLPEQVTLSYGVFEGKLNVIKLQGPFSPEEDPSRFRSLHCLLYPDTPWCPQLGAR

SEQ ID NO: 8650 - protein, 87 aa, Homo Sapiens
  misc_feature (1)..(1): Xaa can be any naturally occurring amino acid
XSHLETLQLLRTAQLPEQISLPPLSALSRYTLVSPAGCPMNPELLGKGWAETSGCALAPKVALWVPGKCLVIGSPWQGLRVVGKPRI

SEQ ID NO: 8651 - protein, 3065 aa, Homo Sapiens
MEEKQQIILANQDGGTVAGAAPTFFVILKQPGNGKTDQGILVTNQDACALASSVSSPVKSKGKICLPADCTVGGITVTLDNNSMWNEFYHRSTEMILTKQGRRMFPYCRYWITGLDSNLKYILVMDISPVDNHRYKWNGRWWEPSGKAEPHVLGRVFIHPESPSTGHYWMHQPVSFYKLKLTNNTLDQEGHIILHSMHRYLPRLHLVPAEKAVEVIQLNGPGVHTFTFPQTEFFAVTAYQNIQITQLKIDYNPFAKGFRDDGLNNKPQRDGKQKNSSDQEGNNISSSSGHRVRLTEGQGSEIQPGDLDPLSRGHETSGKGLEKTSLNIKRDFLGFMDTDSALSEVPQLKQEISECLIASSFEDDSRVASPLDQNGSFNVVIKEEPLDDYDYELGECPEGVTVKQEETDEETDVYSNSDDDPILEKQLKRHNKVDNPEADHLSSKWLPSSPSGVAKAKMFKLDTGKMPVVYLEPCAVTRSTVKISELPDNMLSTSRKDKSSMLAELEYLPTYIENSNETAFCLGKESENGLRKHSPDLRVVQKYPLLKEPQWKYPDISDSISTERILDDSKDSVGDSLSGKEDLGRKRTTMLKIATAAKVVNANQNASPNVPGKRGRPRKLKLCKAGRPPKNTGKSLISTKNTPVSPGSTFPDVKPDLEDVDGVLFVSFESKEALDIHAVDGTTEESSSLQASTTNDSGYRARISQLEKELIEDLKTLRHKQVIHPGLQEVGLKLNSVDPTMSIDLKYLGVQLPLAPATSFPFWNLTGTNPASPDAGFPFVSRTGKTNDFTKIKGWRGKFHSASASRNEGGNSESSLKNRSAFCSDKLDEYLENEGKLMETSMGFSSNAPTSPVVYQLPTKSTSYVRTLDSVLKKQSTISPSTSYSLKPHSVPPVSRKAKSQNRQATFSGRTKSSYKSILPYPVSPKQKYSHVILGDKVTKNSSGIISENQANNFVVPTLDENIFPKQISLRQAQQQQQQQQGSRPPGLSKSQVKLMDLEDCALWEGKPRTYITEERADVSLTTLLTAQASLKTKPIHTIIRKRAPPCNNDFCRLGCVCSSLALEKRQPAHCRRPDCMFGCTCLKRKVVLVKGGSKTKHFQRKAAHRDPVFYDTLGEEAREEEEGIREEEEQLKEKKKRKKLEYTICETEPEQPVRHYPLWVKVEGEVDPEPVYIPTPSVIEPMKPLLLPQPEVLSPTVKGKLLTGIKSPRSYTPKPNPVIREEDKDPVYLYFESMMTCARVRVYERKKEDQRQPSSSSSPSPSFQQQTSCHSSPENHNNAKEPDSEQQPLKQLTCDLEDDSDKLQEKSWKSSCNEGESSSTSYMHQRSPGGPTKLIEIISDCNWEEDRNKILSILSQHINSNMPQSLKVGSFIIELASQRKSRGEKNPPVYSSRVKISMPSCQDQDDMAEKSGSETPDGPLSPGKMEDISPVQTDALDSVRERLHGGKGLPFYAGLSPAGKLVAYKRKPSSSTSGLIQVASNAKVAASRKPRTLLPSTSNSKMASSSGTATNRPGKNLKAFVPAKRPIAARPSPGGVFTQFVMSKVGALQQKIPGVSTPQTLAGTQKFSIRPSPVMVVTPVVSSEPVQVCSPVTAAVTTTTPQVFLENTTAVTPMTAISDVETKETTYSSGATTTGVVEVSETNTSTSVTSTQSTATVNLTKTTGITTPVASVAFPKSLVASPSTITLPVASTASTSLVVVTAAASSSMVTTPTSSLGSVPIILSGINGSPPVSQRPENAAQIPVATPQVSPNTVKRAGPRLLLIPVQQGSPTLRPVSNTQLQGHRMVLQPVRSPSGMNLFRHPNGQIVQLLPLHQLRGSNTQPNLQPVMFRNPGSVMGIRLPAPSKPSETPPSSTSSSAFSVMNPVIQAVGSSSAVNVITQAPSLLSSGASFVSQAGTLTLRISPPEPQSFASKTGSETKITYSSGGQPVGTASLIPLQSGSFALLQLPGQKPVPSSILQHVASLQMKRESQNPDQKDETNSIKREQETKKVLQSEGEAVDPEANVIKQNSGAATSEETLNDSLEDRGDHLDEECLPEEGCATVKPSEHSCITGSHTDQDYKDVNEEYGARNRKSSKEKVAVLEVRTISEKASNKTVQNLSKVQHQKLGDVKVEQQKGFDNPEENSSEFPVTFKEESKFELSGSKVMEQQSNLQPEAKEKECGDSLEKDRERWRKHLKGPLTRKCVGASQECKKEADEQLIKETKTCQENSDVFQQEQGISDLLGKSGITEDARVLKTECDSWSRISNPSAFSIVPRRAAKSSRGNGHFQGHLLLPGEQIQPKQEKKGGRSSADFTVLDLEEDDEDDNEKTDDSIDEIVDVVSDYQSEEVDDVEKNNCVEYIEDDEEHVDIETVEELSEEINVAHLKTTAAHTQSFKQPSCTHISADEKAAERSRKAPPIPLKLKPDYWSDKLQKEAEAFAYYRRTHTANERRRRGEMRDLFEKLKITLGLLHSSKVSKSLILTRAFSEIQGLTDQADKLIGQKNLLTRKRNILIRKVSSLSGKTEEVVLKKLEYIYAKQQALEAQKRKKKMGSDEFDISPRISKQQEGSSASSVDLGQMFINNRRGKPLILSRKKDQATENTSPLNTPHTSANLVMTPQGQLLTLKGPLFSGPVVAVSPDLLESDLKPQVAGSAVALPENDDLFMMPRIVNVTSLATEGGLVDMGGSKYPHEVPDSKPSDHLKDTVRNEDNSLEDKGRISSRGNRDGRVTLGPTQVFLANKDSGYPQIVDVSNMQKAQEFLPKKISGDMRGIQYKWKESESRGERVKSKDSSFHKLKMKDLKDSSIEMELRKVTSAIEEAALDSSELLTNMEDEDDTDETLTSLLNEIAFLNQQLNDDSVGLAELPSSMDTEFPGDARRAFISKVPPGSRATFQVEHLGTGLKELPDVQGESDSISPLLLHLEDDDFSENEKQLAEPASEPDVLKIVIDSEIKDSLLSNKKAIDGGKNTSGLPAEPESVSSPPTLHMKTGLENSNSTDTLWRPMPKLAPLGLKVANPSSDADGQSLKVMPCLAPIAAKVGSVGHKMNLTGNDQEGRESKVMPTLAPVVAKLGNSGASPSSAGK

SEQ ID NO: 8652 - protein, 1086 aa, Homo Sapiens
MEEKQQIILANQDGGTVAGAAPTFFVILKQPGNGKTDQGILVTNQDACALASSVSSPVKSKGKICLPADCTVGGITVTLDNNSMWNEFYHRSTEMILTKQGRRMFPYCRYWITGLDSNLKYILVMDISPVDNHRYKWNGRWWEPSGKAEPHVLGRVFIHPESPSTGHYWMHQPVSFYKLKLTNNTLDQEGHIILHSMHRYLPRLHLVPAEKAVEVIQLNGPGVHTFTFPQTEFFAVTAYQNIQITQLKIDYNPFAKGFRDDGLNNKPQRDGKQKNSSDQEGNNISSSSGHRVRLTEGQGSEIQPGDLDPLSRGHETSGKGLEKTSLNIKRDFLGFMDTDSALSEVPQLKQEISECLIASSFEDDSRVASPLDQNGSFNVVIKEEPLDDYDYELGECPEGVTVKQEETDEETDVYSNSDDDPILEKQLKRHNKVDNPEADHLSSKWLPSSPSGVAKAKMFKLDTGKMPVVYLEPCAVTRSTVKISELPDNMLSTSRKDKSSMLAELEYLPTYIENSNETAFCLGKESENGLRKHSPDLRVVQKYPLLKEPQWKYPDISDSISTERILDDSKDSVGDSLSGKEDLGRKRTTMLKIATAAKVVNANQNASPNVPGKRGRPRKLKLCKAGRPPKNTGKSLISTKNTPVSPGSTFPDVKPDLEDVDGVLFVSFESKEALDIHAVDGTTEESSSLQASTTNDSGYRARISQLEKELIEDLKTLRHKQVIHPGLQEVGLKLNSVDPTMSIDLKYLGVQLPLAPATSFPFWNLTGTNPASPDAGFPFVSRTGKTNDFTKIKGWRGKFHSASASRNEGGNSESSLKNRSAFCSDKLDEYLENEGKLMETSMGFSSNAPTSPVVYQLPTKSTSYVRTLDSVLKKQSTISPSTSYSLKPHSVPPVSRKAKSQNRQATFSGRTKSSYKSILPYPVSPKQKYSHVILGDKVTKNSSGIISENQANNFVVPTLDENIFPKQISLRQAQQQQQQQQGSRPPGLSKSQVKLMDLEDCALWEGKPRTYITEERADVSLTTLLTAQASLKTKPIHTIIRKRAPPCNNDFCRLGCVCSSLALEKRQPAHCRRPDCMFGCTCLKRK

SEQ ID NO: 8653 - protein, 1138 aa, Homo Sapiens
MEEKQQIILANQDGGTVAGAAPTFFVILKQPGNGKTDQGILVTNQDACALASSVSSPVKSKGKICLPADCTVGGITVTLDNNSMWNEFYHRSTEMILTKQGRRMFPYCRYWITGLDSNLKYILVMDISPVDNHRYKWNGRWWEPSGKAEPHVLGRVFIHPESPSTGHYWMHQPVSFYKLKLTNNTLDQEGHIILHSMHRYLPRLHLVPAEKAVEVIQLNGPGVHTFTFPQTEFFAVTAYQNIQITQLKIDYNPFAKGFRDDGLNNKPQRDGKQKNSSDQEGNNISSSSGHRVRLTEGQGSEIQPGDLDPLSRGHETSGKGLEKTSLNIKRDFLGFMDTDSALSEVPQLKQEISECLIASSFEDDSRVASPLDQNGSFNVVIKEEPLDDYDYELGECPEGVTVKQEETDEETDVYSNSDDDPILEKQLKRHNKVDNPEADHLSSKWLPSSPSGVAKAKMFKLDTGKMPVVYLEPCAVTRSTVKISELPDNMLSTSRKDKSSMLAELEYLPTYIENSNETAFCLGKESENGLRKHSPDLRVVQKYPLLKEPQWKYPDISDSISTERILDDSKDSVGDSLSGKEDLGRKRTTMLKIATAAKVVNANQNASPNVPGKRGRPRKLKLCKAGRPPKNTGKSLISTKNTPVSPGSTFPDVKPDLEDVDGVLFVSFESKEALDIHAVDGTTEESSSLQASTTNDSGYRARISQLEKELIEDLKTLRHKQVIHPGLQEVGLKLNSVDPTMSIDLKYLGVQLPLAPATSFPFWNLTGTNPASPDAGFPFVSRTGKTNDFTKIKGWRGKFHSASASRNEGGNSESSLKNRSAFCSDKLDEYLENEGKLMETSMGFSSNAPTSPVVYQLPTKSTSYVRTLDSVLKKQSTISPSTSYSLKPHSVPPVSRKAKSQNRQATFSGRTKSSYKSILPYPVSPKQKYSHVILGDKVTKNSSGIISENQANNFVVPTLDENIFPKQISLRQAQQQQQQQQGSRPPGLSKSQVKLMDLEDCALWEGKPRTYITEERADVSLTTLLTAQASLKTKPIHTIIRKRAPPCNNDFCRLGCVCSSLALEKRQPAHCRRPDCMFGCTCLKRKVVLVKGGSKTKHFQRKAAHRDPVFYDTLGEEAREEEEGIREEEEQLKEKKKR

SEQ ID NO: 8654 - protein, 2856 aa, Homo Sapiens
MEEKQQIILANQDGGTVAGAAPTFFVILKQPGNGKTDQGILVTNQDACALASSVSSPVKSKGKICLPADCTVGGITVTLDNNSMWNEFYHRSTEMILTKQGRRMFPYCRYWITGLDSNLKYILVMDISPVDNHRYKWNGRWWEPSGKAEPHVLGRVFIHPESPSTGHYWMHQPVSFYKLKLTNNTLDQEGHIILHSMHRYLPRLHLVPAEKAVEVIQLNGPGVHTFTFPQTEFFAVTAYQNIQITQLKIDYNPFAKGFRDDGLNNKPQRDGKQKNSSDQEGNNISSSSGHRVRLTEGQGSEIQPGDLDPLSRGHETSGKGLEKTSLNIKRDFLGFMDTDSALSEVPQLKQEISECLIASSFEDDSRVASPLDQNGSFNVVIKEEPLDDYDYELGECPEGVTVKQEETDEETDVYSNSDDDPILEKQLKRHNKVDNPEADHLSSKWLPSSPSGVAKAKMFKLDTGKMPVVYLEPCAVTRSTVKISELPDNMLSTSRKDKSSMLAELEYLPTYIENSNETAFCLGKESENGLRKHSPDLRVVQKYPLLKEPQWKYPDISDSISTERILDDSKDSVGDSLSGKEDLGRKRTTMLKIATAAKVVNANQNASPNVPGKRGRPRKLKLCKAGRPPKNTGKSLISTKNTPVSPGSTFPDVKPDLEDVDGVLFVSFESKEALDIHAVDGTTEESSSLQASTTNDSGYRARISQLEKELIEDLKTLRHKQVIHPGLQEVGLKLNSVDPTMSIDLKYLGVQLPLAPATSFPFWNLTGTNPASPDAGFPFVSRTGKTNDFTKIKGWRGKFHSASASRNEGGNSESSLKNRSAFCSDKLDEYLENEGKLMETSMGFSSNAPTSPVVYQLPTKSTSYVRTLDSVLKKQSTISPSTSYSLKPHSVPPVSRKAKSQNRQATFSGRTKSSYKSILPYPVSPKQKYSHVILGDKVTKNSSGIISENQANNFVVPTLDENIFPKQISLRQAQQQQQQQQGSRPPGLSKSQVKLMDLEDCALWEGKPRTYITEERADVSLTTLLTAQASLKTKPIHTIIRKRAPPCNNDFCRLGCVCSSLALEKRQPAHCRRPDCMFGCTCLKRKVVLVKGGSKTKHFQRKAAHRDPVFYDTLGEEAREEEEGIREEEEQLKEKKKRKKLEYTICETEPEQPVRHYPLWVKVEGEVDPEPVYIPTPSVIEPMKPLLLPQPEVLSPTVKGKLLTGIKSPRSYTPKPNPVIREEDKDPVYLYFESMMTCARVRVYERKKEDQRQPSSSSSPSPSFQQQTSCHSSPENHNNAKEPDSEQQPLKQLTCDLEDDSDKLQEKSWKSSCNEGESSSTSYMHQRSPGGPTKLIEIISDCNWEEDRNKILSILSQHINSNMPQSLKVGSFIIELASQRKSRGEKNPPVYSSRVKISMPSCQDQDDMAEKSGSETPDGPLSPGKMEDISPVQTDALDSVRERLHGGKGLPFYAGLSPAGKLVAYKRKPSSSTSGLIQVASNAKVAASRKPRTLLPSTSNSKMASSSGTATNRPGKNLKAFVPAKRPIENAAQIPVATPQVSPNTVKRAGPRLLLIPVQQGSPTLRPVSNTQLQGHRMVLQPVRSPSGMNLFRHPNGQIVQLLPLHQLRGSNTQPNLQPVMFRNPGSVMGIRLPAPSKPSETPPSSTSSSAFSVMNPVIQAVGSSSAVNVITQAPSLLSSGASFVSQAGTLTLRISPPEPQSFASKTGSETKITYSSGGQPVGTASLIPLQSGSFALLQLPGQKPVPSSILQHVASLQMKRESQNPDQKDETNSIKREQETKKVLQSEGEAVDPEANVIKQNSGAATSEETLNDSLEDRGDHLDEECLPEEGCATVKPSEHSCITGSHTDQDYKDVNEEYGARNRKSSKEKVAVLEVRTISEKASNKTVQNLSKVQHQKLGDVKVEQQKGFDNPEENSSEFPVTFKEESKFELSGSKVMEQQSNLQPEAKEKECGDSLEKDRERWRKHLKGPLTRKCVGASQECKKEADEQLIKETKTCQENSDVFQQEQGISDLLGKSGITEDARVLKTECDSWSRISNPSAFSIVPRRAAKSSRGNGHFQGHLLLPGEQIQPKQEKKGGRSSADFTVLDLEEDDEDDNEKTDDSIDEIVDVVSDYQSEEVDDVEKNNCVEYIEDDEEHVDIETVEELSEEINVAHLKTTAAHTQSFKQPSCTHISADEKAAERSRKAPPIPLKLKPDYWSDKLQKEAEAFAYYRRTHTANERRRRGEMRDLFEKLKITLGLLHSSKVSKSLILTRAFSEIQGLTDQADKLIGQKNLLTRKRNILIRKVSSLSGKTEEVVLKKLEYIYAKQQALEAQKRKKKMGSDEFDISPRISKQQEGSSASSVDLGQMFINNRRGKPLILSRKKDQATENTSPLNTPHTSANLVMTPQGQLLTLKGPLFSGPVVAVSPDLLESDLKPQVAGSAVALPENDDLFMMPRIVNVTSLATEGGLVDMGGSKYPHEVPDSKPSDHLKDTVRNEDNSLEDKGRISSRGNRDGRVTLGPTQVFLANKDSGYPQIVDVSNMQKAQEFLPKKISGDMRGIQYKWKESESRGERVKSKDSSFHKLKMKDLKDSSIEMELRKVTSAIEEAALDSSELLTNMEDEDDTDETLTSLLNEIAFLNQQLNDDSVGLAELPSSMDTEFPGDARRAFISKVPPGSRATFQVEHLGTGLKELPDVQGESDSISPLLLHLEDDDFSENEKQLAEPASEPDVLKIVIDSEIKDSLLSNKKAIDGGKNTSGLPAEPESVSSPPTLHMKTGLENSNSTDTLWRPMPKLAPLGLKVANPSSDADGQSLKVMPCLAPIAAKVGSVGHKMNLTGNDQEGRESKVMPTLAPVVAKLGNSGASPSSAGK

SEQ ID NO: 8655 - protein, 3065 aa, Homo Sapiens; identical to SEQ ID NO: 8651

SEQ ID NO: 8656 - protein, 2856 aa, Homo Sapiens; identical to SEQ ID NO: 8654

SEQ ID NO: 8657 - protein, 61 aa, Homo Sapiens [sequence omitted]

SEQ ID NO: 8658 - protein, 83 aa, Homo Sapiens
  misc_feature (1)..(1): Xaa can be any naturally occurring amino acid
XDQEGNNISSSSGHRVRLTEGQGSEIQPGDLDPLSRGHETSGKGLEKTSLNIKRDFLGFMDTDSALSEVPQLKQEISEWYSFA

SEQ ID NO: 8659 - protein, 1174 aa, Homo Sapiens
  misc_feature (1)..(1): Xaa can be any naturally occurring amino acid
XLTCDLEDDSDKLQEKSWKSSCNEGESSSTSYMHQRSPGGPTKLIEIISDCNWEEDRNKILSILSQHINSNMPQSLKVNGKSYPQAKLLLGQMGALHPANRLAAYITGRLRPSVLDLSTLSTVISKVASNAKVAASRKPRTLLPSTSNSKMASSSGTATNRPGKNLKAFVPAKRPIAARPSPGGVFTQFVMSKVGALQQKIPGVSTPQTLAGTQKFSIRPSPVMVVTPVVSSEPVQVCSPVTAAVTTTTPQVFLENTTAVTPMTAISDVETKETTYSSGATTTGVVEVSETNTSTSVTSTQSTATVNLTKTTGITTPVASVAFPKSLVASPSTITLPVASTASTSLVVVTAAASSSMVTTPTSSLGSVPIILSGINGSPPVSQRPENAAQIPVATPQVSPNTVKRAGPRLLLIPVQQGSPTLRPVSNTQLQGHRMVLQPVRSPSGMNLFRHPNGQIVQLLPLHQLRGSNTQPNLQPVMFRNPGSVMGIRLPAPSKPSETPPSSTSSSAFSVMNPVIQAVGSSSAVNVITQAPSLLSSGASFVSQAGTLTLRISPPEPQSFASKTGSETKITYSSGGQPVGTASLIPLQSGSFALLQLPGQKPVPSSILQHVASLQMKRESQNPDQKDETNSIKREQETKKVLQSEGEAVDPEANVIKQNSGAATSEETLNDSLEDRGDHLDEECLPEEGCATVKPSEHSCITGSHTDQDYKDVNEEYGARNRKSSKEKVAVLEVRTISEKASNKTVQNLSKVQHQKLGDVKVEQQKGFDNPEENSSEFPVTFKEESKFELSGSKVMEQQSNLQPEAKEKECGDSLEKDRERWRKHLKGPLTRKCVGASQECKKEADEQLIKETKTCQENSDVFQQEQGISDLLGKSGITEDARVLKTECDSWSRISNPSAFSIVPRRAAKSSRGNGHFQGHLLLPGEQIQPKQEKKGGRSSADFTVLDLEEDDEDDNEKTDDSIDEIVDVVSDYQSEEVDDVEKNNCVEYIEDDEEHVDIETVEELSEEINVAHLKTTAAHTQSFKQPSCTHISADEKAAERSRKAPPIPLKLKPDYWSDKLQKEAEAFAYYRRTHTANERRRRGEMRDLFEKLKITLGLLHSSKVSKSLILTRAFSEIQGLTDQADKLIGQKNLLTRKRNILIRKVSSLSGKTEEVVLKKLEYIYAKQQALEA

SEQ ID NO: 8660 - protein, 447 aa, Homo Sapiens
MRFRIYKRKVLILTLVVAACGFVLWSSNGRQRKNEALAPPLLDAEPARGAGGRGGDHPSVAVGIRRVSNVSAASLVPAVPQPEADNLTLRYRSLVYQLNFDQTLRNVDKAGTWAPRELVLVVQVHNRPEYLRLLLDSLRKAQGIDNVLVIFSHDFWSTEINQLIAGVNFCPVLQVFFPFSIQLYPNEFPGSDPRDCPRDLPKNAALKLGCINAEYPDSFGHYREAKFSQTKHHWWWKLHFVWERVKILRDYAGLILFLEEDHYLAPDFYHVFKKMWKLKQQECPECDVLSLGTYSASRSFYGMADKVDVKTWKSTEHNMGLALTRNAYQKLIECTDTFCTYDDYNWDWTLQYLTVSCLPKFWKVLVPQIPRIFHAGDCGMHHKKTCRPSTQSAQIESLLNNNKQYMFPETLTISEKFTVVAISPPRKNGGWGDIRDHELCKSYRRLQ

SEQ ID NO: 8661 - protein, 108 aa, Homo Sapiens
MESCSCHPGSGVQWRDHGSLQLPPPGFKMKMRRYKLFLMFCMAGLCLISFLHFFKTLSYVTFPRELASLSPNLVSSFFWNNAPVTPQASPEPGGPDLLRTPLYSHSPL

SEQ ID NO: 8662 - protein, 161 aa, Homo Sapiens
MKMRRYKLFLMFCMAGLCLISFLHFFKTLSYVTFPRELASLSPNLVSSFFWNNAPVTPQASPEPGGPDLLRTPLYSHSPLLQPLPPSKAAEELHRVDLVLPEDTTEYFVRTKAGGVCFKPGTKMLERPPPGRPEEKPEGANGSSARRPPRYLLSARERTGG

SEQ ID NO: 8663 - protein, 533 aa, Homo Sapiens
MKMRRYKLFLMFCMAGLCLISFLHFFKTLSYVTFPRELASLSPNLVSSFFWNNAPVTPQASPEPGGPDLLRTPLYSHSPLLQPLPPSKAAEELHRVDLVLPEDTTEYFVRTKAGGVCFKPGTKMLERPPPGRPEEKPEGANGSSARRPPRYLLSARERTGGRGARRKWVECVCLPGWHGPSCGVPTVVQYSNLPTKERLVPREVPRRVINAINVNHEFDLLDVRFHELGDVVDAFVVCESNFTAYGEPRPLKFREMLTNGTFEYIRHKVLYVFLDHFPPGGRQDGWIADDYLRTFLTQDGVSRLRNLRPDDVFIIDDADEIPARDGVLFLKLYDGWTEPFAFHMRKSLYGFFWKQPGTLEVVSGCTVDMLQAVYGLDGIRLRRRQYYTMPNFRQYENRTGHILVQWSLGSPLHFAGWHCSWCFTPEGIYFKLVSAQNGDFPRWGDYEDKRDLNYIRGLIRTGGWFDGTQQEYPPADPSEHMYAPKYLLKNYDRFHYLLDNPYQEPRSTAAGGWRHRGPEGRPPARGKLDEAEV

SEQ ID NO: 8664 - protein, 423 aa, Homo Sapiens
MNYSITVSIVMGIPTVKREVKSYLIETLHSLIDNLYPEEKLDCVIVVFIGETDIDYVHGVVANLEKEFSKEISSGLVEVISPPESYYPDLTNLKETFGDSKERVRWRTKQNLDYCFLMMYAQEKGIYYIQLEDDIIVKQNYFNTIKNFALQLSSEEWMILEFSQLGFIGKMFQAPDLTLIVEFIFMFYKEKPIDWLLDHILWVKVCNPEKDAKHCDRQKANLRIRFRPSLFQHVGLHSSLSGKIQKLTDKDYMKPLLLKIHVNPPAEVSTSLKVYQGHTLEKTYMGEDFFWAITPIAGDYILFKFDKPVNVESYLFHSGNQEHPGDILLNTTVEVLPFKSEGLEISKETKDKRLEDGYFRIGKFENGVAEGMVDPSLNPISAFRLSVIQNSAVWAILNEQRVFSGWWQKSRDKAEGPQAPLLF

SEQ ID NO: 8665 - protein, 535 aa, Homo Sapiens
MRLRNGTVATALAFITSFLTLSWYTTWQNGKEKLIAYQREFLALKERLRIAEHRISQRSSELNTIVQQFKRVGAETNGSKDALNKFSDNTLKLLKELTSKKSLQVPSIYYHLPHLLKNEGSLQPAVQIGNGRTGVSIVMGIPTVKREVKSYLIETLHSLIDNLYPEEKLDCVIVVFIGETDIDYVHGVVANLEKEFSKEISSGLVEVISPPESYYPDLTNLKETFGDSKERVRWRTKQNLDYCFLMMYAQEKGIYYIQLEDDIIVKQNYFNTIKNFALQLSSEEWMILEFSQLGFIGKMFQAPDLTLIVEFIFMFYKEKPIDWLLDHILWVKVCNPEKDAKHCDRQKANLRIRFRPSLFQHVGLHSSLSGKIQKLTDKDYMKPLLLKIHVNPPAEVSTSLKVYQGHTLEKTYMGEDFFWAITPIAGDYILFKFDKPVNVESYLFHSGNQEHPGDILLNTTVEVLPFKSEGLEISKETKDKRLEDGYFRIGKFENGVAEGMVDPSLNPISAFRLSVIQNSAVWAILNEIHIKKATN

SEQ ID NO: 8666 - protein, 535 aa, Homo Sapiens; identical to SEQ ID NO: 8665

SEQ ID NO: 8667 - protein, 535 aa, Homo Sapiens; identical to SEQ ID NO: 8665

SEQ ID NO: 8668 - protein, 44 aa, Homo Sapiens
MRLRNGTVATALAFITSFLTLSWYTTWQNGKGKENDSENVHEMY

SEQ ID NO: 8669 - protein, 200 aa, Homo Sapiens
MGIPSVRREVHSYLTDTLHSLISELSPQEKEDSVIVVLIAETDSQYTSAVTENIKALFPTEIHSGLLEVISPSPHFYPDFSRLRESFGDPKERVRWRTKQNLDYCFLMMYAQSKGIYYVQLEDDIVAKPNYLSTMKNFALQQPSEDWMILEFSQLGFIGKMFKSLDLSLIVEFILMFYRDKPIDWLLDHILWVKVCNPEK

SEQ ID NO: 8670 - protein, 548 aa, Homo Sapiens
MRLRNGTFLTLLLFCLCAFLSLSWYAALSGQKGDVVDVYQREFLALRDRLHAAEQESLKRSKELNLVLDEIKRAVSERQALRDGDGNRTWGRLTEDPRLKPWNGSHRHVLHLPTVFHHLPHLLAKESSLQPAVRVGQGRTGVSVVMGIPSVRREVHSYLTDTLHSLISELSPQEKEDSVIVVLIAETDSQYTSAVTENIKALFPTEIHSGLLEVISPSPHFYPDFSRLRESFGDPKERVRWRTKQNLDYCFLMMYAQSKGIYYVQLEDDIVAKPNYLSTMKNFALQQPSEDWMILEFSQLGFIGKMFKSLDLSLIVEFILMFYRDKPIDWLLDHILWVKVCNPEKDAKHCDRQKANLRIRFKPSLFQHVGTHSSLAGKIQKLKDKDFGKQALRKEHVNPPAEVSTSLKTYQHFTLEKAYLREDFFWAFTPAAGDFIRFRFFQPLRLERFFFRSGNIEHPEDKLFNTSVEVLPFDNPQSDKEALQEGRTATLRYPRSPDGYLQIGSFYKGVAEGEVDPAFGPLEALRLSIQTDSPVWVILSEIFLKKAD

SEQ ID NO: 8671 - protein, 157 aa, Homo Sapiens
MSRVAGTRTDVNELLQRWTPRCVRWHTGGARRVALDRPLVTACLPPAGDVVDVYQREFLALRDRLHAAEQESLKRSKELNLVLDEIKRAVSERQALRDGDGNRTWGRLTEDPRLKPWNGSHRHVLHLPTVFHHLPHLLAKESSLQPAVRVGQGRTGD

SEQ ID NO: 8672 - protein, 563 aa, Homo Sapiens
MSRVAGTRTDVNELLQRWTPRCVRWHTGGARRVALDRPLVTACLPPAGDVVDVYQREFLALRDRLHAAEQESLKRSKELNLVLDEIKRAVSERQALRDGDGNRTWGRLTEDPRLKPWNGSHRHVLHLPTVFHHLPHLLAKESSLQPAVRVGQGRTGVSVVMGIPSVRREVHSYLTDTLHSLISELSPQEKEDSVIVVLIAETDSQYTSAVTENIKALFPTEIHSGLLEVISPSPHFYPDFSRLRESFGDPKERVRWRTKQNLDYCFLMMYAQSKGIYYVQLEDDIVAKPNYLSTMKNFALQQPSEDWMILEFSQLGFIGKMFKSLDLSLIVEFILMFYRDKPIDWLLDHILWVKVCNPEKDAKHCDRQKANLRIRFKPSLFQHVGTHSSLAGKIQKLKDKDFGKQALRKEHVNPPAEVSTSLKTYQHFTLEKAYLREDFFWAFTPAAGDFIRFRFFQPLRLERFFFRSGNIEHPEDKLFNTSVEVLPFDNPQSDKEALQEGRTATLRYPRSPDGYLQIGSFYKGVAEGEVDPAFGPLEALRLSIQTDSPVWVILSEIFLKKAD

SEQ ID NO: 8673 - protein, 373 aa, Homo Sapiens
  misc_feature (1)..(1): Xaa can be any naturally occurring amino acid
XEDSVIVVLIAETDSQYTSAVTENIKALFPTEIHSGLLEVISPSPHFYPDFSRLRESFGDPKERVRWRTKQNLDYCFLMMYAQSKGIYYVQLEDDIVAKPNYLSTMKNFALQQPSEDWMILEFSQLGFIGKMFKSLDLSLIVEFILMFYRDKPIDWLLDHILWVKVCNPEKDAHCDRQKANLRIRFKPSLFQHVGTHSSLAGKIQKLKDKDFGKQALRKEHVNPPAEVSTSLKTYQHFTLEKAYLREDFFWAFTPAAGDFIRFRFFQPLRLERFFFRSGNIEHPEDKLFNTSVEVLPFDNPQSDKEALQEGRTATLRYPRSPDGYLQIGSFYKGVAEGEVDPAFGPLEALRLSIQTDSPVWVILSEIFLKKAD

SEQ ID NO: 8674 - protein, 429 aa, Homo Sapiens
  misc_feature (1)..(1): Xaa can be any naturally occurring amino acid
XEQESLKRSKELNLVLDEIKRAVSERQALRDGDGNRTWGRLTEDPRLKPWNGSHRHVLHLPTVFHHLPHLLAKESSLQPAVRVGQGRTGVSVVMGIPSVRREVHSYLTDTLHSLISELSPQEKEDSVIVVLIAETDSQYTSAVTENIKALFPTEIHSGLLEVISPSPHFYPDFSRLRESFGDPKERVRWRTKQNLDYCFLMMYAQSKGIYYVQLEDDIVAKPNYLSTMKNFALQQPSEDWMILEFSQLGFIGQRLWKAGAAEGACEPASRGEHEPEDIPALHPGESLPARGLLLGLHPCRGGLHPLPLLPTSKTGAVLLPQWEHRAPGGQALQHVCGGAALRQPSVRQGGPAGGPHRHPPVPSEPRRLPPDRLLLQGSGRGRGGPSLRPSGSTAPLDPDGLPCVGDSERDLPEKGRLSCGLLRVPCGQP

SEQ ID NO: 8675 - protein, 322 aa, Homo Sapiens
  misc_feature (1)..(1): Xaa can be any naturally occurring amino acid
XFPTEIHSGLLEVISPSPHFYPDFSRLRESFGDPKERVRWRTKQNLDYCFLMMYAQSKGIYYVQLEDDIVAKPNYLSTMKNFALQQPSEDWMILEFSQLGFIGKMFKSLDLSLIVEFILMFYRDKPIDWLLDHILWVKVCNPEKDAAGIKVGAHAITAVPPPLQDKDFGKQALRKEHVNPPAEVSTSLKTYQHFTLEKAYLREDFFWAFTPAAGDFIRFRFFQPLRLERFFFRSGNIEHPEDKLFNTSVEVLPFDNPQSDKEALQEGRTATLRYPRSPDGYLQIGSFYKGVAEGEVDPAFGPLEALRLSIQTDSPVWVILSE

SEQ ID NO: 8676 - protein, 240 aa, Homo Sapiens
  misc_feature (1)..(1): Xaa can be any naturally occurring amino acid
XKMFKSLDLSLIVEFILMFYRDKPIDWLLDHILWVKVCNPEKDAKHCDRQKANLRIRFKPSLFQHVGTHSSLAGKIQKLKDKDFGKQALRKEHVNPPAEVSTSLKTYQHFTLEKAYLREDFFWAFTPAAGDFIRFRFFQPLRLERGNIEHPEDKLFNTSVEVLPFDNPQSDKEALQEGRTATLRYPRSPDGYLQIGSFYKGVAEGEVDPAFGPLEALRLSIQTDSPVWVILSEIFLKKAD

SEQ ID NO: 8677 - protein, 150 aa, Homo Sapiens
  misc_feature (1)..(1): Xaa can be any naturally occurring amino acid
XLLLFCLCAFLSLSWYAALSGQKGDVVDVYQREFLALRDRLHAAEQESLKRSKELNLVLDEIKRAVSERQALRDGDGNRTWGRLTGPPIEAVERLTPARAAPAHRLPSPATPAGQGEQSAARGARGPGPHRSVGGDGHPERAARGALVPD

SEQ ID NO: 8678 - protein, 245 aa, Homo Sapiens
  misc_feature (1)..(1): Xaa can be any naturally occurring amino acid
XQYTSAVTENIKALFPTEIHSGLLEVISPSPHFYPDFSRLRESFGDPKERVRWRTKQNLDYCFLMMYAQSKGIYYVQLEDDIVAKPNYLSTMKNFALQQPSEDWMILEFSQLGFIGKMFKSLDLSLIVEFILMFYRDKPIDWLLDHILWVKVCNPEKDAKHCDRQKANLRIRFKPSLFQHVGTHSSLAGKIQKLKDKDFGKQALRKEHVNPPAEWEHRAPGGQALQHVCGGAALRQPSVRQGGPA

SEQ ID NO: 8679 - protein, 307 aa, Homo Sapiens
  misc_feature (1)..(1): Xaa can be any naturally occurring amino acid
XTSAVTENIKALFPTEIHSGLLEVISPSPHFYPDFSRLRESFGDPKERVRWRTKQNLDYCFLMMYAQSKGIYYVQLEDDIVAKPNYLSTMKNFALQQPSEDWMILEFSQLGFIARGHSLLAGWQDPETEGQRLWKAGAAEGACEPASRGEHEPEDIPALHPGESLPARGLLLGLHPCRGGLHPLPLLPTSKTGAVLLPQWEHRAPGGQALQHVCGGAALRQPSVRQGGPAGGPHRHPPVPSEPRRLPPDRLLLQGSGRGRGGPSLRPSGSTAPLDPDGLPCVGDSERDLPEKGRLSCGLLRVPCGQP

SEQ ID NO: 8680 - protein, 113 aa, Homo Sapiens
MRTKQVNLLITLVAVALFSFSCFSIYRITQTISFALGISTVNRGNYSYLKQTLTSVVSRMTLSQEKDSVVIVLVADSNEDYLHSVVKMITKKFKRQVRSGSLEVISIPAFLYS

SEQ ID NO: 8681 - protein, 166 aa, Homo Sapiens
MRTKQVNLLITLVAVALFSFSCFSIYRITQTNNQLINCRNHILEFKENMLHLRNKTEKNTQEMMKVLNRMKYEITKREILSGNLGKLFRSEDLTHFVRFFLMFYKEKPIDWLLNDIFQVKVCDAGEDLRNCMKRKKQIRIQYKPSLFQHVGIHSSFPRKEQYEKKI

SEQ ID NO: 8682 - protein, 375 aa, Homo Sapiens
MRTKQVNLLITLVAVALFSFSCFSIYRITQTNNQLINCRNHILEFKENMLHLRNKTEKNTQEMMKVLNRMKYEITKREILSGNLVAQKADILNKNETVSNTFEDLKFFFPHLRKEGRIYPDVIIGKGKTGVSFALGISTVNRGNYSYLKQTLTSVVSRMTLSQEKDSVVIVLVADSNEDYLHSVVKMITKKFKRQVRSGSLEVISIPAFLYSSMLNAKHLAEASQKLASWRIKQVLDFCILLLYAQPKAKYYLQLEDDIIAKEMYFTKITDFVGNISSNNWFFIEFSMLGFIGKLFRSEDLTHFVRFFLMFYKEKPIDWLLNDIFQVKVCDAGEDLRNCMKRKKQIRIQYKPSLFQHVGIHSSFPRKEQYEKDVY

SEQ ID NO: 8683 - protein, 374 aa, Homo Sapiens
MRTKQVNLLITLVAVALFSFSCFSIYRITQTNNQLINCRNHILEFKENMLHLRNKTEKNTQEMMKVLNRMKYEITKREILSGNLVAQKADILNKNETVSNTFEDLKFFFPHLRKEGRIYPDVIIGKGKTGVSFALGISTVNRGNYSYLKQTLTSVVSRMTLSQEKDSVVIVLVADSNEDYLHSVVKMITKKFKRQVRSGSLEVISIPAFLYSSMLNAKHLAEASQKLASWRIKQVLDFCILLLYAQPKAKYYLQLEDDIIAKEMYFTKITDFVGNISSNNWFFIEFSMLGFIGKLFRSEDLTHFVRFFLMFYKEKPIDWLLNDIFQVKVCDAGEDLRNCMKRKKQIRIQYKPSLFQHVGIHSSFPRKEQYEKKI

SEQ ID NO: 8684 - protein, 36 aa, Homo Sapiens
MRTKQVNLLITLVAVALFSFSCFSIYRITQTNSKGK

SEQ ID NO: 8685 - protein, 91 aa, Homo Sapiens
  misc_feature (1)..(1): Xaa can be any naturally occurring amino acid
XNISSNNWFFIEFSMLGFIGKLFRSEDLTHFVRFFLMFYKEKPIDWLLNDIFQRNCMKRKKQIRIQYKPSLFQHVGIHSSFPRKEQYEKKI

SEQ ID NO: 8686 - protein, 283 aa, Homo Sapiens
METGPEDPSSMPEESSPRRTPQSIPYQDLPHLVNADGQYLFCRYWKPTGTPKALIFVSHGAGEHSGRYEELARMLMGLDLLVFAHDHVGHGQSEGERMVVSDFHVFVRDVLQHVDSMQKDYPGLPVFLLGHSMGGAIAILTAAERPGHFAGMVLISPLVLANPESATTFKVDIYNSDPLICRAGLKVCFGIQLLNAVSRVERALPKLTVPFLLLQGSADRLCDSKGAYLLMELAKSQDKTLKIYEGAYHVLHKELPEVTNSVFHEINMWVSQRTATAGTASPP

SEQ ID NO: 8687 - protein, 313 aa, Homo Sapiens
METGPEDPSSMPEESSPRRTPQSIPYQDLPHLVNADGQYLFCRYWKPTGTPKALIFVSHGAGEHSGRYEELARMLMGLDLLVFAHDHVGHGQSEGERMVVSDFHVFVRDVLQHVDSMQKDYPGLPVFLLGHSMGGAIAILTAAERPGHFAGMVLISPLVLANPESATTFKVLAAKVLNLVLPNLSLGPIDSSVLSRNKTEVDIYNSDPLICRAGLKVCFGIQLLNAVSRVERALPKLTVPFLLLQGSADRLCDSKGAYLLMELAKSQDKTLKIYEGAYHVLHKELPEVTNSVFHEINMWVSQRTATAGTASPP

SEQ ID NO: 8688 - protein, 89 aa, Homo Sapiens
MLMGLDLLVFAHDHVGHGQSEGERMVVSDFHVFVRDVLQHVDSMQKDYPGLPVFLLGHSMGGAIAILTAAERPGHFAGMVLISPLVLAN

SEQ ID NO: 8689 - protein, 77 aa, Homo Sapiens
MPEESSPRRTPQSIPYQDLPHLVNADGQYLFCRYWKPTGTPKALIFVSHGAGEHSGRYEELARMLMGLDLLVFAHDH

SEQ ID NO: 8690 - protein, 303 aa, Homo Sapiens
MPEESSPRRTPQSIPYQDLPHLVNADGQYLFCRYWKPTGTPKALIFVSHGAGEHSGRYEELARMLMGLDLLVFAHDHVGHGQSEGERMVVSDFHVFVRDVLQHVDSMQKDYPGLPVFLLGHSMGGAIAILTAAERPGHFAGMVLISPLVLANPESATTFKVLAAKVLNLVLPNLSLGPIDSSVLSRNKTEVDIYNSDPLICRAGLKVCFGIQLLNAVSRVERALPKLTVPFLLLQGSADRLCDSKGAYLLMELAKSQDKTLKIYEGAYHVLHKELPEVTNSVFHEINMWVSQRTATAGTASPP

SEQ ID NO: 8691 - protein, 303 aa, Homo Sapiens; identical to SEQ ID NO: 8690

SEQ ID NO: 8692 - protein, 277 aa, Homo Sapiens
MQTRFRRIFPWKDASTKRMPEFIHFSPLKPYKGREWEKAGSEHVLETHLLPVGHGQSEGERMVVSDFHVFVRDVLQHVDSMQKDYPGLPVFLLGHSMGGAIAILTAAERPGHFAGMVLISPLVLANPESATTFKVLAAKVLNLVLPNLSLGPIDSSVLSRNKTEVDIYNSDPLICRAGLKVCFGIQLLNAVSRVERALPKLTVPFLLLQGSADRLCDSKGAYLLMELAKSQDKTLKIYEGAYHVLHKELPEVTNSVFHEINMWVSQRTATAGTASPP

SEQ ID NO: 8693 - protein, 197 aa, Homo Sapiens
PVGHGQSEGERMVVSDFHVFVRDVLQHVDSMQKDYPGLPVFLLGHSMGGAIAILTAAERPGHFAGMVLISPLVLANPESATTFKVDIYNSDPLICRAGLKVCFGIQLLNAVSRVERALPKLTVPFLLLQGSADRLCDSKGAYLLMELAKSQDKTLKIYEGAYHVLHKELPEVTNSVFHEINMWVSQRTATAGTASPP

SEQ ID NO: 8694 - protein, 155 aa, Homo Sapiens [sequence omitted]

SEQ ID NO: 8695 - protein, 209 aa, Homo Sapiens
  misc_feature (1)..(1): Xaa can be any naturally occurring amino acid
XLQGGAIAILTAAERPGHFAGMVLISPLVLANPESATTFKDYSRILKHLMEKASRMLKFWIPRPFWVLAAKVLNLVLPNLSLGPIDSSVLSRNKTEVDIYNSDPLICRAGLKVCFGIQLLNAVSRVERALPKLTVPFLLLQGSADRLCDSKGAYLLMELAKSQDKTLKIYEGAYHVLHKELPEVTNSVFHEINMWVSQRTATAGTASPP

SEQ ID NO: 8696 - protein, 103 aa, Homo Sapiens
MKSLILLAILAALAVVTLCYESHESMESYELNPFINRRNANTFISPQQRWRAKVQERIRERSKPVHELNREACDDYRLCERYAMVYGYNAAYNRYFRKRRGTK

SEQ ID NO: 8697 - protein, 128 aa, Homo Sapiens
MKSLILLAILAALAVVTLCYGEWQKEENFGFDIVSVLSLNWHRAQESHESMESYELNPFINRRNANTFISPQQRWRAKVQERIRERSKPVHELNREACDDYRLCERYAMVYGYNAAYNRYFRKRRGTK

SEQ ID NO: 8698 - protein, 74 aa, Homo Sapiens
  misc_feature (1)..(1): Xaa can be any naturally occurring amino acid
XSHESMESYELRSENALSLSTSSIGKPVMTTDFANATPWFMDTMLPIIATSGSAEGPNETEGRKKISFFLEAGT

SEQ ID NO: 8699 - protein, 77 aa, Homo Sapiens
MAGNSILLAAVSILSACQQSYFALQVGKARLKYKVTPPAVTGSPEFERVFRAHFCYLSGSGVHIWPSPILLGIFRSC

SEQ ID NO: 8700 - protein, 147 aa, Homo Sapiens
MAGNSILLAAVSILSACQQSYFALQVGKARLKYKVTPPAVTGSPEFERVFRAQQNCVEFYPIFIITLWMAGWYFNQVFATCLGLVYIYGRHLYFWGYSEAAKKRITGFRLSLGILALLTLLGALGIANSFLDEYLDLNIAKKLRRQF

SEQ ID NO: 8701 - protein, 147 aa, Homo Sapiens; identical to SEQ ID NO: 8700

SEQ ID NO: 8702 - protein, 147 aa, Homo Sapiens; identical to SEQ ID NO: 8700

SEQ ID NO: 8703 - protein, 46 aa, Homo Sapiens
MARSLVCLGVIILLSAFSGPGVRGGPMPKLADRKLCADQECSHPIS

SEQ ID NO: 8704 - protein, 131 aa, Homo Sapiens
MARSLVCLGVIILLSAFSGPGVRGGPMPKLADRKLCADQECSHPISMAVALQDYMAPDCRFLTIHRGQVVYVFSKLKGRGRLFWGGSVQGDYYGDLAARLGYFPSSIVREDQTLKPGKVDVKTDKWDFYCQ

SEQ ID NO: 8705 - protein, 131 aa, Homo Sapiens; identical to SEQ ID NO: 8704

SEQ ID NO: 8706 - protein, 131 aa, Homo Sapiens; identical to SEQ ID NO: 8704

SEQ ID NO: 8707 - protein, 95 aa, Homo Sapiens
  misc_feature (1)..(1): Xaa can be any naturally occurring amino acid
XRSLVCLGVIILLSAFSGPGVRGGPMPKLADRKLCADQECSHPISMAVALQDYMAPDCRFLTIHRGQVVFREITMEIWLLAWAISPVALSERTRP

SEQ ID NO: 8708 - protein, 58 aa, Homo Sapiens
  misc_feature (1)..(1): Xaa can be any naturally occurring amino acid
XSLVCLGVIILLSAFSGPGVRGGPMPKLADRKLCADQECSRSGRLLWRSGCSPGLFPQ

SEQ ID NO: 8709 - protein, 1412 aa, Homo Sapiens
MAKFGVHRILLLAISLTKCLESTKLLADLKKCGDLECEALINRVSAMRDYRGPDCRYLNFTKGEEISVYVKLAGEREDLWAGSKGKEFGYFPRDAVQIEEVFISEEIQMSTKESDFLCLLGVSYTFDNEDSELNGDYGENIYPYEEDKDEKSSIYESDFQIEPGFYATYESTLFEDQVPALEAPEDIGSTSESKDWEEVVVESMEQDRIPEVHVPPSSAVSGVKEWFGLGGEQAEEKAFESVIEPVQESSFRSRKIAVEDENDLEELNNGEPQTEHQQESESEIDSVPKTQSELASESEHIPKPQSTGWFGGGFTSYLGFGDEDTGLELIAEESNPPLQDFPNSISSDKEATVPCTEILTEKKDTITNDSLSLKPSWFDFGFAILGFAYAKEDKIMLDDRKNEEDGGADEHEHPLTSELDPEKEQEIETIKIIETEDQIDKKPVSEKTDESDTIPYLKKFLYNFDNPWNFQNIPKETELPFPKQILDQNNVIENEETGEFSIDNYPTDNTKVMIFKSSYSLSDMVSNIELPTRIHEEVYFEPSSSKDSDENSKPSVDTEGPALVEIDRSVENTLLNSQMVSTDNSLSSQNYISQKEDASEFQILKYLFQIDVYDFMNSAFSPIVILTERVVAALPEGMRPDSNLYGFPWELVICAAVVGFFAVLFFLWRSFRSVRSRLYVGREKKLALMLSGLIEEKSKLLEKFSLVQKEYEGYEVESSLKDASFEKEATEAQSLEATCEKLNRSNSELEDEILCLEKELKEEKSKHSEQDELMADISKRIQSLEDESKSLKSQVAEAKMTFKIFQMNEERLKIAIKDALNENSQLQESQKQLLQEAEVWKEQVSELNKQKVTFEDSKVHAEQVLNDKESHIKTLTERLLKMKDWAAMLGEDITDDDNLELEMNSESENGAYLDNPPKGALKKLIHAAKLNASLKTLEGERNQIYIQLSEVDKTKEELTEHIKNLQTEQASLQSENTHFENENQKLQQKLKVMTELYQENEMKLHRKLTVEENYRLEKEEKLSKVDEKISHATEELETYRKRAKDLEEELERTIHSYQGQIISHEKKAHDNWLAARNAERNLNDLRKENAHNRQKLTETELKFELLEKDPYALDVPNTAFGREHSPYGPSPLGWPSSETRAFLSPPTLLEGPLRLSPLLPGGGGRGSRGPGNPLDHQITNERGESSCDRLTDPHRAPSDTGSLSPPWDQDRRMMFPPPGQSYPDSALPPQRQDRFCSNSGRLSGPAELRSFNMPSLDKMDGSMPSEMESSRNDTKDDLGNLNVPDSSLPAENEATGPGFVPPPLAPIRGPLFPVDARGPFLRRGPPFPPPPPGAMFGASRDYFPPGDFPGPPPAPFAMRNVYPPRGFPPYLPPRPGFFPPPPHSEGRSEFPSGLIPPSNEPATEHPEPQQET

SEQ ID NO: 8710 - protein, 1907 aa, Homo Sapiens
MAAAPGLLVWLLVLRLPWRVPGQLDPSTGRRFSEHKLCADDECSMLMYRGEALEDFTGPDCRFVNFKKGDPVYVYYKLARGWPEVWAGSVGRTFGYFPKDLIQVVHEYTKEELQVPTDETDFVCFDGGRDDFHNYNVEELLGFLELYNSAATDSEKAVEKTLQDMEKNPELSKEREPEPEPVEANSEESDSVFSENTEDLQEQFTTQKHHSHANSQANHAQGEQASFESFEEMLQDKLKVPESENNKTSNSSQVSNEQDKIDAYKLLKKEMTLDLKTKFGSTADALVSDDETTRLVTSLEDDFDEELDTEYYAVGKEDEENQEDFDELPLLTFTDGEDMKTPAKSGVEKYPTDKEQNSNEEDKVQLTVPPGIKNDDKNILTTWGDTIFSIVTGGEETRDTMDLESSSSEEEKEDDDDALVPDSKQGKPQSATDYSDPDNVDDGLFIVDIPKTNNDKEVNAEHHIKGKGRGVQESKRGLVQDKTELEDENQEGMTVHSSVHSNNLNSMPAAEKGKDTLKSAYDDTENDLKGAAIHISKGMLHEEKPGEQILEGGSESESAQKAAGNQMNDRKIQQESLGSAPLMGDDHPNASRDSVEGDALVNGAKLHTLSVEHQREELKEELVLKTQNQPRFSSPDEIDLPRELEDEVPILGRNLPWQQERDVAATASKQMSEKIRLSEGEAKEDSLDEEFFHHKAMQGTEVGQTDQTDSTGGPAFLSKVEEDDYPSEELLEDENAINAKRSKEKNPGNQGRQFDVNLQVPDRAVLGTIHPDPEIEESKQETSMILDSEKTSETAAKGVNTGGREPNTMVEKERPLADKKAQRPFERSDFSDSIKIQTPELGEVFQNKDSDYLKNDNPEEHLKTSGLAGEPEGELSKEDHENTEKYMGTESQGSAAAEPEDDSFHWTPHTSVEPGHSDKREDLLIISSFFKEQQSLQRFQKYFNVHELEALLQEMSSKLKSAQQESLPYNMEKVLDKVFRASESQILSIAEKMLDTRVAENRDLGMNENNIFEEAAVLDDIQDLIYFVRYKHSTAEETATLVMAPPLEEGLGGAMEEMQPLHEDNFSREKTAELNVQVPEEPTHLDQRVIGDTHASEVSQKPNTEKDLDPGPVTTEDTPMDAIDANKQPETAAEEPASVTPLENAILLIYSFMFYLTKSLVATLPDDVQPGPDFYGLPWKPVFITAFLGIASFAIFLWRTVLVVKDRVYQVTEQQISEKLKTIMKENTELVQKLSNYEQKIKESKKHVQETRKQNMILSDEAIKYKDKIKTLEKNQEILDDTAKNLRVMLESEREQNVKNQDLISENKKSIEKLKDVISMNASEFSEVQIALNEAKLSEEKVKSECHRVQEENARLKKKKEQLQQEIEDWSKLHAELSEQIKSFEKSQKDLEVALTHKDDNINALTNCITQLNLLECESESEGQNKGGNDSDELANGEVGGDRNEKMKNQIKQMMDVSRTQTAISVVEEDLKLLQLKLRASVSTKCNLEDQVKKLEDDRNSLQAAKAGLEDECKTLRQKVEILNELYQQKEMALQKKLSQEEYERQEREHRLSAADEKAVSAAEEVKTYKRRIEEMEDELQKTERSFKNQIATHEKKAHENWLKARAAERAIAEEKREAANLRHKLLELTQKMAMLQEEPVIVKPMPGKPNTQNPPRRGPLSQNGSFGPSPVSGGECSPPLTVEPPVRPLSATLNRRDMPRSEFGSVDGPLPHPRWSAEASGKPSPSDPGSGTATMMNSSSRGSSPTRVLDEGKVNMAPKGPPPFPGVPLMSTPMGGPVPPPIRYGPPPQLCGPFGPRPLPPPFGPGMRPPLGLREFAPGVPPGRRDLPLHPRGFLPGHAPFRPLGSLGPREYFIPGTRLPPPTHGPQEYPPPPAVRDLLPSGSRDEPPPASQSTSQDCSQALKQSP

SEQ ID NO: 8711 - protein, 500 aa, Homo Sapiens
MAAAPGLLVWLLVLRLPWRVPGQLDPSTGRRFSEHKLCADDECSMLMYRGEALEDFTGPDCRFVNFKKGDPVYVYYKLARGWPEVWAGSVGRTFGYFPKDLIQVVHEYTKEELQVPTDETDFVCFDGGRDDFHNYNVEELLGFLELYNSAATDSEKAVEKTLQDMEKNPELSKEREPEPEPVEANSEESDSVFSENTEDLQEQFTTQKHHSHANSQANHAQGEQASFESFEEMLQDKLKVPESENNKTSNSSQVSNEQDKIDAYKLLKKEMTLDLKTKFGSTADALVSDDETTRLVTSLEDDFDEELDTEYYAVGKEDEENQEDFDELPLLTFTDGEDMKTPAKSGVEKYPTDKEQNSNEEDKVQLTVPPGIKNDDKNILTTWGDTIFSIVTGGEETRDTMDLESSSSEEEKEDDDDALVPDSKQGKPQSATDYSDPDNVDDGLFIVDIPKTNNDKEVNAEHHIKGKGRGVQESKRGLVQDKTELEDENQEGFKTEPIKL

SEQ ID NO: 8712 - protein, 785 aa, Homo Sapiens
MDSVPATVPSIAATPGDPELVGPLSVLYAAFIAKLLELVATLPDDVQPGPDFYGLPWKPVFITAFLGIASFAIFLWRTVLVVKDRVYQVTEQQISEKLKTIMKENTELVQKLSNYEQKIKESKKHVQETRKQNMILSDEAIKYKDKIKTLEKNQEILDDTAKNLRVMLESEREQNVKNQDLISENKKSIEKLKDVISMNASEFSEVQIALNEAKLSEEKVKSECHRVQEENARLKKKKEQLQQEIEDWSKLHAELSEQIKSFEKSQKDLEVALTHKDDNINALTNCITQLNLLECESESEGQNKGGNDSDELANGEVGGDRNEKMKNQIKQMMDVSRTQTAISVVEEDLKLLQLKLRASVSTKCNLEDQVKKLEDDRNSLQAAKAGLEDECKTLRQKVEILNELYQQKEMALQKKLSQEEYERQEREHRLSAADEKAVSAAEEVKTYKRRIEEMEDELQKTERSFKNQIATHEKKAHENWLKARAAERAIAEEKREAANLRHKLLELTQKMAMLQEEPVIVKPMPGKPNTQNPPRRGPLSQNGSFGPSPVSGGECSPPLTVEPPVRPLSATLNRRDMPRSEFGSVDGPLPHPRWSAEASGKPSPSDPGSGTATMMNSSSRGSSPTRVLDEGKVNMAPKGPPPFPGVPLMSTPMGGPVPPPIRYGPPPQLCGPFGPRPLPPPFGPGMRPPLGLREFAPGVPPGRRDLPLHPRGFLPGHAPFRPLGSLGPREYFIPGTRLPPPTHGPQEYPPPPAVRDLLPSGSRDEPPPASQSTSQDCSQALKQSP

SEQ ID NO: 8713 - protein, 1016 aa, Homo Sapiens
  misc_feature (1)..(1): Xaa can be any naturally occurring amino acid
XLVPDSKQGKPQSATDYSDPDNVDDGLFIVDIPKTNNDKEVNAEHHIKGKGRGVQESKRGLVQDKTELEDENQEGMTVHSSVHSNNLNSMPAAEKGKDTLKSAYDDTENDLKGAAIHISKGMLHEEKPGEQILEGGSESESAQKAAGNQMNDRKIQQESLGSAPLMGDDHPNASRDSVEGDALVNGAKLHTLSVEHQREELKEELVLKTQNQPRFSSPDEIDLPRELEDEVPILGRNLPWQQERDVAATASKQMSEKIRLSEGEAKEDSLDEEFFHHKAMQGTEVGQTDQTDSTGGPAFLSKVEEDDYPSEELLEDENAINAKRSKEKNPGNQGRQFDVNLQVPDRAVLGTIHPDPEIEESKQETSMILDSEKTSETAAKGVNTGGREPNTMVEKERPLADKKAQRPFERSDFSDSIKIQTPELGEVFQNKDSDYLKNDNPEEHLKTSGLAGEPEGELSKEDHENTEKYMGTESQGSAAAEPEDDSFHWTPHTSVEPGHSDKREDLLIISSFFKEQQSLQRFQKYFNVHELEALLQEMSSKLKSAQQESLPYNMEKVLDKVFRASESQILSIAEKMLDTRVAENRDLGMNENNIFEEAAVLDDIQDLIYFVRYKHSTAEETATLVMAPPLEEGLGGAMEEMQPLHEDNFSREKTAELNVQVPEEPTHLDQRVIGDTHASEVSQKPNTEKDLDPGPVTTEDTPMDAIDANKQPETAAEEPASVTPLENAILLIYSFMFYLTKSLVATLPDDVQPGPDFYGLPWKPVFITAFLGIASFAIFLWRTVLVVKDRVYQVTEQQISEKLKTIMKENTELVQKLSNYEQKIKESKKHVQETRKQNMILSDEAIKYKDKIKTLEKNQEILDDTAKNLRVMLESEREQNVKNQDLLQQEIEDWSKLHAELSEQIKSFEKSQKDLEVALTHKDDNINALTNCITQLNLLECESESEGQNKGGNDSDELANGEVGGDRNEKMKNQIKQMMDVSRTQTAISVVEEDLKLLQLKLRASVSTKCNLEDQV

SEQ ID NO: 8714 - protein, 107 aa, Homo Sapiens
  misc_feature (1)..(1): Xaa can be any naturally occurring amino acid
XSAEASGKPSPSDPGSGTATMMNSSSRGSSPTRVLDEGKVNMAPKGPPPFPGVPLMSTPMGGPVPPPIRYGPPPQLCGPFGPRPLPPPFDKDGRPGTVAHACNPSTL

SEQ ID NO: 8715 - protein, 388 aa, Homo Sapiens
MFRLNSLSALAELAVGSRWYHGGSQPIQIRRRLMMVAFLGASAVTASTGLLWKRAHAESPPCVDNLKSDIGDKGKNKDEGDVCNHEKKTADLAPHPEEKKKKRSGFRDRKVMEYENRIRAYSTPDKIFRYFATLKVISEPGEAEVFMTPEDFVRSITPNEKQPEHLGLDQYIIKRFDGKARFSKKKILHRVRKKSKGSILQRRKKALQKEERTRHGSTKHNEQEVRRTIMEWLEKAGVQWHHLSSLQPPTPWFKRFFCLSLLSSWDYRHTPPCPANFFIFSRDRVSPCWPGWSRYPDLMIRPPWLRKVLGLQKISQEREKFADEGSIFYTLGECGLISFSDYIFLTTVLSTPQRNFEIAFKMFDLNGDGEVDMEEFEQVQSIIRSQTS

SEQ ID NO: 8716 - protein, 480 aa, Homo Sapiens
MFRLNSLSALAELAVGSRWYHGGSQPIQIRRRLMMVAFLGASAVTASTGLLWKRAHAESPPCVDNLKSDIGDKGKNKDEGDVCNHEKKTADLAPHPEEKKKKRSGFRDRKVMEYENRIRAYSTPDKIFRYFATLKVISEPGEAEVFMTPEDFVRSITPNEKQPEHLGLDQYIIKRFDGKDFWQKISQEREKFADEGSIFYTLGECGLISFSDYIFLTTVLSTPQRNFEIAFKMFDLNGDGEVDMEEFEQVQSIIRSQTSMGMRHRDRPTTGNTLKSGLCSALTTYFFGADLKGKLTIKNFLEFQRKLQHDVLKLEFERHDPVDGRITERQFGGMLLAYSGVQSKKLTAMQRQLKKHFKEGKGLTFQEVENFFTFLKNINDVDTALSFYHMAGASLDKVTMQQVARTVAKVELSDHVCDVVFALFDCDGNGELSNKEFVSIMKQRLMRGLEKPKDMGFTRLMQAMWKCAQETAWDFALPKQ

SEQ ID NO: 8717 - protein, 482 aa, Homo Sapiens
MFRLNSLSALAELAVGSRWYHGGSQPIQIRRRLMMVAFLGASAVTASTGLLWKRAHAESPPCVDNLKSDIGDKGKNKDEGDVCNHEKKTADLAPHPEEKKKKRSGFRDRKVMEYENRIRAYSTPDKIFRYFATLKVISEPGEAEVFMTPEDFVRSITPNEKQPEHLGLDQYIIKRFDGKDFWQTEKISQEREKFADEGSIFYTLGECGLISFSDYIFLTTVLSTPQRNFEIAFKMFDLNGDGEVDMEEFEQVQSIIRSQTSMGMRHRDRPTTGNTLKSGLCSALTTYFFGADLKGKLTIKNFLEFQRKLQHDVLKLEFERHDPVDGRITERQFGGMLLAYSGVQSKKLTAMQRQLKKHFKEGKGLTFQEVENFFTFLKNINDVDTALSFYHMAGASLDKVTMQQVARTVAKVELSDHVCDVVFALFDCDGNGELSNKEFVSIMKQRLMRGLEKPKDMGFTRLMQAMWKCAQETAWDFALPKQ

SEQ ID NO: 8718 - protein, 476 aa, Homo Sapiens
MFRLNSLSALAELAVGSRWYHGGSQPIQIRRRLMMVAFLGASAVTASTGLLWKRAHAESPPCVDNLKSDIGDKGKNKDEGDVCNHEKKTADLAPHPEEKKKKRSGFRDRKVMEYENRIRAYSTPDKIFRYFATLKVISEPGEAEVFMTPEDFVRSITPNEKQPEHLGLDQYIIKRFDGKKISQEREKFADEGSIFYTLGECGLISFSDYIFLTTVLSTPQRNFEIAFKMFDLNGDGEVDMEEFEQVQSIIRSQTSMGMRHRDRPTTGNTLKSGLCSALTTYFFGADLKGKLTIKNFLEFQRKLQHDVLKLEFERHDPVDGRITERQFGGMLLAYSGVQSKKLTAMQRQLKKHFKEGKGLTFQEVENFFTFLKNINDVDTALSFYHMAGASLDKVTMQQVARTVAKVELSDHVCDVVFALFDCDGNGELSNKEFVSIMKQRLMRGLEKPKDMGFTRLMQAMWKCAQETAWDFALPKQ

SEQ ID NO: 8719 - protein, 478 aa, Homo Sapiens [sequence omitted]

SEQ ID NO: 8720 - protein, 154 aa, Homo Sapiens
MKRIYTYRRAKEIFKDTPKAPQRNFEIAFKMFDLNGDGEVDMEEFEQVQSIIRSQTSMGMRHRDRPTTGNTLKSGLCSALTTYFFGADLKGKLTIKNFLEFQRKLQHDVLKLEFERHDPVDGRITERQFGGMLLAYSGVQSKKLTAMQRQLKKH

SEQ ID NO: 8721 - protein, 278 aa, Homo Sapiens
MKRIYTYRRAKEIFKDTPKAPQRNFEIAFKMFDLNGDGEVDMEEFEQVQSIIRSQTSMGMRHRDRPTTGNTLKSGLCSALTTYFFGADLKGKLTIKNFLEFQRKLQHDVLKLEFERHDPVDGRITERQFGGMLLAYSGVQSKKLTAMQRQLKKHFKEGKGLTFQEVENFFTFLKNINDVDTALSFYHMAGASLDKVTMQQVARTVAKVELSDHVCDVVFALFDCDGNGELSNKEFVSIMKQRLMRGLEKPKDMGFTRLMQAMWKCAQETAWDFALPKQ

SEQ ID NO: 8722 - protein, 212 aa, Homo Sapiens
MVAFLGASAVTASTGLLWKRAHAESPPCVDNLKSDIGDKGKNKDEGDVCNHEKKTADLAPHPEEKKKKRSGFRDRKVMEYENRIRAYSTPDKIFRYFATLKVISEPGEAEVFMTPEDFVRSITPNEKQPEHLGLDQYIIKRFDGKKISQEREKFADEGSIFYTLGECGLISFSDYIFLTTVLSTPQRNFEIAFKMFDLNGDGEVDMEEFEQA

SEQ ID NO: 8723 - protein, 278 aa, Homo Sapiens
MVSLKAKLNHLRQSMLKQKAPQRNFEIAFKMFDLNGDGEVDMEEFEQVQSIIRSQTSMGMRHRDRPTTGNTLKSGLCSALTTYFFGADLKGKLTIKNFLEFQRKLQHDVLKLEFERHDPVDGRITERQFGGMLLAYSGVQSKKLTAMQRQLKKHFKEGKGLTFQEVENFFTFLKNINDVDTALSFYHMAGASLDKVTMQQVARTVAKVELSDHVCDVVFALFDCDGNGELSNKEFVSIMKQRLMRGLEKPKDMGFTRLMQAMWKCAQETAWDFALPKQ

SEQ ID NO: 8724 - protein, 246 aa, Homo Sapiens
  misc_feature (1)..(1): Xaa can be any naturally occurring amino acid
XNEKQPEHLGLDQYIIKRFDGKKISQEREKFADEGSIFYTLGECGLISFSDYIFLTTVLSTPQRNFEIAFKMFDLNGDGEVDMEEFEQVQSIIRSQTSMGMRHRDRPTTGNTLKSGLCSALTTYFFGADLKGKLTIKNFLEFQRKLQHDVLKLEFERHDPVDGRITERQFGGMLLAYSGVQSKKLTAMQRQLKKHFKEGKGLTFQEVENFFTFLKNINDVDTALSFYHMAGASLDKGKGTIFMGRR

SEQ ID NO: 8725 - protein, 512 aa, Homo Sapiens
MAEPSVESSSPGGSATSDDHEFDPSADMLVHDFDDERTLEEEEMMEGETNFSSEIEDLAREGDMPIHELLSLYGYGSTVRLPEEDEEEEEEEEEGEDDEDADNDDNSGCSGENKEENIKDSSGQEDETQSSNDDPSQSVASQDAQEIIRPRRCKYFDTNSEVEEESEEDEDYIPSEDWKKEIMVGSMFQAEIPVGICRYKENEKVYENDDQLLWDPEYLPEDKVIIFLKDASRRTGDEKGVEAIPEGSHIKDNEQALYELVKCNFDTEEALRRLRFNVKAAREELSVWTEEECRNFEQGLKAYGKDFHLIQANKVRTRSVGECVAFYYMWKKSERYDFFAQQTRFGKKKYNLHPGVTDYMDRLLDESESAASSRAPSPPPTASNSSNSQSEKEDGTVSTANQNGVSSNGPGEILNKEEVKVEGLHINGPTGGNKKPLHADMDTNGYETDNLTTDPKLAHMTARNENDFDEKSERPAKRRRVNSNGKESPGSSEFFQEAVSHGKFEELENTDD

SEQ ID NO: 8726 - protein, 433 aa, Homo Sapiens
MAEPSVESSSPGGSATSDDHEFDPSADMLVHDFDDERTLEEEEMMEGETNFSSEIEDLAREGDMPIHELLSLYGYGSTVRLPEEDEEEEEEEEEGEDDEDADNDDNSGCSGENKEENIKDSSGQEDETQSSNDDPSQSVASQDAQEIIRPRRCKYFDTNSEVEEESEEDEDYIPSEDWKKEIMVGSMFQAEIPVGICRYKENEKVYENDDQLLWDPEYLPEDKVIIFLKDASRRTGDEKGVEAIPEGSHIKDNEQALYELVKCNFDTEEALRRLRFNVKAAREELSVWTEEECRNFEQGLKAYGKDFHLIQANKVRTRSVGECVAFYYMWKKSERYDFFAQQTRFGKKKYNLHPGVTDYMDRLLDESESAASSRAPSPPPTASNSSNSQSEKEDGTVSTANQNGVSSNGPGILQMLLPVHFSAISSRANAFLK

SEQ ID NO: 8727 - protein, 486 aa, Homo Sapiens
MDGASSGGGGSSEGGGGSSGSGYGVVARFSQCLAEFRTWLRTNWLRFNADKTDVMLPSVESSSPGGSATSDDHEFDPSADMLVHDFDDERTLEEEEMMEGETNFSSEIEDLAREGDMPIHELLSLYGYGSTVRLPEEDEEEEEEEEEGEDDEDADNDDNSGCSGENKEENIKDSSGQEDETQSSNDDPSQSVASQDAQEIIRPRRCKYFDTNSEVEEESEEDEDYIPSEDWKKEIMVGSMFQAEIPVGICRYKENEKVYENDDQLLWDPEYLPEDKVIIFLKDASRRTGDEKGVEAIPEGSHIKDNEQALYELVKCNFDTEEALRRLRFNVKAAREELSVWTEEECRNFEQGLKAYGKDFHLIQANKVRTRSVGECVAFYYMWKKSERYDFFAQQTRFGKKKYNLHPGVTDYMDRLLDESESAASSRAPSPPPTASNSSNSQSEKEDGTVSTANQNGVSSNGPGILQMLLPVHFSAISSRANAFLK

SEQ ID NO: 8728 - protein, 565 aa, Homo Sapiens
MDGASSGGGGSSEGGGGSSGSGYGVVARFSQCLAEFRTWLRTNWLRFNADKTDVMLPSVESSSPGGSATSDDHEFDPSADMLVHDFDDERTLEEEEMMEGETNFSSEIEDLAREGDMPIHELLSLYGYGSTVRLPEEDEEEEEEEEEGEDDEDADNDDNSGCSGENKEENIKDSSGQEDETQSSNDDPSQSVASQDAQEIIRPRRCKYFDTNSEVEEESEEDEDYIPSEDWKKEIMVGSMFQAEIPVGICRYKENEKVYENDDQLLWDPEYLPEDKVIIFLKDASRRTGDEKGVEAIPEGSHIKDNEQALYELVKCNFDTEEALRRLRFNVKAAREELSVWTEEECRNFEQGLKAYGKDFHLIQANKVRTRSVGECVAFYYMWKKSERYDFFAQQTRFGKKKYNLHPGVTDYMDRLLDESESAASSRAPSPPPTASNSSNSQSEKEDGTVSTANQNGVSSNGPGEILNKEEVKVEGLHINGPTGGNKKPLHADMDTNGYETDNLTTDPKLAHMTARNENDFDEKSERPAKRRRVNSNGKESPGSSEFFQEAVSHGKFEELENTDD

SEQ ID NO: 8729 - protein, 450 aa, Homo Sapiens
MFMFNWFTDCLWTLFLSNYQPSVESSSPGGSATSDDHEFDPSADMLVHDFDDERTLEEEEMMEGETNFSSEIEDLAREGDMPIHELLSLYGYGSTVRLPEEDEEEEEEEEEGEDDEDADNDDNSGCSGENKEENIKDSSGQEDETQSSNDDPSQSVASQDAQEIIRPRRCKYFDTNSEVEEESEEDEDYIPSEDWKKEIMVGSMFQAEIPVGICRYKENEKVYENDDQLLWDPEYLPEDKVIIFLKDASRRTGDEKGVEAIPEGSHIKDNEQALYELVKCNFDTEEALRRLRFNVKAAREELSVWTEEECRNFEQGLKAYGKDFHLIQANKVRTRSVGECVAFYYMWKKSERYDFFAQQTRFGKKKYNLHPGVTDYMDRLLDESESAASSRAPSPPPTASNSSNSQSEKEDGTVSTANQNGVSSNGPGILQMLLPVHFSAISSRANAFLK

SEQ ID NO: 8730 - protein, 470 aa, Homo Sapiens
MFMFNWFTDCLWTLFLSNYQPSVESSSPGGSATSDDHEFDPSADMLVHDFDDERTLEEEEMMEGETNFSSEIEDLAREGDMPIHELLSLYGYGSTVRLPEEDEEEEEEEEEGEDDEDADNDDNSGCSGENKEENIKDSSGQEDETQSSNDDPSQSVASQDAQEIIRPRRCKYFDTNSEVEEESEEDEDYIPSEDWKKEIMVGSMFQAEIPVGICRYKENEKVYENDDQLLWDPEYLPEDKVIIFLKDASRRTGDEKGVEAIPEGSHIKDNEQALYELVKCNFDTEEALRRLRFNVKAAREELSVWTEEECRNFEQGLKAYGKDFHLIQANKVRTRSVGECVAFYYMWKKSERYDFFAQQTRFGKKKYNLHPGVTDYMDRLLDESESAASSRAPSPPPTASNSSNSQSEKEDGTVSTANQNGVSSNGPGEILNKEEVKVEGLHINGPTGILQMLLPVHFSAISSRANAFLK

SEQ ID NO: 8731 - protein, 529 aa, Homo Sapiens
MFMFNWFTDCLWTLFLSNYQPSVESSSPGGSATSDDHEFDPSADMLVHDFDDERTLEEEEMMEGETNFSSEIEDLAREGDMPIHELLSLYGYGSTVRLPEEDEEEEEEEEEGEDDEDADNDDNSGCSGENKEENIKDSSGQEDETQSSNDDPSQSVASQDAQEIIRPRRCKYFDTNSEVEEESEEDEDYIPSEDWKKEIMVGSMFQAEIPVGICRYKENEKVYENDDQLLWDPEYLPEDKVIIFLKDASRRTGDEKGVEAIPEGSHIKDNEQALYELVKCNFDTEEALRRLRFNVKAAREELSVWTEEECRNFEQGLKAYGKDFHLIQANKVRTRSVGECVAFYYMWKKSERYDFFAQQTRFGKKKYNLHPGVTDYMDRLLDESESAASSRAPSPPPTASNSSNSQSEKEDGTVSTANQNGVSSNGPGEILNKEEVKVEGLHINGPTGGNKKPLHADMDTNGYETDNLTTDPKLAHMTARNENDFDEKSERPAKRRRVNSNGKESPGSSEFFQEAVSHGKFEELENTDD

SEQ ID NO: 8732 - protein, 81 aa, Homo Sapiens
MFMFNWFTDCLWTLFLSNYQPSVESSSPGGSATSDDHEFDPSADMLVHDFDDERTLEEEEMMEGETNFSSEIEDLARVNNM

SEQ ID NO: 8733 - protein, 370 aa, Homo Sapiens
MPIHELLSLYGYGSTVRLPEEDEEEEEEEEEGEDDEDADNDDNSGCSGENKEENIKDSSGQEDETQSSNDDPSQSVASQDAQEIIRPRRCKYFDTNSEVEEESEEDEDYIPSEDWKKEIMVGSMFQAEIPVGICRYKENEKVYENDDQLLWDPEYLPEDKVIIFLKDASRRTGDEKGVEAIPEGSHIKDNEQALYELVKCNFDTEEALRRLRFNVKAAREELSVWTEEECRNFEQGLKAYGKDFHLIQANKVRTRSVGECVAFYYMWKKSERYDFFAQQTRFGKKKYNLHPGVTDYMDRLLDESESAASSRAPSPPPTASNSSNSQSEKEDGTVSTANQNGVSSNGPGILQMLLPVHFSAISSRANAFLK

SEQ ID NO: 8734 - protein, 70 aa, Homo Sapiens
MFQPLSSPDSHRKGTGFGLGIVFSLTFFKRRMWPLAFGSGMGLGMAYSNCQHDFQAPYLLHGKYVKEQEQ

SEQ ID NO: 8735 - protein, 71 aa, Homo Sapiens
RKWDRCLADAVVKIGTGFGLGIVFSLTFFKRRMWPLAFGSGMGLGMAYSNCQHDFQAPYLLHGKYVKEQEQ

SEQ ID NO: 8736 - protein, 46 aa, Homo Sapiens
  misc_feature (1)..(1): Xaa can be any naturally occurring amino acid
XKWDRCLADAVVKIEMGFHHVAQAGLELRVQTIHLPWPPNVPGLQA

SEQ ID NO: 8737 - protein, 286 aa, Homo Sapiens
MCLFQLCGLVRYMEFGPPTVNDKLMRFFDHCEKFLTEVEKNATALYHVEAFKTGPEMQNILKKVAATLQVPVNDLNADLIQVAFFTCSFDLAIKGVKSPWCDVFDIDDAKVLEYLNDLKQYWKRGYGYTINSRSSCTLFQDIFQHLDKAVEQKQRSQPISSPVILQFGHAETLLPLLSLMGYFKDKEPLTAYNYKKQMHRKFRSGLIVPYASNLIFVLYHCENAKTPKEQFRVQMLLNEKVLPLAYSQETVSFYEDLKNHYKDILQSCQTSEECELARANSTSDEL

SEQ ID NO: 8738 - protein, 312 aa, Homo Sapiens
MLRAPGCLLRTSVAPAAALAAALLSSLARCSLLEPRDPVASSLSPYFGTKTRYEDVNPVLLSGPEAPWRDPELLEGTCTPVQLVALIRHGTRYPTVKQIRKLRQLHGLLQARGSRDGGASSTGSRDLGAALADWPLWYADWMDGQLVEKGRQDMRQLALRLASLFPALFSRENYGRLRLITSSKHRCMDSSAAFLQGLWQHYHPGLPPPDVADMEFGPPTVNDKLMRFFDHCEKFLTEVEKNATALYHVEAFKTGPEMQNILKKVAATLQVPVNDLNAGLSQFLLQSSSSLVMQRLFFHCFLSWATSKTRNP

SEQ ID NO: 8739 - protein, 487 aa, Homo Sapiens
MLRAPGCLLRTSVAPAAALAAALLSSLARCSLLEPRDPVASSLSPYFGTKTRYEDVNPVLLSGPEAPWRDPELLEGTCTPVQLVALIRHGTRYPTVKQIRKLRQLHGLLQARGSRDGGASSTGSRDLGAALADWPLWYADWMDGQLVEKGRQDMRQLALRLASLFPALFSRENYGRLRLITSSKHRCMDSSAAFLQGLWQHYHPGLPPPDVADMEFGPPTVNDKLMRFFDHCEKFLTEVEKNATALYHVEAFKTGPEMQNILKKVAATLQVPVNDLNADLIQVAFFTCSFDLAIKGVKSPWCDVFDIDDAKVLEYLNDLKQYWKRGYGYTINSRSSCTLFQDIFQHLDKAVEQKQRSQPISSPVILQFGHAETLLPLLSLMGYFKDKEPLTAYNYKKQMHRKFRSGLIVPYASNLIFVLYHCENAKTPKEQFRVQMLLNEKVLPLAYSQETVSFYEDLKNHYKDILQSCQTSEECELARANSTSDEL

SEQ ID NO: 8740 - protein, 146 aa, Homo Sapiens
MKLPILRSNPEDQILYQTERYNEETFGYEVPIKEEGDYVLVLKFAEVYFAQSQQKVFDVRLNGHVVVKDLDIFDRVGHSTAHDEIIPMSIRKGKLSVQGEVSTFTGKLYIEFVKGYYDNPKVCALYIMAGTVDDVPKLQPHPGLEK

SEQ ID NO: 8741 - protein, 217 aa, Homo Sapiens
MLGAWAVEGTAVALLRLLLLLLPPAIRGPGLGVAGVAGAAGAGLPESVIWAVNAGGEAHVDVHGIHFRKDPLEGRVGRASDYGMKLPILRSNPEDQILYQTERYNEETFGYEVPIKEEGDYVLVLKFAEVYFAQSQQKMYQSFSLIRDWRRKKRKKKKKNMMKGLISKNRPIRTGCSQAPAHPTPMPRTTAASCFPSWWPSESSFQPSSASAGCENK

SEQ ID NO: 8742 - protein, 292 aa, Homo Sapiens
MLGAWAVEGTAVALLRLLLLLLPPAIRGPGLGVAGVAGAAGAGLPESVIWAVNAGGEAHVDVHGIHFRKDPLEGRVGRASDYGMKLPILRSNPEDQILYQTERYNEETFGYEVPIKEEGDYVLVLKFAEVYFAQSQQKVFDVRLNGHVVVKDLDIFDRVGHSTAHDEIIPMSIRKGKLSVQGEVSTFTGKLYIEFVKGYYDNPKVCALYIMAGTVDDVPKLQPHPGLEKKEEEEEEEEYDEGSNLKKQTNKNRVQSGPRTPNPYASDNSSLMFPILVAFGVFIPTLFCLCRL

SEQ ID NO: 8743 - protein, 173 aa, Homo Sapiens
  misc_feature (1)..(1): Xaa can be any naturally occurring amino acid
XNEETFGYEVPIKEEGDYVLVLKFAEVYFAQSQQKVFDVRLNGHVVVKDLDIFDRVGHSTAHDEIIPMSIRKGKLSVQGEVSTFTGKLYIEFVKMYQSFSLIRDWRRKKRKKKKKNMMKGLISKNRPIRTGCSQAPAHPTPMPRTTAASCFPSWWPSESSFQPSSASAGCENK

SEQ ID NO: 8744 - protein, 115 aa, Homo Sapiens
MVSRKAVAALLVVHVAAMLASQTEAFVPIFTYGELQRMQEKERNKGQKKSLSVWQRSGEEGPVDPAEPIREEENEMIKLTAPLEIGMRMNSRQLEKYPATLEGLLSEMLPQHAAK

SEQ ID NO: 8745 - protein, 114 aa, Homo Sapiens
MVSRKAVAALLVVHVAAMLASQTEAFVPIFTYGELQRMQEKERNKGQKKSLSVWQRSGEEGPVDPAEPIREEENEMIKLTAPLEIGMRMNSRQLEKYPATLEGLLSEMLPQHAK

SEQ ID NO: 8746 - protein, 108 aa, Homo Sapiens
MVSRKAVAALLVVHVAAMLASQTEAFVPIFTYGELQRMQEKERNKGQKKSLSVWQRSGEEGPVDPAEPIREEENEMIKLTAPLEIGMRMNSRQLEKYPATLEGLLTAK

SEQ ID NO: 8747 - protein, 919 aa, Homo Sapiens
MAADVFMCSPRRPRSRGRQVLLKPQVSEDDDDSDTDEPSPPPASGAATPARAHASAAPPPPRAGPGREEPPRRQQIIHSGHFMVSSPHREHPPKKGYDFDTVNKQTCQTYSFGKTSSCHLSIDASLTKLFECMTLAYSGKLVSPKWKNFKGLKLQWRDKIRLNNAIWRAWYMQYLEKRKNPVCHFVTPLDGSVDVDEHRRPEAITTEGKYWKSRIEIVIREYHKWRTYFKKRLQQHKDEDLSSLVQDDDMLYWHKHGDGWKTPVPMEEDPLLDTDMLMSEFSDTLFSTLSSHQPVAWPNPREIAHLGNADMIQPGLIPLQPNLDFMDTFEPFQDLFSSSRSIFGSMLPASASAPVPDPNNPPAQESILPTTALPTVSLPDSLIAPPTAPSLAHMDEQGCEHTSRTEDPFIQPTDFGPSEPPLSVPQPFLPVFTMPLLSPSPAPPPISPVLPLVPPPATALNPPAPPTFHQPQKFAGVNKAPSVITHTASATLTHDAPATTFSQSQGLVITTHHPAPSAAPCGLALSPVTRPPQPRLTFVHPKPVSLTGGRPKQPHKIVPAPKPEPVSLVLKNARIAPAAFSGQPQAVIMTSGPLKREGMLASTVSQSNVVIAPAAIARAPGVPEFHSSILVTDLGHGTSSPPAPVSRLFPSTAQDPLGKGEQVPLHGGSPQVTVTGPSRDCPNSGQASPCASEQSPSPQSPQNNCSGKSDPKNVAALKNRQMKHISAEQKRRFNIKMCFDMLNSLISNNSKLTSHAITLQKTVEYITKLQQERGQMQEEARRLREEIEELNATIISCQQLLPATGVPVTRRQFDHMKDMFDEYVKTRTLQNWKFWIFSIIIKPLFESFKGMVSTSSLEELHRTALSWLDQHCSLPILRPMVLSTLRQLSTSTSILTDPAQLPEQASKAVTRIGKRLGES

SEQ ID NO: 8748 - protein, 217 aa, Homo Sapiens
MDEQGCEHTSRTEDPFIQPTDFGPSEPPLSVPPPISPVLPLVPPPATALNPPAPPTFHQPQKFAGVNKAPSVITHTASATLTHDAPATTFSQSQGLVITTHHPAPSAAPCGLALSPVTRPPQPRLTFVHPKPVSLTGGRPKQPHKIVPAPKPEPVSLVLKNARIAPGEPGGETQCGAPPDPEGCFPIPKAFKLVTTTTTLVCTCMRTHIHLNETKVS

SEQ ID NO: 8749 - protein, 526 aa, Homo Sapiens
MDEQGCEHTSRTEDPFIQPTDFGPSEPPLSVPQPFLPVFTMPLLSPSPAPPPISPVLPLVPPPATALNPPAPPTFHQPQKFAGVNKAPSVITHTASATLTHDAPATTFSQSQGLVITTHHPAPSAAPCGLALSPVTRPPQPRLTFVHPKPVSLTGGRPKQPHKIVPAPKPEPVSLVLKNARIAPAAFSGQPQAVIMTSGPLKREGMLASTVSQSNVVIAPAAIARAPGVPEFHSSILVTDLGHGTSSPPAPVSRLFPSTAQDPLGKGEQVPLHGGSPQVTVTGPSRDCPNSGQASPCASEQSPSPQSPQNNCSGKSDPKNVAALKNRQMKHISAEQKRRFNIKMCFDMLNSLISNNSKLTSHAITLQKTVEYITKLQQERGQMQEEARRLREEIEELNATIISCQQLLPATGVPVTRRQFDHMKDMFDEYVKTRTLQNWKFWIFSIIIKPLFESFKGMVSTSSLEELHRTALSWLDQHCSLPILRPMVLSTLRQLSTSTSILTDPAQLPEQASKAVTRIGKRLGES

SEQ ID NO: 8750 - protein, 74 aa, Homo Sapiens
MLYWHKHGDGWKTPVPMEEDPLLDTDMLMSEFSDTLFSTLSSHQPVAWPNPREIAHLGNADMIQPGLIPLQPNL

SEQ ID NO: 8751 - protein, 308 aa, Homo Sapiens
MVLGALVALSSCPLGLRTSCLTGREAASAGWARPCGPGLHLNILLILAAAFSGQPQAVIMTSGPLKREGMLASTVSQSNVVIAPAAIARAPGVPEFHSSILVTDLGHGTSSPPAPVSRLFPSTAQDPLGKGEQVPLHGGSPQVTVTGPSRDCPNSGQASPCASEQSPSPQSPQNNCSGKSDPKNVAALKNRQMKHISAEQKRRFNIKMCFDMLNSLISNNSKLTSHAITLQKTVEYITKLQQERGQMQEEARRLREEIEELNATIISCQQLLPATGVPVTRRQFDHMKDMFDEYVKTRTLQNWKFWIV

SEQ ID NO: 8752 - protein, 171 aa, Homo Sapiens
  misc_feature (1)..(1): Xaa can be any naturally occurring amino acid
XHGGSPQVTVTGPSRDCPNSGQASPCASEQSPSPQSPQNNCSGKSDPKNVAALKNRQMKHISAEQKRRFNIKMCFDMLNSLISNNSKLTSHAITLQKTVEYITKLQQERGQMQEEARRLREEIEELNATIIDPFSVGRYFPAPGERSTPVQPPSGLQSPAPLRACLFFNHT

SEQ ID NO: 8753 - protein, 213 aa, Homo Sapiens
MAGALAGLAAGLQVPRVAPSPDSDSDTDSEDPSLRRSAGGLLRSQVIHSGHFMVSSPHSDSLPRRRDQEGSVGPSDFGPRSIDPTLTRLFECLSLAYSGKLVSPKWKNFKGLKLLCRDKIRLNNAIWRAWYIQYFFTNSRLPQPPMPSNFPEPPSFSPVVDSLFSSGTLGPEVPPASSAMTHLSGHSRLQARNSCPGPLDSSAFLSSDFLLPE

SEQ ID NO: 8754 - protein, 721 aa, Homo Sapiens
MAGALAGLAAGLQVPRVAPSPDSDSDTDSEDPSLRRSAGGLLRSQVIHSGHFMVSSPHSDSLPRRRDQEGSVGPSDFGPRSIDPTLTRLFECLSLAYSGKLVSPKWKNFKGLKLLCRDKIRLNNAIWRAWYIQYVKRRKSPVCGFVTPLQGPEADAHRKPEAVVLEGNYWKRRIELPPEDAYVGNADMIQPDLTPLQPSLDDFMDISDFFTNSRLPQPPMPSNFPEPPSFSPVVDSLFSSGTLGPEVPPASSAMTHLSGHSRLQARNSCPGPLDSSAFLSSDFLLPEDPKPRLPPPPVPPPLLHYPPPAKVPGLEPCPPPPFPPMAPPTALLQEEPLFSPRFPFPTVPPAPGVSPLPAPAAFPPTPQSVPSPAPTPFPIELLPLGYSEPAFGPCFSMPRGKPPAPSPRGQKASPPTLAPATASPPTTAGSNNPCLTQLLTAAKPEQALEPPLVSSTLLRSPGSPETVPEFPCTFLPPTPAPTPPRPPPGPATLAPSRPLLVPKAERLSPPAPSGSERRLSGDLSSMPGPGTLSVRVSPPQPILSRGRPDSNKTENRRITHISAEQKRRFNIKLGFDTLHGLVSTLSAQPSLKVSKATTLQKTAEYILMLQQERAGLQEEAQQLRDEIEELNAAINLCQQQLPATGVPITHQRFDQMRDMFDDYVRTRTLHNWKFWVFSILIRPLFESFNGMVSTASVHTLRQTSLAWLDQYCSLPALRPST

SEQ ID NO: 8755 - protein, 852 aa, Homo Sapiens
MAGALAGLAAGLQVPRVAPSPDSDSDTDSEDPSLRRSAGGLLRSQVIHSGHFMVSSPHSDSLPRRRDQEGSVGPSDFGPRSIDPTLTRLFECLSLAYSGKLVSPKWKNFKGLKLLCRDKIRLNNAIWRAWYIQYVKRRKSPVCGFVTPLQGPEADAHRKPEAVVLEGNYWKRRIEVVMREYHKWRIYYKKRLRKPSREDDLLAPKQAEGRWPPPEQWCKQLFSSVVPVLLGDPEEEPGGRQLLDLNCFLSDISDTLFTMTQSGPSPLQLPPEDAYVGNADMIQPDLTPLQPSLDDFMDISDFFTNSRLPQPPMPSNFPEPPSFSPVVDSLFSSGTLGPEVPPASSAMTHLSGHSRLQARNSCPGPLDSSAFLSSDFLLPEDPKPRLPPPPVPPPLLHYPPPAKVPGLEPCPPPPFPPMAPPTALLQEEPLFSPRFPFPTVPPAPGVSPLPAPAAFPPTPQSVPSPAPTPFPIELLPLGYSEPAFGPCFSMPRGKPPAPSPRGQKASPPTLAPATASPPTTAGSNNPCLTQLLTAAKPEQALEPPLVSSTLLRSPGSPQETVPEFPCTFLPPTPAPTPPRPPPGPATLAPSRPLLVPKAERLSPPAPSGSERRLSGDLSSMPGPGTLSVRVSPPQPILSRGRPDSNKTENRRITHISAEQKRRFNIKLGFDTLHGLVSTLSAQPSLKVSKATTLQKTAEYILMLQQERAGLQEEAQQLRDEIEELNAAINLCQQQLPATGVPITHQRFDQMRDMFDDYVRTRTLHNWKFWVFSILIRPLFESFNGMVSTASVHTLRQTSLAWLDQYCSLPALRPTVLNSLRQLGTSTSILTDPGRIPEQATRAVTEGTLGKPL

SEQ ID NO: 8756 - protein, 575 aa, Homo Sapiens
MAGALAGLAAGLQVPRVAPSPDSDSDTDSEDPSLRRSAGGLLRSQVIHSGHFMVSSPHSDSLPRRRDQEGSVGPSDFGPRSIDPTLTRLFECLSLAYSGKLVSPKWKNFKGLKLLCRDKIRLNNAIWRAWYIQYVKRRKSPVCGFVTPLQGPEADAHRKPEAVVLEGNYWKRRIEVVMREYHKWRIYYKKRLRKPSREDDLLAPKQAEGRWPPPEQWCKQLFSSVVPVLLGDPEEEPGGRQLLDLNCFLSDISDTLFTMTQSGPSPLQLPPEDAYVGNADMIQPDLTPLQPSLDDFMDISDFFTNSRLPQPPMPSNFPEPPSFSPVVDSLFSSGTLGPEVPPASSAMTHLSGHSRLQARNSCPGPLDSSAFLSSDFLLPEDPKPRLPPPPVPPPLLHYPPPAKVPGLEPCPPPPFPPMAPPTALLQEEPLFSPRFPFPTVPPAPGVSPLPAPAAFPPTPQSVPSPAPTPFPIELLPLGYSEPAFGPCFSMPRGKPPAPSPRGQKASPPTLAPATASPPTTAGSNNPCLTQLLTAAKPEQALEPPLVSSTLLRSPGSPAVNGGCQGTSAPCQALGL

SEQ ID NO: 8757 - protein, 831 aa, Homo Sapiens
MAGALAGLAAGLQVPRVAPSPDSDSDTDSEDPSLRRSAGGLLRSQVIHSGHFMVSSPHSDSLPRRRDQEGSVGPSDFGPRSIDPTLTRLFECLSLAYSGKLVSPKWKNFKGLKLLCRDKIRLNNAIWRAWYIQYVKRRKSPVCGFVTPLQGPEADAHRKPEAVVLEGNYWKRRIEVVMREYHKWRIYYKKRLRKPSREDDLLAPKQAEGRWPPPEQWCKQLFSSVVPVLLGDPEEEPGGRQLLDLNCFLSDISDTLFTMTQSGPSPLQLPPEDAYVGNADMIQPDLTPLQPSLDDFMDISDFFTNSRLPQPPMPSNFPEPPSFSPVVDSLFSSGTLGPEVPPASSAMTHLSGHSRLQARNSCPGPLDSSAFLSSDFLLPEDPKPRLPPPPVPPPLLHYPPPAKVPGLEPCPPPPFPPMAPPTALLQEEPLFSPRFPFPTVPPAPGVSPLPAPAAFPPTPQSVPSPAPTPFPIELLPLGYSEPAFGPCFSMPRGKPPAPSPRGQKASPPTLAPATASPPTTAGSNNPCLTQLLTAAKPEQALEPPLVSSTLLRSPGSPQETVPEFPCTFLPPTPAPTPPRPPPGPATLAPSRPLLVPKAERLSPPAPSGSERRLSGDLSSMPGPGTLSVRVSPPQPILSRGRPDSNKNRRITHISAEQKRRFNIKLGFDTLHGLVSTLSAQPSLKERAGLQEEAQQLRDEIEELNAAINLCQQQLPATGVPITHQRFDQMRDMFDDYVRTRTLHNWKFWVFSILIRPLFESFNGMVSTASVHTLRQTSLAWLDQYCSLPALRPTVLNSLRQLGTSTSILTDPGRIPEQATRAVTEGTLGKPL

SEQ ID NO: 8758 - protein, 833 aa, Homo Sapiens
MAGALAGLAAGLQVPRVAPSPDSDSDTDSEDPSLRRSAGGLLRSQVIHSGHFMVSSPHSDSLPRRRDQEGSVGPSDFGPRSIDPTLTRLFECLSLAYSGKLVSPKWKNFKGLKLLCRDKIRLNNAIWRAWYIQYVKRRKSPVCGFVTPLQGPEADAHRKPEAVVLEGNYWKRRIEVVMREYHKWRIYYKKRLRKPSREDDLLAPKQAEGRWPPPEQWCKQLFSSVVPVLLGDPEEEPGGRQLLDLNCFLSDISDTLFTMTQSGPSPLQLPPEDAYVGNADMIQPDLTPLQPSLDDFMDISDFFTNSRLPQPPMPSNFPEPPSFSPVVDSLFSSGTLGPEVPPASSAMTHLSGHSRLQARNSCPGPLDSSAFLSSDFLLPEDPKPRLPPPPVPPPLLHYPPPAKVPGLEPCPPPPFPPMAPPTALLQEEPLFSPRFPFPTVPPAPGVSPLPAPAAFPPTPQSVPSPAPTPFPIELLPLGYSEPAFGPCFSMPRGKPPAPSPRGQKASPPTLAPATASPPTTAGSNNPCLTQLLTAAKPEQALEPPLVSSTLLRSPGSPQETVPEFPCTFLPPTPAPTPPRPPPGPATLAPSRPLLVPKAERLSPPAPSGSERRLSGDLSSMPGPGTLSVRVSPPQPILSRGRPDSNKTENRRITHISAEQKRRFNIKLGFDTLHGLVSTLSAQPSLKERAGLQEEAQQLRDEIEELNAAINLCQQQLPATGVPITHQRFDQMRDMFDDYVRTRTLHNWKFWVFSILIRPLFESFNGMVSTASVHTLRQTSLAWLDQYCSLPALRPTVLNSLRQLGTSTSILTDPGRIPEQATRAVTEGTLGKPL

SEQ ID NO: 8759 - protein, 850 aa, Homo Sapiens
MAGALAGLAAGLQVPRVAPSPDSDSDTDSEDPSLRRSAGGLLRSQVIHSGHFMVSSPHSDSLPRRRDQEGSVGPSDFGPRSIDPTLTRLFECLSLAYSGKLVSPKWKNFKGLKLLCRDKIRLNNAIWRAWYIQYVKRRKSPVCGFVTPLQGPEADAHRKPEAVVLEGNYWKRRIEVVMREYHKWRIYYKKRLRKPSREDDLLAPKQAEGRWPPPEQWCKQLFSSVVPVLLGDPEEEPGGRQLLDLNCFLSDISDTLFTMTQSGPSPLQLPPEDAYVGNADMIQPDLTPLQPSLDDFMDISDFFTNSRLPQPPMPSNFPEPPSFSPVVDSLFSSGTLGPEVPPASSAMTHLSGHSRLQARNSCPGPLDSSAFLSSDFLLPEDPKPRLPPPPVPPPLLHYPPPAKVPGLEPCPPPPFPPMAPPTALLQEEPLFSPRFPFPTVPPAPGVSPLPAPAAFPPTPQSVPSPAPTPFPIELLPLGYSEPAFGPCFSMPRGKPPAPSPRGQKASPPTLAPATASPPTTAGSNNPCLTQLLTAAKPEQALEPPLVSSTLLRSPGSPQETVPEFPCTFLPPTPAPTPPRPPPGPATLAPSRPLLVPKAERLSPPAPSGSERRLSGDLSSMPGPGTLSVRVSPPQPILSRGRPDSNKNRRITHISAEQKRRFNIKLGFDTLHGLVSTLSAQPSLKVSKATTLQKTAEYILMLQQERAGLQEEAQQLRDEIEELNAAINLCQQQLPATGVPITHQRFDQMRDMFDDYVRTRTLHNWKFWVFSILIRPLFESFNGMVSTASVHTLRQTSLAWLDQYCSLPALRPTVLNSLRQLGTSTSILTDPGRIPEQATRAVTEGTLGKPL

SEQ ID NO: 8760 - protein, 235 aa, Homo Sapiens
PKWKNFKGLKLLCRDKIRLNNAIWRAWYIQYVKRRKSPVCGFVTPLQGPEADAHRKPEAVVLEGNYWKRRIEVVMREYHKWRIYYKKRVSGGGPGRPQSFPPAAAGYRPPRKIPGKGILTPELAPLGPSIQSRADSATVWPQRLLAASLPRGRLRKPSREDDLLAPKQAEGRWPPPEQWCKQLFSSVVPVLLGDPEEEPGGRQLLDLNCFLSDISDTLFTMTQSGPSPLQLPPED

SEQ ID NO: 8761 - protein, 469 aa, Homo Sapiens
MHSFPPLLLLLFWGVVSHSFPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 8762 - protein, 476 aa, Homo Sapiens
MMHLAFLVLLCLPVCSAYPLSGAAKEEDSNKDLAQQYLEKYYNLEKDVKQFRRKDSNLIVKKIQGMQKFLGLEVTGKLDTDTLEVMRKPRCGVPDVGHFSSFPGMPKWRKTHLTYRIVNYTPDLPRDAVDSAIEKALKVWEEVTPLTFSRLYEGEADIMISFAVKEHGDFYSFDGPGHSLAHAYPPGPGLYGDIHFDDDEKWTEDASGTNLFLVAAHELGHSLGLFHSANTEALMYPLYNSFTELAQFRLSQDDVNGIQSLYGPPPASTEEPLVPTKSVPSGSEMPAKCDPALSFDAISTLRGEYLFFKDRYFWRRSHWNPEPEFHLISAFWPSLPSYLDAAYEVNSRDTVFIFKGNEFWAIRGNEVQAGYPRGIHTLGFPPTIRKIDAAVSDKEKKKTYFFAADKYWRFDENSQSMEQGFPRLIADDFPGVEPKVDAVLQAFGFFYFFSGSSQFEFDPNARMVTHILKSNSWLHC

SEQ ID NO: 8763 - protein, 181 aa, Homo Sapiens
MMHLAFLVLLCLPVCSAYPLSGAAKEEDSNKDLAQQYLEKYYNLEKDVKQFRRKDSNLIVKKIQGMQKFLGLEVTGKLDTDTLEVMRKPRCGVPDVGHFSSFPGMPKWRKTHLTYRIVNYTPDLPRDAVDSAIEKALKVWEEVTPLTFSRLYEGEADIMISFAVKGHSLAHAYPPGPGLYG

SEQ ID NO: 8764 - protein, 113 aa, Homo Sapiens
MAPAAWLRSAAARALLPPMLLLLLQPPPLLARALPPDAHHLHAERRGPQPWHAALPSSPAPAPATQEAPRPASSLRPPRCGVPDPSDGLSARNRQKRFVLSGGRWEKTDLTYR

SEQ ID NO: 8765 - protein, 488 aa, Homo Sapiens
MAPAAWLRSAAARALLPPMLLLLLQPPPLLARALPPDAHHLHAERRGPQPWHAALPSSPAPAPATQEAPRPASSLRPPRCGVPDPSDGLSARNRQKRFVLSGGRWEKTDLTYRILRFPWQLVQEQVRQTMAEALKVWSDVTPLTFTEVHEGRADIMIDFARYWHGDDLPFDGPGGILAHAFFPKTHREGDVHFDYDETWTIGDDQGTDLLQVAAHEFGHVLGLQHTTAAKALMSAFYTFRYPLSLSPDDCRGVQHLYGQPWPTVTSRTPALGPQAGIDTNEIAPLEPDAPPDACEASFDAVSTIRGELFFFKAGFVWRLRGGQLQPGYPALASRHWQGLPSPVDAAFEDAQGHIWFFQGAQYWVYDGEKPVLGPAPLTELGLVRFPVHAALVWGPEKNKIYFFRGRDYWRFHPSTRRVDSPVPRRATDWRGVPSEIDAAFQDADGYAYFLRGRLYWKFDPVKVKALEGFPRLVGPDFFGCAEPANTFL

SEQ ID NO: 8766 - protein, 354 aa, Homo Sapiens
MAPAAWLRSAAARALLPPMLLLLLQPPPLLARALPPDAHHLHAERRGPQPWHAALPSSPAPAPATQEAPRPASSLRPPRCGVPDPSDGLSARNRQKRILRFPWQLVQEQVRQTMAEALKVWSDVTPLTFTEVHEGRADIMIDFARYWHGDDLPFDGPGGILAHAFFPKTHREGDVHFDYDETWTIGDDQGTDLLQVAAHEFGHVLGLQHTTAAKALMSAFYTFRYPLSLSPDDCRGVQHLYGQPWPTVTSRTPALGPQAGIDTNEIAPLEPDAPPDACEASFDAVSTIRGELFFFKAGFVWRLRGGQLQPGYPALASRHWQGLPSPVDAAFEDAQGHIWFFQGTTGVSTPAPGV

SEQ ID NO: 8767 - protein, 170 aa, Homo Sapiens
  misc_feature (1)..(1): Xaa can be any naturally occurring amino acid
XAHEFGHVLGLQHTTAAKALMSAFYTFRYPLSLSPDDCRGVQHLYGQPWPTVTSRTPALGPQAGIDTNEIAPLEPDAPPDACEASFDAVSTIRGELFFFKAGFVWRLRGGQLQPGYPALASRHWQGLPSPVDAAFEDAQGHIWFFQELGFPSSTGRDESLEHCRCQGLHK

SEQ ID NO: 8768 - protein, 470 aa, Homo Sapiens
MKFLLILLLQATASGALPLNSSTSLEKNNVLFGERYLEKFYGLEINKLPVTKMKYSGNLMKEKIQEMQHFLGLKVTGQLDTSTLEMMHAPRCGVPDVHHFREMPGGPVWRKHYITYRINNYTPDMNREDVDYAIRKAFQVWSNVTPLKFSKINTGMADILVVFARGAHGDFHAFDGKGGILAHAFGPGSGIGGDAHFDEDEFWTTHSGGTNLFLTAVHEIGHSLGLGHSSDPKAVMFPTYKYVDINTFRLSADDIRGIQSLYGDPKENQRLPNPDNSEPALCDPNLSFDAVTTVGNKIFFFKDRFFWLKVSERPKTSVNLISSLWPTLPSGIEAAYEIEARNQVFLFKDDKYWLISNLRPEPNYPKSIHSFGFPNFVKKIDAAVFNPRFYRTYFFVDNQYWRYDERRQMMDPGYPKLITKNFQGIGPKIDAVFYSKNKYYYFFQGSNQFEYDFLLQRITKTLKSNSWFGC

SEQ ID NO: 8769 - protein, 471 aa, Homo Sapiens
MHPGVLAAFLFLSWTHCRALPLPSGGDEDDLSEEDLQFAERYLRSYYHPTNLAGILKENAASSMTERLREMQSFFGLEVTGKLDDNTLDVMKKPRCGVPDVGEYNVFPRTLKWSKMNLTYRIVNYTPDMTHSEVEKAFKKAFKVWSDVTPLNFTRLHDGIADIMISFGIKEHGDFYPFDGPSGLLAHAFPPGPNYGGDAHFDDDETWTSSSKGYNLFLVAAHEFGHSLGLDHSKDPGALMFPIYTYTGKSHFMLPDDDVQGIQSLYGPGDEDPNPKHPKTPDKCDPSLSLDAITSLRGETMIFKDRFFWRLHPQQVDAELFLTKSFWPELPNRIDAAYEHPSHDLIFIFRGRKFWALNGYDILEGYPKKISELGLPKEVKKISAAVHFEDTGKTLLFSGNQVWRYDDTNHIMDKDYPRLIEEDFPGIGDKVDAVYEKNGYIYFFNGPIQFEYSIWSNRIVRVMPANSILWC

SEQ ID NO: 8770 - protein, 489 aa, Homo Sapiens
MHPGVLAAFLFLSWTHCRALPLPSGGDEDDLSEEDLQFAERYLRSYYHPTNLAGILKENAASSMTERLREMQSFFGLEVTGKLDDNTLDVMKKPRCGVPDVGEYNVFPRTLKWSKMNLTYRIVNYTPDMTHSEVEKAFKKAFKVWSDVTPLNFTRLHDGIADIMISFGIKEHGDFYPFDGPSGLLAHAFPPGPNYGGDAHFDDDETWTSSSKGYNLFLVAAHEFGHSLGLDHSKDPGALMFPIYTYTGKSHFMLPDDDVQGIQSLYGPGDEDPNPKHPKTPDKCDPSLSLDAITSLRGETMIFKDRFFWRLHPQQVDAELFLTKSFWPELPNRIDAAYEHPSHDLIFIFRGRKFWALNGYDILEGYPKKISELGLPKEVKKISAAVHFEDTGKTLLFSGNQVWRYDDTNHIMDKDYPRLIEEDFPGIGDKVDAVYEKNESHSVTQAGVHCRNLSSLQPPPPGFKRFSCLSLWSSWDYRLYLFFQRTHTV

SEQ ID NO: 8771 - protein, 383 aa, Homo Sapiens [sequence omitted]

SEQ ID NO: 8772 - protein, 194 aa, Homo Sapiens
MRESLLFLRLPSSPALSRRRALRWALRPPRVAQAFSGRVCGQAWLQQYGYLPPGDLRTHTQRSPQSLSAAIAAMQKFYGLQVTGKADADTMKAMRRPRCGVPDKFGAEIKANVRRKRYAIQGLKWQHNEITFCIQNYTPKVGEYATYEAIRKAFRVWESATPLRFREVPYAYIREGHEKQADIMIFFAEGFHGD

SEQ ID NO: 8773 - protein, 582 aa, Homo Sapiens
MSPAPRPPRCLLLPLLTLGTALASLGSAQSSSFSPEAWLQQYGYLPPGDLRTHTQRSPQSLSAAIAAMQKFYGLQVTGKADADTMKAMRRPRCGVPDKFGAEIKANVRRKRYAIQGLKWQHNEITFCIQNYTPKVGEYATYEAIRKAFRVWESATPLRFREVPYAYIREGHEKQADIMIFFAEGFHGDSTPFDGEGGFLAHAYFPGPNIGGDTHFDSAEPWTVRNEDLNGNDIFLVAVHELGHALGLEHSSDPSAIMAPFYQWMDTENFVLPDDDRRGIQQLYGGESGFPTKMPPQPRTTSRPSVPDKPKNPTYGPNICDGNFDTVAMLRGEMFVFKERWFWRVRNNQVMDGYPMPIGQFWRGLPASINTAYERKDGKFVFFKGDKHWVFDEASLEPGYPKHIKELGRGLPTDKIDAALFWMPNGKTYFFRGNKYYRFNEELRAVDSEYPKNIKVWEGIPESPRGSFMGSDEVFTYFYKGNKYWKFNNQKLKVEPGYPKSALRDWMGCPSGGRPDEGTEEETEVIIIEVDEEGGGAVSAAAVVLPVLLLLLVLAVGLAVFFFRRHGTPRRLLYCQRSLLDKV

SEQ ID NO: 8774 - protein, 71 aa, Homo Sapiens
MSPAPRPPRCLLLPLLTLGTALASLGSAQSSSFSPESLEELYNWGELPLPRFPWALLSALEPPDKHLDSAQ

SEQ ID NO: 8775 - protein, 143 aa, Homo Sapiens
MDPGYPAQSPLWRGVPSTLDDAMRWSDGASYFFRGQEYWKVLDGELEVAPGYPQSTARDWLVCGDSQADGSVAAGVDAAEGPRAPPGQHDQSRSEDGYEVCSCTSGASSPPGAPGPLVAATMLLLLPPLSPGALWTAAQALTL

SEQ ID NO: 8776 - protein, 118 aa, Homo Sapiens
MHRFWRGLPLHLDSVDAVYERTSDHKIVFFKGDRYWVFKDNNVEEGYPRPVSDFSLPPGGIDAAFSWAHNDRTYFFKDQLYWRYDDHTRHMDPGYPAQSPLWRGVPSTLDDAMRWSDG

SEQ ID NO: 8777 - protein, 39 aa, Homo Sapiens
MHRFWRGLPLHLDSVDAVYERTSDHKIVFFKGPAVLALR

SEQ ID NO: 8778 - protein, 169 aa, Homo Sapiens
MKTPRCSLPDLPVLTQARRRRQAPAPTKWNKRNLSWRVRTFPRDSPLGHDTVRALMYYALKVWSDIAPLNFHEVAGSAADIQIDFSKADHNDGYPFDGPGGTVAHAFFPGHHHTAGDTHFDDDEAWTFRSSDAHGMDLFAVAVHEFGHAIGLSHVAAAHSIMRPYYQGP

SEQ ID NO: 8779 - protein, 115 aa, Homo Sapiens
MQQFGGLEATGILDEATLALMKTPRCSLPDLPVLTQARRRRQAPAPTKWNKRNLSWRVRTFPRDSPLGHDTVRALMYYALKVWSDIAPLNFHEVAGSAADIQIDFSKADHNDGYP

SEQ ID NO: 8780 - protein, 519 aa, Homo Sapiens
MQQFGGLEATGILDEATLALMKTPRCSLPDLPVLTQARRRRQAPAPTKWNKRNLSWRVRTFPRDSPLGHDTVRALMYYALKVWSDIAPLNFHEVAGSAADIQIDFSKADHNDGYPFDGPGGTVAHAFFPGHHHTAGDTHFDDDEAWTFRSSDAHGMDLFAVAVHEFGHAIGLSHVAAAHSIMRPYYQGPVGDPLRYGLPYEDKVRVWQLYGVRESVSPTAQPEEPPLLPEPPDNRSSAPPRKDVPHRCSTHFDAVAQIRGEAFFFKGKYFWRLTRDRHLVSLQPAQMHRFWRGLPLHLDSVDAVYERTSDHKIVFFKGDRYWVFKDNNVEEGYPRPVSDFSLPPGGIDAAFSWAHNDRTYFFKDQLYWRYDDHTRHMDPGYPAQSPLWRGVPSTLDDAMRWSDGASYFFRGQEYWKVLDGELEVAPGYPQSTARDWLVCGDSQADGSVAAGVDAAEGPRAPPGQHDQSRSEDGYEVCSCTSGASSPPGAPGPLVAATMLLLLPPLSPGALWTAAQALTL

SEQ ID NO: 8781 - protein, 603 aa, Homo Sapiens
MRRRAARGPGPPPPGPGLSRLPLPLLLLLALGTRGGCAAPAPAPRAEDLSLGVEWLSRFGYLPPADPTTGQLQTQEELSKAITAMQQFGGLEATGILDEATLALMKTPRCSLPDLPVLTQARRRRQAPAPTKWNKRNLSWRVRTFPRDSPLGHDTVRALMYYALKVWSDIAPLNFHEVAGSAADIQIDFSKADHNDGYPFDGPGGTVAHAFFPGHHHTAGDTHFDDDEAWTFRSSDAHGMDLFAVAVHEFGHAIGLSHVAAAHSIMRPYYQGPVGDPLRYGLPYEDKVRVWQLYGVRESVSPTAQPEEPPLLPEPPDNRSSAPPRKDVPHRCSTHFDAVAQIRGEAFFFKGKYFWRLTRDRHLVSLQPAQMHRFWRGLPLHLDSVDAVYERTSDHKIVFFKGDRYWVFKDNNVEEGYPRPVSDFSLPPGGIDAAFSWAHNDRTYFFKDQLYWRYDDHTRHMDPGYPAQSPLWRGVPSTLDDAMRWSDGASYFFRGQEYWKVLDGELEVAPGYPQSTARDWLVCGDSQADGSVAAGVDAAEGPRAPPGQHDQSRSEDGYEVCSCTSGASSPPGAPGPLVAATMLLLLPPLSPGALWTAAQALTL

SEQ ID NO: 8782 - protein, 302 aa, Homo Sapiens
MYYALKVWSDIAPLNFHEVAGSAADIQIDFSKADHNDGYPFDGPGGTVAHAFFPGHHHTAGDTHFDDDEAWTFRSSDAHGMDLFAVAVHEFGHAIGLSHVAAAHSIMRPYYQGPVGDPLRYGLPYEDKVRVWQLYGVRESVSPTAQPEEPPLLPEPPDNRSSAPPRKDVPHRCSTHFDAVAQIRGEAFFFKGKYFWRLTRDRHLVSLQPAQMHRFWRGLPLHLDSVDAVYERTSDHKIVFFKGDRYWVFKDNNVEEGYPRPVSDFSLPPGGIDAAFSWAHNDRTYFFKDQLYWRYDDHTRHM

SEQ ID NO: 8783 - protein, 485 aa, Homo Sapiens
MNCQQLWLGFLLPMTVSGRVLGLAEVAPVDYLSQYGYLQKPLEGSNNFKPEDITEALRAFQEASELPVSGQLDDATRARMRQPRCGLEDPFNQKTLKYLLLARAALRQAFQDWSNVAPLTFQEVQAGAADIRLSFHGRQSSYCSNTFDGPGRVLAHADIPELGSVHFDEDEFWTEGTYRGVNLRIIAAHEVGHALGLGHSRYSQALMAPVYEGYRPHFKLHPDDVAGIQALYGKKSPVIRDEEEEETELPTVPPVPTEPSPMPDPCSSELDAMMLGPRGKTYAFKGDYVWTVSDSGPGPLFRVSALWEGLPGNLDAAVYSPRTQWIHFFKGDKVWRYINFKMSPGFPKKLNRVEPNLDAALYWPLNQKVFLFKGSGYWQWDELARTDFSSYPKPIKGLFTGVPNQPSAAMSWQDGRVYFFKGKVYWRLNQQLRVEKGYPRNISHNWMHCRPRTIDTTPSGGNTTPSGTGITLDTTLSATETTFEY

SEQ ID NO: 8784 - protein, 305 aa, Homo Sapiens
MNCQQLWLGFLLPMTVSGRVLGLAEVAPVDYLSQYGYLQKPLEGSNNFKPEDITEALRAFQEASELPVSGQLDDATRARMRQPRCGLEDPFNQKTLKYLLLGRWRKKHLTFRILNLPSTLPPHTARAALRQAFQDWSNVAPLTFQEVQAGAADIRLSFHGRQSSYCSNTFDGPGKKSPVIRDEEEEETELPTVPPVPTEPSPMPDPCSSELDAMMLGEAPPLQAVGRRWGQPADPEAWTNGSDMGLQHEQWRAPWEDLCFQGGLCVDCIRFRTGPLVPSVCPLGGAPRKPGCCCLLASNTMDSLL

SEQ ID NO: 8785 - protein, 508 aa, Homo Sapiens
MNCQQLWLGFLLPMTVSGRVLGLAEVAPVDYLSQYGYLQKPLEGSNNFKPEDITEALRAFQEASELPVSGQLDDATRARMRQPRCGLEDPFNQKTLKYLLLGRWRKKHLTFRILNLPSTLPPHTARAALRQAFQDWSNVAPLTFQEVQAGAADIRLSFHGRQSSYCSNTFDGPGRVLAHADIPELGSVHFDEDEFWTEGTYRGVNLRIIAAHEVGHALGLGHSRYSQALMAPVYEGYRPHFKLHPDDVAGIQALYGKKSPVIRDEEEEETELPTVPPVPTEPSPMPDPCSSELDAMMLGPRGKTYAFKGDYVWTVSDSGPGPLFRVSALWEGLPGNLDAAVYSPRTQWIHFFKGDKVWRYINFKMSPGFPKKLNRVEPNLDAALYWPLNQKVFLFKGSGYWQWDELARTDFSSYPKPIKGLFTGVPNQPSAAMSWQDGRVYFFKGKVYWRLNQQLRVEKGYPRNISHNWMHCRPRTIDTTPSGGNTTPSGTGITLDTTLSATETTFEY

SEQ ID NO: 8786 - protein, 81 aa, Homo Sapiens
MNCQQLWLGFLLPMTVSGRVLGLAEVAPVDYLSQYGYLQKPLEGSNNFKPEDITEALRESPGPCRHPRAGQCALRRRRVLD

SEQ ID NO: 8787 - protein, 108 aa, Homo Sapiens
MNCQQLWLGFLLPMTVSGRVLGLAEVAPVDYLSQYGYLQKPLEGSNNFKPEDITEALRPLEKEAPDFPHLEPALHPSTPHSPGSPASSLPGLEQCGSLDLPRGAGWCG

SEQ ID NO: 8788 - protein, 63 aa, Homo Sapiens
MNCQQLWLGFLLPMTVSGRVLGLAEVAPVDYLSQYGYLQKPLEGSNNFKPEDITEALSLRSAG

SEQ ID NO: 8789 - protein, 252 aa, Homo Sapiens
GTTEDYDRDKKYGFCPETGYSLFLVAAHEFGHAMGLEHSQDPGALMAPIYTYTKNFRLSQDDIKGIQELYGASPDIDLGTGPTPTLGPVTPEICKQDIVFDGIAQIRGEIFFFKDRFIWRTVTPRDKPMGPLLVATFWPELPEKIDAVYEAPQEEKAVFFAGNEYWIYSASTLERGYPKPLTSLGLPPDVQRVDAAFNWSKNKKTYIFAGDKFWRYNEVKKKMDPGFPKLIADAWNAIPDNLDAVVDLQGGG

SEQ ID NO: 8790 - protein, 660 aa, Homo Sapiens
MEALMARGALTGPLRALCLLGCLLSHAAAAPSPIIKFPGDVAPKTDKELAVQYLNTFYGCPKESCNLFVLKDTLKKMQKFFGLPQTGDLDQNTIETMRKPRCGNPDVANYNFFPRKPKWDKNQITYRIIGYTPDLDPETVDDAFARAFQVWSDVTPLRFSRIHDGEADIMINFGRWEHGDGYPFDGKDGLLAHAFAPGTGVGGDSHFDDDELWTLGEGQVVRVKYGNADGEYCKFPFLFNGKEYNSCTDTGRSDGFLWCSTTYNFEKDGKYGFCPHEALFTMGGNAEGQPCKFPFRFQGTSYDSCTTEGRTDGYRWCGTTEDYDRDKKYGFCPETAMSTVGGNSEGAPCVFPFTFLGNKYESCTSAGRSDGKMWCATTANYDDDRKWGFCPDQGYSLFLVAAHEFGHAMGLEHSQDPGALMAPIYTYTKNFRLSQDDIKGIQELYGASPDIDLGTGPTPTLGPVTPEICKQDIVFDGIAQIRGEIFFFKDRFIWRTVTPRDKPMGPLLVATFWPELPEKIDAVYEAPQEEKAVFFAGNEYWIYSASTLERGYPKPLTSLGLPPDVQRVDAAFNWSKNKKTYIFAGDKFWRYNEVKKKMDPGFPKLIADAWNAIPDNLDAVVDLQGGGHSYFFKGAYYLKLENQSLKSVKFGSIKSDWLGC

SEQ ID NO: 8791 - protein, 118 aa, Homo Sapiens
MQKFFGLPQTGDLDQNTIETMRKPRCGNPDVANYNFFPRKPKWDKNQITYRIIGYTPDLDPETVDDAFARAFQVWSDVTPLRFSRIHDGEADIMINFGRWEHGDGYPFDGKDGLLAHA

SEQ ID NO: 8792 - protein, 201 aa, Homo Sapiens
MQKFFGLPQTGDLDQNTIETMRKPRCGNPDVANYNFFPRKPKWDKNQITYRIIGYTPDLDPETVDDAFARAFQVWSDVTPLRFSRIHDGEADIMINFGRWEHGDGYPFDGKDGLLAHAFAPGTGVGGDSHFDDDELWTLGEGQVVRVKYGNADGEYCKFPFLFNGKEYNSCTDTGRSDGFLWCSTTYNFEKDGKYGFCPHE

SEQ ID NO: 8793 - protein, 584 aa, Homo Sapiens
MQKFFGLPQTGDLDQNTIETMRKPRCGNPDVANYNFFPRKPKWDKNQITYRIIGYTPDLDPETVDDAFARAFQVWSDVTPLRFSRIHDGEADIMINFGRWEHGDGYPFDGKDGLLAHAFAPGTGVGGDSHFDDDELWTLGEGQVVRVKYGNADGEYCKFPFLFNGKEYNSCTDTGRSDGFLWCSTTYNFEKDGKYGFCPHEALFTMGGNAEGQPCKFPFRFQGTSYDSCTTEGRTDGYRWCGTTEDYDRDKKYGFCPETAMSTVGGNSEGAPCVFPFTFLGNKYESCTSAGRSDGKMWCATTANYDDDRKWGFCPDQGYSLFLVAAHEFGHAMGLEHSQDPGALMAPIYTYTKNFRLSQDDIKGIQELYGASPDIDLGTGPTPTLGPVTPEICKQDIVFDGIAQIRGEIFFFKDRFIWRTVTPRDKPMGPLLVATFWPELPEKIDAVYEAPQEEKAVFFAGNEYWIYSASTLERGYPKPLTSLGLPPDVQRVDAAFNWSKNKKTYIFAGDKFWRYNEVKKKMDPGFPKLIADAWNAIPDNLDAVVDLQGGGHSYFFKGAYYLKLENQSLKSVKFGSIKSDWLGC

SEQ ID NO: 8794 - protein, 584 aa, Homo Sapiens; identical to SEQ ID NO: 8793

SEQ ID NO: 8795 - protein, 610 aa, Homo Sapiens
MQYLNTFYGCPKESCNLFVLKDTLKKMQKFFGLPQTGDLDQNTIETMRKPRCGNPDVANYNFFPRKPKWDKNQITYRIIGYTPDLDPETVDDAFARAFQVWSDVTPLRFSRIHDGEADIMINFGRWEHGDGYPFDGKDGLLAHAFAPGTGVGGDSHFDDDELWTLGEGQVVRVKYGNADGEYCKFPFLFNGKEYNSCTDTGRSDGFLWCSTTYNFEKDGKYGFCPHEALFTMGGNAEGQPCKFPFRFQGTSYDSCTTEGRTDGYRWCGTTEDYDRDKKYGFCPETAMSTVGGNSEGAPCVFPFTFLGNKYESCTSAGRSDGKMWCATTANYDDDRKWGFCPDQGYSLFLVAAHEFGHAMGLEHSQDPGALMAPIYTYTKNFRLSQDDIKGIQELYGASPDIDLGTGPTPTLGPVTPEICKQDIVFDGIAQIRGEIFFFKDRFIWRTVTPRDKPMGPLLVATFWPELPEKIDAVYEAPQEEKAVFFAGNEYWIYSASTLERGYPKPLTSLGLPPDVQRVDAAFNWSKNKKTYIFAGDKFWRYNEVKKKMDPGFPKLIADAWNAIPDNLDAVVDLQGGGHSYFFKGAYYLKLENQSLKSVKFGSIKSDWLGC

SEQ ID NO: 8796 - protein, 22 aa, Homo Sapiens
  misc_feature (1)..(1): Xaa can be any naturally occurring amino acid
XLENQSLKSVKFGSIKSDWLGC

SEQ ID NO: 8797 - protein, 483 aa, Homo Sapiens
MKVLPASGLAVFLIMALKFSTAAPSLVAASPRTWRNNYRLAQAYLDKYYTNKEGHQIGEMVARGSNSMIRKIKELQAFFGLQVTGKLDQTTMNVIKKPRCGVPDVANYRLFPGEPKWKKNTLTYRISKYTPSMSSVEVDKAVEMALQAWSSAVPLSFVRINSGEADIMISFENGDHGDSYPFDGPRGTLAHAFAPGEGLGGDTHFDNAEKWTMGTNGFNLFTVAAHEFGHALGLAHSTDPSALMYPTYKYKNPYGFHLPKDDVKGIQALYGPRKVFLGKPTLPHAPHHKPSIPDLCDSSSSFDAVTMLGKELLLFKDRIFWRRQVHLRTGIRPSTITSSFPQLMSNVDAAYEVAERGTAYFFKGPHYWITRGFQMQGPPRTIYDFGFPRHVQQIDAAVYLREPQKTLFFVGDEYYSYDERKRKMEKDYPKNTEEEFSGVNGQIDAAVELNGYIYFFSGPKTYKYDTEKEDVVSVVKSSSWIGC

SEQ ID NO: 8798 - protein, 569 aa, Homo Sapiens
MLAASIFRPTLLLCWLAAPWPTQPESLFHSRDRSDLEPSPLRQAKPIADLHAAQRFLSRYGWSGVWAAWGPSPEGPPETPKGAALAEAVRRFQRANALPASGELDAATLAAMNRPRCGVPDMRPPPPSAPPSPPGPPPRARSRRSPRAPLSLSRRGWQPRGYPDGGAAQAFSKRTLSWRLLGEALSSQLSVADQRRIVALAFRMWSEVTPLDFREDLAAPGAAVDIKLGFGRGRHLGCPRAFDGSGQEFAHAWRLGDIHFDDDEHFTPPTSDTGISLLKVAVHEIGHVLGLPHTYRTGSIMQPNYIPQEPAFELDWSDRKAIQKLYGSCEGSFDTAFDWIRKERNQYGEVMVRFSTYFFRNSWYWLYENRNNRTRYGDPIQILTGWPGIPTHNIDAFVHIWTWKRDERYFFQGNQYWRYDSDKDQALTEDEQGKSYPKLISEGFPGIPSPLDTAFYDRRQKLIYFFKESLVFAFDVNRNRVLNSYPKRITEVFPAVIPQNHPFRNIDSAYYSYAYNSIFFFKGNAYWKVVNDKDKQQNSWLPANGLFPKKFISEKWFDVCDVHISTLNM

SEQ ID NO: 8799 - protein, 183 aa, Homo Sapiens
MDPGTVATMRKPRCSLPDVLGVAGLVRRRRRYALSGSVWKKRTLTWRVRSFPQSSQLSQETVRVLMSYALMAWGMESGLTFHEVDSPQGQEPDILIDFARAFHQDSYPFDGLGGTLAHAFFPGEHPISGDTHFDDEETWTFGSKASQQLEQELAGGSPVDEELGFSRGWRVNPLGPGSPERLS

SEQ ID NO: 8800 - protein, 562 aa, Homo Sapiens
MRLRLRLLALLLLLLAPPARAPKPSAQDVSLGVDWLTRYGYLPPPHPAQAQLQSPEKLRDAIKVMQRFAGLPETGRMDPGTVATMRKPRCSLPDVLGVAGLVRRRRRYALSGSVWKKRTLTWRVRSFPQSSQLSQETVRVLMSYALMAWGMESGLTFHEVDSPQGQEPDILIDFARAFHQDSYPFDGLGGTLAHAFFPGEHPISGDTHFDDEETWTFGSKDGEGTDLFAVAVHEFGHALGLGHSSAPNSIMRPFYQGPVGDPDKYRLSQDDRDGLQQLYGKAPQTPYDKPTRKPLAPPPQPPASPTHSPSFPIPDRCEGNFDAIANIRGETFFFKGPWFWRLQPSGQLVSPRPARLHRFWEGLPAQVRVVQAAYARHRDGRILLFSGPQFWVFQDRQLEGGARPLTELGLPPGEEVDAVFSWPQNGKTYLVRGRQYWRYDEAAARPDPGYPRDLSLWEGAPPSPDDVTVSNAGDTYFFKGAHYWRFPKNSIKTEPDAPQPMGPNWLDCPAPSSGPRAPRPPKATPVSETCDCQCELNQAAGRWPAPIPLLLLPLLVGGVASR

SEQ ID NO: 8801 - protein, 261 aa, Homo Sapiens
MQLVILRVTIFLPWCFAVPVPPAADHKGWDFVEGYFHQFFLTKKESPLLTQETQTQLLQQFHRNGTDLLDMQMHALLHQPHCGVPDGSDTSISPGRCKWNKHTLTYRIINYPHDMKPSAVKDSIYNAVSIWSNVTPLIFQQVQNGDADIKVSFWQWAHEDGWPFDGPGGILGHAFLPNSGNPGVVHFDKNEHWSASDTGYNLFLVATHEIGHSLGLQHSGNQSSIMYPTYWYHDPRTFQLSADDIQRIQHLYGEKCSSDIP

SEQ ID NO: 8802 - protein, 261 aa, Homo Sapiens; identical to SEQ ID NO: 8801

SEQ ID NO: 8803 - protein, 513 aa, Homo Sapiens
MKRLLLLFLFFITFSSAFPLVRMTENEENMQLAQAYLNQFYSLEIEGNHLVQSKNRSLIDDKIREMQAFFGLTVTGKLDSNTLEIMKTPRCGVPDVGQYGYTLPGWRKYNLTYRIINYTPDMARAAVDEAIQEGLEVWSKVTPLKFTKISKGIADIMIAFRTRVHGRCPRYFDGPLGVLGHAFPPGPGLGGDTHFDEDENWTKDGAGFNLFLVAAHEFGHALGLSHSNDQTALMFPNYVSLDPRKYPLSQDDINGIQSIYGGLPKEPAKPKEPTIPHACDPDLTFDAITTFRREVMFFKGRHLWRIYYDITDVEFELIASFWPSLPADLQAAYENPRDKILVFKDENFWMIRGYAVLPDYPKSIHTLGFPGRVKKIDAAVCDKTTRKTYFFVGIWCWRFDEMTQTMDKGFPQRVVKHFPGISIRVDAAFQYKGFFFFSRGSKQFEYDIKTKNITRIMRTNTWFQCKEPKNSSFGFDINKEKAHSGGIKILYHKSLSLFIFGIVHLLKNTSIYQ

SEQ ID NO: 8804 - protein, 89 aa, Homo Sapiens
DFETWDSYSPQGRRPETQGPKYCHSSFDAITVDRQQQLYIFKGSHFWEVAADGNVSEPRPLQERWVGLPPNIEAAAVSLNDGDFYFFKA

SEQ ID NO: 8805 - protein, 189 aa, Homo Sapiens
KYGYLNEQVPKAPTSTRFSDAIRAFQWVSQLPVSGVLDRATLRQMTRPRCGVTDTNSYAAWAERISDLFARHRTKMRRKKRFAKQGGALAHAFLPRRGEAHFDQDERWSLSRRRGRNLFVVLAHEIGHTLGLTHSPAPRALMAPYYKRLGRDALLSWDDVLAVQSLYGKPLGGSVAVQLPGKLFTDFET

SEQ ID NO: 8806 - protein, 130 aa, Homo Sapiens
MVARVGLLLRALQLLLWGHLDAQPAERGGQELRKEAEAFLEKYGYLNEQVPKAPTSTRFSDAIRAFQWVSQLPVSGVLDRATLRQMTRPRCGVTDTNSYAAWAERISDLFARHRTKMRRKKRFAKQGEHC

SEQ ID NO: 8807 - protein, 510 aa, Homo Sapiens
MVARVGLLLRALQLLLWGHLDAQPAERGGQELRKEAEAFLEKYGYLNEQVPKAPTSTRFSDAIRAFQWVSQLPVSGVLDRATLRQMTRPRCGVTDTNSYAAWAERISDLFARHRTKMRRKKRFAKQGNKWYKQHLSYRLVNWPEHLPEPAVRGAVRAAFQLWSNVSALEFWEAPATGPADIRLTFFQGDHNDGLGNAFDGPGGALAHAFLPRRGEAHFDQDERWSLSRRRGRNLFVVLAHEIGHTLGLTHSPAPRALMAPYYKRLGRDALLSWDDVLAVQSLYGKPLGGSVAVQLPGKLFTDFETWDSYSPQGRRPETQGPKYCHSSFDAITVGSHFWEVAADGNVSEPRPLQERWVGLPPNIEAAAVSLNDGDFYFFKGGRCWRFRGPKPVWGLPQLCRAGGLPRHPDAALFFPPLRRLILFKGARYYVLARGGLQVEPYYPRSLQDWGGIPEEVSGALPRPDGSIIFFRDDRYWRLDQAKLQATTSGRWATELPWMGCWHANSGSALF

SEQ ID NO: 8808 - protein, 393 aa, Homo Sapiens
MVARVGLLLRALQLLLWGHLDAQPAERGGQELRKEAEAFLEKYGYLNEQVPKAPTSTRFSDAIRAFQWVSQLPVSGVLDRATLRQMTRPRCGVTDTNSYAAWAERISDLFARHRTKMRRKKRFAKQGNKWYKQHLSYRLVNWPEHLPEPAVRGAVRAAFQLWSNVSALEFWEAPATGPADIRLTFFQGDHNDGLGNAFDGPGGALAHAFLPRRGEAHFDQDERWSLSRRRGRNLFVVLAHEIGHTLGLTHSPAPRALMAPYYKRLGRDALLSWDDVLAVQSLYGKPLGGSVAVQLPGKLFTDFETWDSYSPQGRRPETQGPKYCHSSFDAITVDRQQQLYIFKGSHFWEVAADGNVSEPRPLQERWVGLPPNIEAAAVSLNDGDFYFFKVQSV

SEQ ID NO: 8809 - protein, 520 aa, Homo Sapiens
MVARVGLLLRALQLLLWGHLDAQPAERGGQELRKEAEAFLEKYGYLNEQVPKAPTSTRFSDAIRAFQWVSQLPVSGVLDRATLRQMTRPRCGVTDTNSYAAWAERISDLFARHRTKMRRKKRFAKQGNKWYKQHLSYRLVNWPEHLPEPAVRGAVRAAFQLWSNVSALEFWEAPATGPADIRLTFFQGDHNDGLGNAFDGPGGALAHAFLPRRGEAHFDQDERWSLSRRRGRNLFVVLAHEIGHTLGLTHSPAPRALMAPYYKRLGRDALLSWDDVLAVQSLYGKPLGGSVAVQLPGKLFTDFETWDSYSPQGRRPETQGPKYCHSSFDAITVDRQQQLYIFKGSHFWEVAADGNVSEPRPLQERWVGLPPNIEAAAVSLNDGDFYFFKGGRCWRFRGPKPVWGLPQLCRAGGLPRHPDAALFFPPLRRLILFKGARYYVLARGGLQVEPYYPRSLQDWGGIPEEVSGALPRPDGSIIFFRDDRYWRLDQAKLQATTSGRWATELPWMGCWHANSGSALF

SEQ ID NO: 8810 - protein, 42 aa, Homo Sapiens
MKSLPILLLLCVAVCSAYPLDGAAREISRKLLRPQKRCETVC

SEQ ID NO: 8811 - protein, 477 aa, Homo Sapiens
MKSLPILLLLCVAVCSAYPLDGAARGEDTSMNLVQKYLENYYDLKKDVKQFVRRKDSGPVVKKIREMQKFLGLEVTGKLDSDTLEVMRKPRCGVPDVGHFRTFPGIPKWRKTHLTYRIVNYTPDLPKDAVDSAVEKALKVWEEVTPLTFSRLYEGEADIMISFAVREHGDFYPFDGPGNVLAHAYAPGPGINGDAHFDDDEQWTKDTTGTNLFLVAAHEIGHSLGLFHSANTEALMYPLYHSLTDLTRFRLSQDDINGIQSLYGPPPDSPETPLVPTEPVPPEPGTPANCDPALSFDAVSTLRGEILIFKDRHFWRKSLRKLEPELHLISSFWPSLPSGVDAAYEVTSKDLVFIFKGNQFWAIRGNEVRAGYPRGIHTLGFPPTVRKIDAAISDKEKNKTYFFVEDKYWRFDEKRNSMEPGFPKQIAEDFPGIDSKIDAVFEEFGFFYFFTGSSQLEFDPNAKKVTHTLKSNSWLNC

SEQ ID NO: 8812 - protein, 99 aa, Homo Sapiens
  misc_feature (1)..(1): Xaa can be any naturally occurring amino acid
XNQFWAIRGNEVRAGYPRGIHTLGFPPTVRKIDAAISDKEKNKTYFFVEDKYWRFDEKRNSMEPGFPKQIAEDFPGIDSKIDAVFEEFDRAGTECCLHS

SEQ ID NO: 8813 - protein, 267 aa, Homo Sapiens
MRLTVLCAVCLLPGSLALPLPQEAGGMSELQWEQAQDYLKRFYLYDSETKNANSLEAKLKEMQKFFGLPITGMLNSRVIEIMQKPRCGVPDVAEYSLFPNSPKWTSKVVTYRIVSYTRDLPHITVDRLVSKALNMWGKEIPLHFRKVVWGTADIMIGFARGAHGDSYPFDGPGNTLAHAFAPGTGLGGDAHFDEDERWTDGSSLGINFLYAATHELGHSLGMGHSSDPNAVMYPTYGNGDPQNFKLSQDDIKGIQKLYGKRSNSRKK

SEQ ID NO: 8814 - protein, 467 aa, Homo Sapiens [sequence omitted]

SEQ ID NO: 8815 - protein, 56 aa, Homo Sapiens
MFSLKTLPFLLLLHVQISKAFPVSSKEKNTKTVQHKAISEANQMQPPDLGLPSLQN

SEQ ID NO: 8816 - protein, 56 aa, Homo Sapiens; identical to SEQ ID NO: 8815

SEQ ID NO: 8817 - protein, 36 aa, Homo Sapiens
MFSLKTLPFLLLLHVQISKAFPVSSKEKNTKTVQNK

SEQ ID NO: 8818 - protein, 43 aa, Homo Sapiens
MFSLKTLPFLLLLHVQISKAFPVSSKEKNTKTVQRQKYLKSDK

SEQ ID NO: 8819 - protein, 344 aa, Homo Sapiens
  misc_feature (1)..(1): Xaa can be any naturally occurring amino acid
XKEKNTKTVQDYLEKFYQLPSNQYQSTRKNGTNVIVEKLKEMQRFFGLNVTGKPNEETLDMMKKPRCGVPDSGGFMLTPGNPKWERTNLTYRIRNYTPQLSEAEVERAIKDAFELWSVASPLIFTRISQGEADINIAFYQRDHGDNSPFDGPNGILAHAFQPGQGIGGDAHFDAEETWTNTSANYNLFLVAAHEFGHSLGLAHSSDPGALMYPNYAFRETSNYSLPQDDIDGIQAIYGLSSNPIQPTGPSTPKPCDPSLTFDAITTLRGEILFFKDRYFWRRHPQLQRVEMNFISLFWPSLPTGIQAAYEDFDRDLIFLFKDMITKDNSWSQVIPKAYQVPFQE

SEQ ID NO: 8820 - protein, 707 aa, Homo Sapiens
MSLWQPLVLVLLVLGCCFAAPRQRQSTLVLFPGDLRTNLTDRQLAEEYLYRYGYTRVAEMRGESKSLGPALLLLQKQLSLPETGELDSATLKAMRTPRCGVPDLGRFQTFEGDLKWHHHNITYWIQNYSEDLPRAVIDDAFARAFALWSAVTPLTFTRVYSRDADIVIQFGVAEHGDGYPFDGKDGLLAHAFPPGPGIQGDAHFDDDELWSLGKGVVVPTRFGNADGAACHFPFIFEGRSYSACTTDGRSDGLPWCSTTANYDTDDRFGFCPSERLYTQDGNADGKPCQFPFIFQGQSYSACTTDGRSDGYRWCATTANYDRDKLFGFCPTRADSTVMGGNSAGELCVFPFTFLGKEYSTCTSEGRGDGRLWCATTSNFDSDKKWGFCPDQGYSLFLVAAHEFGHALGLDHSSVPEALMYPMYRFTEGPPLHKDDVNGIRHLYGPRPEPEPRPPTTTTPQPTAPPTVCPTGPPTVHPSERPTAGPTGPPSAGPTGPPTAGPSTATTVPLSPVDDACNVNIFDAIAEIGNQLYLFKDGKYWRFSEGRGSRPQGPFLIADKWPALPRKLDSVFEERLSKKLFFFSGRQVWVYTGASVLGPRRLDKLGLGADVAQVTGALRSGRGKMLLFSGRRLWRFDVKAQMVDPRSASEVDRMFPGVPLDTHDVFQYREKAYFCQDRFYWRVSSRSELNQVDQVGYVTYDILQCPED

SEQ ID NO: 8821 - protein, 1228 aa, Homo Sapiens
MKGARLFVLLSSLWSGGIGLNNSKHSWTIPEDGNSQKTMPSASVPPNKIQSLQILPTTRVMSAEIATTPEARTSEDSLLKSTLPPSETSAPAEGVRNQTLTSTEKAEGVVKLQNLTLPTNASIKFNPGAESVVLSNSTLKFLQSFARKSNEQATSLNTVGGTGGIGGVGGTGGVGNRAPRETYLSRGDSSSSQRTDYQKSNFETTRGKNWCAYVHTRLSPTVILDNQVTYVPGGKGPCGWTGGSCPQRSQKISNPVYRMQHKIVTSLDWRCCPGYSGPKCQLRAQEQQSLIHTNQAESHTAVGRGVAEQQQQQGCGDPEVMQKMTDQVNYQAMKLTLLQKKIDNISLTVNDVRNTYSSLEGKVSEDKSREFQSLLKGLKSKSINVLIRDIVREQFKIFQNDMQETVAQLFKTVSSLSEDLESTRQIIQKVNESVVSIAAQQKFVLVQENRPTLTDIVELRNHIVNVRQEMTLTCEKPIKELEVKQTHLEGALEQEHSRSILYYESLNKTLSKLKEVHEQLLSTEQVSDQKNAPAAESVSNNVTEYMSTLHENIKKQSLMMLQMFEDLHIQESKINNLTVSLEMEKESLRGECEDMLSKCRNDFKFQLKDTEENLHVLNQTLAEVLFPMDNKMDKMSEQLNDLTYDMEILQPLLEQGASLRQTMTYEQPKEAIVIRKKIENLTSAVNSLNFIIKELTKRHNLLRNEVQGRDDALERRINEYALEMEDGLNKTMTIINNAIDFIQDNYALKETLSTIKDNSEIHHKCTSDMETILTFIPQFHRLNDSIQTLVNDNQRYNFVLQVAKTLAGIPRDEKLNQSNFQKMYQMFNETTSQVRKYQQNMSHLEEKLLLTTKISKNFETRLQDIESKVTQTLIPYYISVKKGSVVTNERDQALQLQVLNSRFKALEAKSIHLSINFFSLNKTLHEVLTMCHNASTSVSELNATIPKWIKHSLPDIQLLQKGLTEFVEPIIQIKTQAALSNLTCCIDRSLPGSLANVVKSQKQVKSLPKKINALKKPTVNLTTVLIGRTQRNTDNIIYPEEYSSCSRHPCQNGGTCINGRTSFTCACRHPFTGDNCTIKLVEENALAPDFSKGSYRYAPMVAFFASHTYGMTIPGPILFNNLDVNYGASYTPRTGKFRIPYLGVYVFKYTIESFSAHISGFLVVDGIDKLAFESENINSEIHCDRVLTGDALLELNYGQEVWLRLAKGTIPAKFPPVTTFSGYLLYRT

SEQ ID NO: 8822 - protein, 1228 aa, Homo Sapiens; identical to SEQ ID NO: 8821

SEQ ID NO: 8823 - protein, 970 aa, Homo Sapiens
MQHKIVTSLDWRCCPGYSGPKCQLRAQEQQSLIHTNQAESHTAVGRGVAEQQQQQGCGDPEVMQKMTDQVNYQAMKLTLLQKKIDNISLTVNDVRNTYSSLEGKVSEDKSREFQSLLKGLKSKSINVLIRDIVREQFKIFQNDMQETVAQLFKTVSSLSEDLESTRQIIQKVNESVVSIAAQQKFVLVQENRPTLTDIVELRNHIVNVRQEMTLTCEKPIKELEVKQTHLEGALEQEHSRSILYYESLNKTLSKLKEVHEQLLSTEQVSDQKNAPAAESVSNNVTEYMSTLHENIKKQSLMMLQMFEDLHIQESKINNLTVSLEMEKESLRGECEDMLSKCRNDFKFQLKDTEENLHVLNQTLAEVLFPMDNKMDKMSEQLNDLTYDMEILQPLLEQGASLRQTMTYEQPKEAIVIRKKIENLTSAVNSLNFIIKELTKRHNLLRNEVQGRDDALERRINEYALEMEDGLNKTMTIINNAIDFIQDNYALKETLSTIKDNSEIHHKCTSDMETILTFIPQFHRLNDSIQTLVNDNQRYNFVLQVAKTLAGIPRDEKLNQSNFQKMYQMFNETTSQVRKYQQNMSHLEEKLLLTTKISKNFETRLQDIESKVTQTLIPYYISVKKGSVVTNERDQALQLQVLNSRFKALEAKSIHLSINFFSLNKTLHEVLTMCHNASTSVSELNATIPKWIKHSLPDIQLLQKGLTEFVEPIIQIKTQAALSNLTCCIDRSLPGSLANVVKSQKQVKSLPKKINALKKPTVNLTTVLIGRTQRNTDNIIYPEEYSSCSRHPCQNGGTCINGRTSFTCACRHPFTGDNCTIKLVEENALAPDFSKGSYRYAPMVAFFASHTYGMTIPGPILFNNLDVNYGASYTPRTGKFRIPYLGVYVFKYTIESFSAHISGFLVVDGIDKLAFESENINSEIHCDRVLTGDALLELNYGQEVWLRLAKGTIPAKFPPVTTFSGYLLYRT

SEQ ID NO: 8824 - protein, 204 aa, Homo Sapiens
MAHKPVYQVKQKVLTSLAWRCCPGYTGPNCEHHDSMAIPEPADPGDSHQEPQDGPVSFKPGHLAAVINEVEVQQEQQEHLLGDLQNDVHRVADSLPGLWKALPGNLTAAVMEANQTGHEFPDRSLEQVLLPHVDTFLQVHFSPIWRSFNQSLHSLTQAIRNLSLDVEANRQAISRVQDSAVARADFQELGAKFEAKVQENTQRV

SEQ ID NO: 8825 - protein, 295 aa, Homo Sapiens
MGTSASWAGGMGIKGQPEAAKSWRKPKQSNWCPYPMSKLVTLLALCKTEKFLIHSQQPCPQGAPDCQKVKVMYRMAHKPVYQVKQKVLTSLAWRCCPGYTGPNCEHHDSMAIPEPADPGDSHQEPQDGPVSFKPGHLAAVINEVEVQQEQQEHLLGDLQNDVHRVADSLPGLWKALPGNLTAAVMEANQTGHEFPDRSLEQVLLPHVDTFLQVHFSPIWRSFNQSLHSLTQAIRNLSLDVEANRQAISRVQDSAVARADFQELGAKFEAKVQENTQRVGQLRQDVEDRLHAQHFT

SEQ ID NO: 8826 - protein, 109 aa, Homo Sapiens
MILSLLFSLGGPLGWGLLGAWAQASSTSLSDLQSSRTPGVWKAEAEDTGKDPVGRIMDSRIPALLRQEARTGGSALAPPVDLGVAQQPSPLACFPVTGAPTQCPSWSPY

SEQ ID NO: 8827 - protein, 949 aa, Homo Sapiens
MILSLLFSLGGPLGWGLLGAWAQASSTSLSDLQSSRTPGVWKAEAEDTGKDPVGRNWCPYPMSKLVTLLALCKTEKFLIHSQQPCPQGAPDCQKVKVMYRMAHKPVYQVKQKVLTSLAWRCCPGYTGPNCEHHDSMAIPEPADPGDSHQEPQDGPVSFKPGHLAAVINEVEVQQEQQEHLLGDLQNDVHRVADSLPGLWKALPGNLTAAVMEANQTGHEFPDRSLEQVLLPHVDTFLQVHFSPIWRSFNQSLHSLTQAIRNLSLDVEANRQAISRVQDSAVARADFQELGAKFEAKVQENTQRVGQLRQDVEDRLHAQHFTLHRSISELQADVDTKLKRLHKAQEAPGTNGSLVLATPGAGARPEPDSLQARLGQLQRNLSELHMTTARREEELQYTLEDMRATLTRHVDEIKELYSESDETFDQISKVERQVEELQVNHTALRELRVILMEKSLIMEENKEEVERQLLELNLTLQHLQGGHADLIKYVKDCNCQKLYLDLDVIREGQRDATRALEETQVSLDERRQLDGSSLQALQNAVDAVSLAVDAHKAEGERARAATSRLRSQVQALDDEVGALKAAAAEARHEVRQLHSAFAALLEDALRHEAVLAALFGEEVLEEMSEQTPGPLPLSYEQIRVALQDAASGLQEQALGWDELAARVTALEQASEPPRPAEHLEPSHDAGREEAATTALAGLARELQSLSNDVKNVGRCCEAEAGAGAASLNASLHGLHNALFATQRSLEQHQRLFHSLFGNFQGLMEANVSLDLGKLQTMLSRKGKKQQKDLEAPRKRDKKEAEPLVDIRVTGPVPGALGAALWEAGSPVAFYASFSEGTAALQTVKFNTTYINIGSSYFPEHGYFRAPERGVYLFAVSVEFGPGPGTGQLVFGGHHRTPVCTTGQGSGSTATVFAMAELQKGERVWFELTQGSITKRSLSGTAFGGFLMFKT

SEQ ID NO: 8828 - protein, 123 aa, Homo Sapiens
MSKLVTLLALCKTEKFLIHSQQPCPQGAPDCQKVKVMYRMAHKPVYQVKQKVLTSLAWRCCPGYTGPNCEHHDSMAIPEPADPGDSHQEPQDGPVSFKPGHLAAVINEVEVQQEQQEHLLGDL

SEQ ID NO: 8829 - protein, 613 aa, Homo Sapiens
MCCWPLLLLWGLLPGTAAGGSGRTYPHRTLLDSEGKYWLGWSQRGSQIAFRLQVRTAGYVGFGFSPTGAMASADIVVGGVAHGRPYLQDYFTNANRELKKDAQQDYHLEYAMENSTHTIIEFTRELHTCDINDKSITDSTVRVIWAYHHEDAGEAGPKYHDSNRGTKSLRLLNPEKTSVLSTALPYFDLVNQDVPIPNKDTTYWCQMFKIPVFQEKHHVIKVEPVIQRGHESLVHHILLYQCSNNFNDSVLESGHECYHPNMPDAFLTCETVIFAWAIGGEGFSYPPHVGLSLGTPLDPHYVLLEVHYDNPTYEEGLIDNSGLRLFYTMDIRKYDAGVIEAGLWVSLFHTIPPGMPEFQSEGHCTLECLEEALEAEKPSGIHVFAVLLHAHLAGRGIRLRHFRKGKEMKLLAYDDDFDFNFQEFQYLKEEQTILPGDNLITECRYNTKDRAEMTWGGLSTRSEMCLSYLLYYPRINLTRCASIPDIMEQLQFIGVKEIYRPVTTWPFIIKSPKQYKNLSFMDAMNKFKWTKKEGLSFNKLVLSLPVNVRCSKTDNAEWSIQGMTALPPDIERPYKAEPLVCGTSSSSSLHRDFSINLLVCLLLLSCTLSTKSL

SEQ ID NO: 8830 - protein, 115 aa, Homo Sapiens
MCCWPLLLLWGLLPGTAAGGSGRTYPHRTLLDSEGKYWLGWSQRGSQIAFRLQVRTAGYVGFGFSPTGAMASADIVVGGVAHGRPYLQPCLLVSKTEACDAKCLQQQGNCCRATC

SEQ ID NO: 8831 - protein, 545 aa, Homo Sapiens
MNSFLSVFRYPDFSFPYFPQDYFTNANRELKKDAQQDYHLEYAMENSTHTIIEFTRELHTCDINDKSITDSTVRVIWAYHHEDAGEAGPKYHDSNRGTKSLRLLNPEKTSVLSTALPYFDLVNQDVPIPNKDTTYWCQMFKIPVFQEKHHVIKVEPVIQRGHESLVHHILLYQCSNNFNDSVLESGHECYHPNMPDAFLTCETVIFAWAIGGEGFSYPPHVGLSLGTPLDPHYVLLEVHYDNPTYEEGLIDNSGLRLFYTMDIRKYDAGVIEAGLWVSLFHTIPPGMPEFQSEGHCTLECLEEALEAEKPSGIHVFAVLLHAHLAGRGIRLRHFRKGKEMKLLAYDDDFDFNFQEFQYLKEEQTILPGDNLITECRYNTKDRAEMTWGGLSTRSEMCLSYLLYYPRINLTRCASIPDIMEQLQFIGVKEIYRPVTTWPFIIKSPKQYKNLSFMDAMNKFKWTKKEGLSFNKLVLSLPVNVRCSKTDNAEWSIQGMTALPPDIERPYKAEPLVCGTSSSSSLHRDFSINLLVCLLLLSCTLSTKSL

SEQ ID NO: 8832 - protein, 125 aa, Homo Sapiens
MAVFLQLLPLLLSRAQGNPGASLDGRPGDRVNLSCGGVSHPIRWVWAPSFPACKGLSKGRRPILWASSSGTPTVPPLQPFVGRLRSLDSAPDPAAGRWVGARTGSFGPGLVAAQAPAPATDSTTP

SEQ ID NO: 8833 - protein, 193 aa, Homo Sapiens
MAVFLQLLPLLLSRAQGNPGASLDGRPGDRVNLSCGGVSHPIRWVWAPSFPACKGLSKGRRPILWASSSGTPTVPPLQPFVGRLRSLDSGIRRLELLLSAGDSGTFFCKGRHEDESRTVLHVLGDRTYCKAPGPTHALSPPHSSTCENRAPEASKGGRAQDSRGPGPGTEPALCGSGPSSPQQAPPAVHSGPC

SEQ ID NO: 8834 - protein, 197 aa, Homo Sapiens
MAVFLQLLPLLLSRAQGNPGASLDGRPGDRVNLSCGGVSHPIRWVWAPSFPACKGLSKGRRPILWASSSGTPTVPPLQPFVGRLRSLDSGIRRLELLLSAGDSGTFFCKGRHEDESRTVLHVLGDRTYCKAPGPTHAPLVKTEPQRPVKEEEPKIPGDLDQEPSLLYADLDHLALSRPRRLSTADPADASTIYAVVV

SEQ ID NO: 8835 - protein, 217 aa, Homo Sapiens
MAVFLQLLPLLLSRAQGNPGASLDGRPGDRVNLSCGGVSHPIRWVWAPSFPACKGLSKGRRPILWASSSGTPTVPPLQPFVGRLRSLDSGIRRLELLLSAGDSGTFFCKGRHEDESRTVLHVLGDRTYCKAPGPTHGACPRNRFDHSLDLLCPPHIAPLVKTEPQRPVKEEEPKIPGDLDQEPSLLYADLDHLALSRPRRLSTADPADASTIYAVVV

SEQ ID NO: 8836 - protein, 237 aa, Homo Sapiens
MAVFLQLLPLLLSRAQGNPGASLDGRPGDRVNLSCGGVSHPIRWVWAPSFPACKGLSKGRRPILWASSSGTPTVPPLQPFVGRLRSLDSGIRRLELLLSAGDSGTFFCKGRHEDESRTVLHVLGDRTYCKAPGPTHGSVYPQLLIPLLGAGLVLGLGALGLVWWLHRRLPPQPIRPLPRFALSPPHSSTCENRAPEASKGGRAQDSRGPGPGTEPALCGSGPSSPQQAPPAVHSGPC

SEQ ID NO: 8837 - protein, 222 aa, Homo Sapiens
MAVFLQLLPLLLSRAQGNPGASLDGRPGDRVNLSCGGVSHPIRWVWAPSFPACKGLSKGRRPILWASSSGTPTVPPLQPFVGRLRSLDSGIRRLELLLSAGDSGTFFCKGRHEDESRTVLHVLGDRTYCKAPGPTHGSVYPQLLIPLLGAGLVLGLGALGLVWWLHRRLPPQPIRPLPRFALSPPHSSTCENRAPEASKGGRAQDSRGPGPGTGKGMGMGRG

SEQ ID NO: 8838 - protein, 241 aa, Homo Sapiens
MAVFLQLLPLLLSRAQGNPGASLDGRPGDRVNLSCGGVSHPIRWVWAPSFPACKGLSKGRRPILWASSSGTPTVPPLQPFVGRLRSLDSGIRRLELLLSAGDSGTFFCKGRHEDESRTVLHVLGDRTYCKAPGPTHGSVYPQLLIPLLGAGLVLGLGALGLVWWLHRRLPPQPIRPLPRFAPLVKTEPQRPVKEEEPKIPGDLDQEPSLLYADLDHLALSRPRRLSTADPADASTIYAVVV

SEQ ID NO: 8839 - protein, 220 aa, Homo Sapiens
MAVFLQLLPLLLSRAQGNPGASLDGRPGDRVNLSCGGVSHPIRWVWAPSFPACKGLSKGRRPILWASSSGTPTVPPLQPFVGRLRSLDSGIRRLELLLSAGDSGTFFCKGRHEDESRTVLHVLGDRTYCKAPGPTHGSVYPQLLIPLLGAGLVLGLGALGLVWWLHRRLPPQPIRPLPRFAPLVKTEPQRPVKEEEPKIPGDLDQEPVRAWGWEGDSQNL

SEQ ID NO: 8840 - protein, 745 aa, Homo Sapiens
MGVPFFSSLRCMVDLGPCWAGGLTAEMKLLLALAGLLAILATPQPSEGAAPAVLGEVDTSLVLSSMEEAKQLVDKAYKERRESIKQRLRSGSASPMELLSYFKQPVAATRTAVRAADYLHVALDLLERKLRSLWRRPFNVTDVLTPAQLNVLSKSSGCAYQDVGVTCPEQDKYRTITGMCNNRRSPTLGASNRAFVRWLPAEYEDGFSLPYGWTPGVKRNGFPVALARAVSNEIVRFPTDQLTPDQERSLMFMQWGQLLDHDLDFTPEPAARASFVTGVNCETSCVQQPPCFPLKIPPNDPRIKNQADCIPFFRSCPACPGSNITIRNQINALTSFVDASMVYGSEEPLARNLRNMSNQLGLLAVNQRFQDNGRALLPFDNLHDDPCLLTNRSARIPCFLAGDTRSSEMPELTSMHTLLLREHNRLATELKSLNPRWDGERLYQEARKIVGAMVQIITYRDYLPLVLGPTAMRKYLPTYRSYNDSVDPRIANVFTNAFRYGHTLIQPFMFRLDNRYQPMEPNPRVPLSRVFFASWRVVLEGGIDPILRGLMATPAKLNRQNQIAVDEIRERLFEQVMRIGLDLPALNMQRSRDHGLPGYNAWRRFCGLPQPETVGQLGTVLRNLKLARKLMEQYGTPNNIDIWMGGVSEPLKRKGRVGPLLACIIGTQFRKLRDGDRFWWENEGVFSMQQRQALAQISLPRIICDNTGITTVSKNNIFMSNSYPRDFVNCSTLPALNLASWREAS

SEQ ID NO: 8841 - protein, 87 aa, Homo Sapiens [sequence omitted]

SEQ ID NO: 8842 - protein, 74 aa, Homo Sapiens
MWRSRWDASVLKAEALALLPCGLGMAFSQSHVMAARRHQHSRLIIEVDEYSSNPTQAFTFYNINQGRFQPPHVQ

SEQ ID NO: 8843 - protein, 119 aa, Homo Sapiens
MWRSRWDASVLKAEALALLPCGLGMAFSQSHVMAARRHQHSRLIIEVDEYSSNPTQAFTFYNINQGRFQPPHVQMVDPVPHDAPKPPGYTRFVCVSDTHSRTDPIQMPYGDVLIHAGDF

SEQ ID NO: 8844 - protein, 326 aa, Homo Sapiens
MWRSRWDASVLKAEALALLPCGLGMAFSQSHVMAARRHQHSRLIIEVDEYSSNPTQAFTFYNINQGRFQPPHVQMVDPVPHDAPKPPGYTRFVCVSDTHSRTDPIQMPYGDVLIHAGDFTELGLPSEVKKFNEWLGSLPYEYKIVIAGNHELTFDQEFMADLIKQDFYYFPSVSKLKPENYENVQSLLTNCIYLQDSEVTVRGFRIYGSPWQPWFYGWGFNLPRGQALLEKWNLIPEGVDILITHGPPLGFLDWVPKKMQRVGCVELLNTVQRRVQPRLHVFGHIHEGYGVMADGTTTYVNASVCTVNYQPVNPPIVIDLPTPRNS

SEQ ID NO: 8845 - protein, 326 aa, Homo Sapiens; identical to SEQ ID NO: 8844

SEQ ID NO: 8846 - protein, 209 aa, Homo Sapiens
MAASAGAGAVIAAPDSRRWLWSVLAAALGLLTAGVSALEVYTPKEIFVANGTQGKLTCKFKSTSTTGGLTSVSWSFQPEGADTTVSFFHYSQGQVYLGNYPPFKDRISWAGDLDKKDASINIENMQFIHNGTYICDVKNPPDIVVQPGHIRLYVVEKENLPVFPVWVVVGIVTAVVLGLTLLISMILAVLYRRKNSKRDYTGAQSYMHS

SEQ ID NO: 8847 - protein, 269 aa, Homo Sapiens
MAASAGAGAVIAAPDSRRWLWSVLAAALGLLTAGVSALEVYTPKEIFVANGTQGKLTCKFKSTSTTGGLTSVSWSFQPEGADTTVSFFHYSQGQVYLGNYPPFKDRISWAGDLDKKDASINIENMQFIHNGTYICDVKNPPDIVVQPGHIRLYVVEKENLPVFPVWVVVGIVTAVVLGLTLLISMILAVLYRRKNSKRDYTGCSTSESLSPVKQAPRKSPSDTEGLVKSLPSGSHQGPVIYAQLDHSGGHHSDKINKSESVVYADIRKN

SEQ ID NO: 8848 - protein, 119 aa, Homo Sapiens
MAASAGAGAVIAAPDSRRWLWSVLAAALGLLTAGVSALEVYTPKEIFVANGTQGKLTCKFKSTSTTGGLTSVSWSFQPEGADTTVSGPVIYAQLDHSGGHHSDKINKSESVVYADIRKN

SEQ ID NO: 8849 - protein, 95 aa, Homo Sapiens
MAASAGAGAVIAAPDSRRWLWSVLAAALGLLTAGVSALEVYTPKEIFVANGTQGKLTCKFKSTSTTGGLTSVSWSFQPEGADTTVSRICLCFQFG

SEQ ID NO: 8850 - protein, 183 aa, Homo Sapiens
PFSSVTAGVSALEVYTPKEIFVANGTQGKLTCKFKSTSTTGGLTSVSWSFQPEGADTTVSFFHYSQGQVYLGNYPPFKDRISWAGDLDKKDASINIENMQFIHNGTYICDVKNPPDIVVQPGHIRLYVVEKENLPVFPVWVVVGIVTAVVLGLTLLISMILAVLYRRKNSKRDYTGAQSYMHS

SEQ ID NO: 8851 - protein, 296 aa, Homo Sapiens
MGELMAFLLPLIIVLMVKHSDSRTHSLRYFRLGVSDPIHGVPEFISVGYVDSHPITTYDSVTRQKEPRAPWMAENLAPDHWERYTQLLRGWQQMFKVELKRLQRHYNHSDNVAHTIKQAWEANQHELLYQKNWLEEECIAWLKRFLEYGKDTLQRTEPPLVRVNRKETFPGVTALFCKAHGFYPPEIYMTWMKNGEEIVQEIDYGDILPSGDGTYQAWASIELDPQSSNLYSCHVEHCGVHMVLQVPQESETIPLVMKAVSGSIVLVIVLAGVGVLVWRRRPREQNGAIYLPTPDR

SEQ ID NO: 8852 - protein, 341 aa, Homo Sapiens
MGELMAFLLPLIIVLMVKHSDSRTHSLRYFRLGVSDPIHGVPEFISVGYVDSHPITTYDSVTRQKEPRAPWMAENLAPDHWERYTQLLRGWQQMFKVELKRLQRHYNHSGSHTYQRMIGCELLEDGSTTGFLQYAYDGQDFLIFNKDTLSWLAVDNVAHTIKQAWEANQHELLYQKNWLEEECIAWLKRFLEYGKDTLQRTEPPLVRVNRKETFPGVTALFCKAHGFYPPEIYMTWMKNGEEIVQEIDYGDILPSGDGTYQAWASIELDPQSSNLYSCHVEHCGVHMVLQVPQESETIPLVMKAVSGSIVLVIVLAGVGVLVWRRRPREQNGAIYLPTPDR

SEQ ID NO: 8853 - protein, 341 aa, Homo Sapiens; identical to SEQ ID NO: 8852

SEQ ID NO: 8854 - protein, 214 aa, Homo Sapiens
MGELMAFLLPLIIVLMVKHSDSRTHSLRYFRLGVSDPIHGVPEFISVGYVDSHPITTYDSVTRQKEPRAPWMAENLAPDHWERYTQLLRGWQQMFKVELKRLQRHYNHSGSHTYQRMIGCELLEDGSTTGFLQYAYDGQDFLIFNKDTLSWLAVDNVAHTIKQAWEANQHELLYQKNWLEEECIAWLKRFLEYGKDTLQRTEQNGAIYLPTPDR

SEQ ID NO: 8855 - protein, 249 aa, Homo Sapiens
MGELMAFLLPLIIVLMVKHSDSRTHSLRYFRLGVSDPIHGVPEFISVGYVDSHPITTYDSVTRQKEPRAPWMAENLAPDHWERYTQLLRGWQQMFKVELKRLQRHYNHSGSHTYQRMIGCELLEDGSTTGFLQYAYDGQDFLIFNKDTLSWLAVDNVAHTIKQAWEANQHELLYQKNWLEEECIAWLKRFLEYGKDTLQRTESETIPLVMKAVSGSIVLVIVLAGVGVLVWRRRPREQNGAIYLPTPDR

SEQ ID NO: 8856 - protein, 249 aa, Homo Sapiens; identical to SEQ ID NO: 8855

SEQ ID NO: 8857 - protein, 103 aa, Homo Sapiens
MALCALTRALRSLNLAPPTVAAPAPSLFPAAQMMNNGLLQQPSALMLLPCRPVLTSVALNANFVSWKSRTKYTITPVKMRKSGGRDHTGAGNVRSNSRPSIQR

SEQ ID NO: 8858 - protein, 96 aa, Homo Sapiens
MALCALTRALRSLNLAPPTVAAPAPSLFPAAQMMNNGLLQQPSALMLLPCRPVLTSVALNANFVSWKSRTKYTITPVKMRKSGGRDHTGGNKDRGI

SEQ ID NO: 8859 - protein, 225 aa, Homo Sapiens
MALCALTRALRSLNLAPPTVAAPAPSLFPAAQMMNNGLLQQPSALMLLPCRPVLTSVALNANFVSWKSRTKYTITPVKMRKSGGRDHTGRIRVHGIGGGHKQRYRMIDFLRFRPEETKSGPFEEKVIQVRYDPCRSADIALVAGGSRKRWIIATENMQAGDTILNSNHIGRMAVAAREGDAHPLGALPVGTLINNVESEPGRGAQYIRAAGAGNVRSNSRPSIQR

SEQ ID NO: 8860 - protein, 305 aa, Homo Sapiens [sequence omitted]

SEQ ID NO: 8861 - protein, 94 aa, Homo Sapiens
MALCALTRALRSLNLAPPTVAAPAPSLFPAAQVIHLTREEGCFHSGCRRWGLRACEAGVASLVRSHADDEQWPPPTALCLDVAPLPPSSYFCGP

SEQ ID NO: 8862 - protein, 49 aa, Homo Sapiens
MAASSLTVTLGRLASACSHSILRPSGPGAASLWSASRRFNSQSTSYLPG

SEQ ID NO: 8863 - protein, 49 aa, Homo Sapiens; identical to SEQ ID NO: 8862

SEQ ID NO: 8864 - protein, 150 aa, Homo Sapiens
MAASSLTVTLGRLASACSHSILRPSGPGAASLWSASRRFNSQSTSYLPGYVPKTSLSSPPWPEVVLPDPVEETRHHAEVVKKVNEMIVTGQYGRLFAVVHFASRQWKVTSEDLILIGNELDLACGERIRLEKVLLVGADNFTLLGKPLLG

SEQ ID NO: 8865 - protein, 205 aa, Homo Sapiens
MAASSLTVTLGRLASACSHSILRPSGPGAASLWSASRRFNSQSTSYLPGYVPKTSLSSPPWPEVVLPDPVEETRHHAEVVKKVNEMIVTGQYGRLFAVVHFASRQWKVTSEDLILIGNELDLACGERIRLEKVLLVGADNFTLLGKPLLGKDLVRVEATVIEKTESWPRIIMRFRKRKNFKKKRIVTTPQTVLRINSIEIAPCLL

SEQ ID NO: 8866 - protein, 36 aa, Homo Sapiens
MAASSLTVTLGRLASACSHSILRPSGPGADMFLKHP

SEQ ID NO: 8867 - protein, 120 aa, Homo Sapiens
MIVTGQYGRLFAVVHFASRQWKVTSEDLILIGNELDLACGERIRLEKVLLVGADNFTLLGKPLLGKDLVRVEATVIEKTESWPRIIMRFRKRKNFKKKRIVTTPQTVLRINSIEIAPCLL

SEQ ID NO: 8868 - protein, 195 aa, Homo Sapiens
MIVTGQYGRLFAVVHFASRQWKVTSEDLILIGNELDLACGERIRLEKVLLVGADNFTLLGKPLLGKDLVRVEATVIEKTESWPRIIMRFRKRKNFKKKRSKLEKVPLGPVARCWLPRRMRTEGVGHVGLGTGSPGRSQPGCHCPLATLILEGAPRGSSLAPLLLHAPRVTPPRSPSPPRSARDPTSLPFSSTLRA

SEQ ID NO: 8869 - protein, 38 aa, Homo Sapiens
EMESELTACVDVAGALWIHNLRSRGKLALGKSTTVEDK

SEQ ID NO: 8870 - protein, 212 aa, Homo Sapiens
MAAAVLGQLGALWIHNLRSRGKLALGLLSFHSVLPQSYIHTSASLDISRKWEKKNKIVYPPQLPGEPRRPAEIYHCRRQIKYSKDKMWYLAKLIRGMSIDQALAQLEFNDKKGAKIIKEVLLEAQDMAVRDHNVEFRSNLYIAESTSGRGQCLKRIRYHGRGRFGIMEKVYCHYFVKLVEGPPPPPEPPKTAVAHAKEYIQQLRSRTIVHTL

SEQ ID NO: 8871 - protein, 206 aa, Homo Sapiens
MAAAVLGQLGALWIHNLRSRGKLALGVLPQSYIHTSASLDISRKWEKKNKIVYPPQLPGEPRRPAEIYHCRRQIKYSKDKMWYLAKLIRGMSIDQALAQLEFNDKKGAKIIKEVLLEAQDMAVRDHNVEFRSNLYIAESTSGRGQCLKRIRYHGRGRFGIMEKVYCHYFVKLVEGPPPPPEPPKTAVAHAKEYIQQLRSRTIVHTL

SEQ ID NO: 8872 - protein, 232 aa, Homo Sapiens
MAAAVLGQLGKDFLVVKRQKGVEMESELTACVDVAGALWIHNLRSRGKLALGVLPQSYIHTSASLDISRKWEKKNKIVYPPQLPGEPRRPAEIYHCRRQIKYSKDKMWYLAKLIRGMSIDQALAQLEFNDKKGAKIIKEVLLEAQDMAVRDHNVEFRSNLYIAESTSGRGQCLKRIRYHGRGRFGIMEKVYCHYFVKLVEGPPPPPEPPKTAVAHAKEYIQQLRSRTIVHTL

SEQ ID NO: 8873 - protein, 126 aa, Homo Sapiens
MWYLAKLIRGMSIDQALAQLEFNDKKGAKIIKEVLLEAQDMAVRDHNVEFRSNLYIAESTSGRGQCLKRIRYHGRGRFGIMEKVYCHYFVKLVEGPPPPPEPPKTAVAHAKEYIQQLRSRTIVHTL

SEQ ID NO: 8874 - protein, 68 aa, Homo Sapiens
MRLSALLALASKVTLPPHYRYGMSPPGSVADKRKNPPWIRRRPVVVEPISDEDWYLFCGDTVEILEGK

SEQ ID NO: 8875 - protein, 99 aa, Homo Sapiens
MRLSALLALASKVTLPPHYRYGMSPPGSVADKRKNPPWIRRRPVVVEPISDEDWYLFCGDTVEILEGKDAGKQGKVVQVIRQRNWVVVGGLNTHYRYIG

SEQ ID NO: 8876 - protein, 173 aa, Homo Sapiens
MRLSALLALASKVTLPPHYRYGMSPPGSVADKRKNPPWIRRRPVVVEPISDEDWYLFCGDTVEILEGKDAGKQGKVVQVIRQRNWVVVGGLNTHYRYIGKTMDYRGTMIPSEAPLLHRQVKLVDPMDRKPTEIEWRFTEAGERVRVSTRSGRIIPKPEFPRADGIVPETWIDG

SEQ ID NO: 8877 - protein, 216 aa, Homo Sapiens
MRLSALLALASKVTLPPHYRYGMSPPGSVADKRKNPPWIRRRPVVVEPISDEDWYLFCGDTVEILEGKDAGKQGKVVQVIRQRNWVVVGGLNTHYRYIGKTMDYRGTMIPSEAPLLHRQVKLVDPMDRKPTEIEWRFTEAGERVRVSTRSGRIIPKPEFPRADGIVPETWIDGPKDTSVEDALERTYVPCLKTLQEEVMEAMGIKETRKYKKVYWY

SEQ ID NO: 8878 - protein, 216 aa, Homo Sapiens; identical to SEQ ID NO: 8877

SEQ ID NO: 8879 - protein, 148 aa, Homo Sapiens
MASVVLALRTRTAVTSLLSPTPATALAVRYASKKSGGSSKNLGGKSSGRRQGIKKMEGHYVHAGNIIATQRHFRWHPGAHVGVGKNKCLYALEEGIVRYTKEVYVPHPRNTEAVDLITRLPKGAVLYKTFVHVVPAKPEGTFKLVAML

SEQ ID NO: 8880 - protein, 94 aa, Homo Sapiens
MASVVLALRTRTAVTSLLSPTPATALAVRYASKKSGGSSKNLGGKSSGRRQGIKKMEGHYVHAGNIIATQRHFRWHPGAHVSCSVAAPLFPFLG

SEQ ID NO: 8881 - protein, 84 aa, Homo Sapiens
MASVVLALRTRTAVTSLLSPTPATALAVRYASKKSGGSSKNLGGKSSGRRQGIKKMEGHYVHAGNIIATQRHFRWHPGAHWRWK

SEQ ID NO: 8882 - protein, 93 aa, Homo Sapiens
MEGHYVHAGNIIATQRHFRWHPGAHVGVGKNKCLYALEEGIVRYTKEVYVPHPRNTEAVDLITRLPKGAVLYKTFVHVVPAKPEGTFKLVAML

SEQ ID NO: 8883 - protein, 93 aa, Homo Sapiens; identical to SEQ ID NO: 8882

SEQ ID NO: 8884 - protein, 136 aa, Homo Sapiens
  misc_feature (1)..(1): Xaa can be any naturally occurring amino acid
XSPTPATALAVRYASKKSGGSSKNLGGKSSGRRQGIKKMEGHYVHAGNIIATQRHFRWHPGAHVCVLQVGVGKNKCLYALEEGIVRYTKEVYVPHPRNTEAVDLITRLPKGAVLYKTFVHVVPAKPEGTFKLVAML

SEQ ID NO: 8885 - protein, 188 aa, Homo Sapiens [sequence omitted]

SEQ ID NO: 8886 - protein, 107 aa, Homo Sapiens
MALAMLVLVVSPWSAARGVLRNYWERLLRKLPQSRPGFPSPPWGPALAVQGPAMFTEPANDTSGSKENSSLLDSIFWMAAPKNRRTIEVNRCRRRNPQKLIKVKVMH

SEQ ID NO: 8887 - protein, 42 aa, Homo Sapiens
  misc_feature (1)..(1): Xaa can be any naturally occurring amino acid
XENSSLLDSIFWMAAPKNRRTIEVNRCRRRNPQKLIKVKSSC

SEQ ID NO: 8888 - protein, 36 aa, Homo Sapiens
MAVLAGSLLGPTSRLAGMSISRATSNARTSTAGSGA

SEQ ID NO: 8889 - protein, 92 aa, Homo Sapiens [sequence omitted]

SEQ ID NO: 8890 - protein, 92 aa, Homo Sapiens [sequence omitted]

SEQ ID NO: 8891 - protein, 92 aa, Homo Sapiens [sequence omitted]

SEQ ID NO: 8892 - protein, 184 aa, Homo Sapiens
MPRRPSGYFLSSGGAGSGSGRALGEGSGSQSRNSWSSVLTVSGHSSITMWLPSSMSFRNARSRICRRRRAQGLERLWAPESPAAGTAGPTADMAVLAGSLLGPTSRSAALLGGRWLQPRAWLGFPDAWGLPTPQQARGKARGNEYQPSNIKRKNKHGWVRRLSTPAGVQVILRRMLKGRKSLSH

SEQ ID NO: 8893 - protein, 95 aa, Homo Sapiens
MAASAFAGAVRAASGILRPLNILASSTYRNCVKNASLISALSTGRFSHIQTPVVSSTPRLTTSERNLTCGHTSVILNRLAIRKNYGKRHLQGRSD

SEQ ID NO: 8894 - protein, 170 aa, Homo Sapiens
MAASAFAGAVRAASGILRPLNILASSTYRNCVKNASLISALSTGRFSHIQTPVVSSTPRLTTSERNLTCGHTSVILNRMAPVLPSVLKLPVRSLTYFSARKGKRKTVKAVIDRFLRLHCGLWVRRKAGYKKKLWKKTPARKKRLREFVFCNKTQSKLLDKMTTSFWKRRN

SEQ ID NO: 8895 - protein, 177 aa, Homo Sapiens
MAASAFAGAVRAASGILRPLNILASSTYRNCVKNASLISALSTGRFSHIQTPVVSSTPRLTTSERNLTCGHTSVILNRMAPVLPSVLKLPVRSLTYFSARKGKRKTVKAVIDRFLRLHCGLWVRRKAGYKKKLWKKTPARKKRLREFVFCNKTQSKLLDKMTTSFWKRRNWHSPICR

SEQ ID NO: 8896 - protein, 188 aa, Homo Sapiens [sequence omitted]

SEQ ID NO: 8897 - protein, 122 aa, Homo Sapiens
MAALGTVLFSVRRLHCSVAAWAGGQWRLQQGLAANPSGYGPLTELPDWSYADGRPAPPMKGQLRRKAERETFARRVVLLSQEMDAGLQAWQLRQQKLQEEQRKQENALKPKGASLKSPLPSQ

SEQ ID NO: 8898 - protein, 110 aa, Homo Sapiens
MAALGTVLFSVRRLHCSVAAWAGGQWRLQQGLAANPSGYGPLTELPDWSYADGRPAPPMKGQLRRKAERETFAVSETSCTAVTGNGRWITSMAAQAAEVAGRTKEAGKCS

SEQ ID NO: 8899 - protein, 72 aa, Homo Sapiens
MAALGTVLFSVRRLHCSVAAWAGGQWRLQQGLAANPSGYGPLTELPDWSYAETSCTAVTGNGRWITSMAAQA

SEQ ID NO: 8900 - protein, 123 aa, Homo Sapiens
MAALGTVLFTGVRRLHCSVAAWAGGQWRLQQGLAANPSGYGPLTELPDWSYADGRPAPPMKGQLRRKAERETFARRVVLLSQEMDAGLQAWQLRQQKLQEEQRKQENALKPKGASLKSPLPSQ

SEQ ID NO: 8901 - protein, 87 aa, Homo Sapiens
MAALGTVLFTGVRRLHCSVAAWAGGQWRLQQGLAANPSGYGPLTELPDWSYAETSCTAVTGNGRWITSMAAQAAEVAGRTKEAGKCS

SEQ ID NO: 8902 - protein, 64 aa, Homo Sapiens
MKGQLRRKAERETFARRVVLLSQEMDAGLQAWQLRQQKLQEEQRKQENALKPKGASLKSPLPSQ

SEQ ID NO: 8903 - protein, 64 aa, Homo Sapiens; identical to SEQ ID NO: 8902

SEQ ID NO: 8904 - protein, 64 aa, Homo Sapiens; identical to SEQ ID NO: 8902

SEQ ID NO: 8905 - protein, 52 aa, Homo Sapiens
MKGQLRRKAERETFAVSETSCTAVTGNGRWITSMAAQAAEVAGRTKEAGKCS

SEQ ID NO: 8906 - protein, 51 aa, Homo Sapiens
MRRRVVLLSQEMDAGLQAWQLRQQKLQEEQRKQENALKPKGASLKSPLPSQ

SEQ ID NO: 8907 - protein, 52 aa, Homo Sapiens
MVKIFSTCYLLDELYCCHRKWTLDYKHGSSGSRSCRKNKGSRKMLLNPKGLH

SEQ ID NO: 8908 - protein, 5 aa, Homo Sapiens
MAAVG

SEQ ID NO: 8909 - protein, 9 aa, Homo Sapiens
MAAVGSLLG

SEQ ID NO: 8910 - protein, 164 aa, Homo Sapiens
MAAVGSLLGLAASSWLGGQNASDHSLWLLRKPRGSSCPGTGHQLCRLRQSTVKATGPALRRLHTSSWRADSSRASLTRVHRQAYARLYPVLLVKQDGSTIHIRYREPRRMLAMPIDLDTLSPEERRARLRKREAQLQSRKEYEQELSDDLHVERYRQFWTRTKK

SEQ ID NO: 8911 - protein, 164 aa, Homo Sapiens; identical to SEQ ID NO: 8910

SEQ ID NO: 8912 - protein, 24 aa, Homo Sapiens
MAAVGSLLGRLRQSTVKATGPALR

SEQ ID NO: 8913 - protein, 43 aa, Homo Sapiens
MAAVGSLLGRLRQSTVKATGPALRRLHTSSWRADSSRASLTRV

SEQ ID NO: 8914 - protein, 76 aa, Homo Sapiens
MAAVGSLLGRLRQSTVKATGPALRRLHTSSWRADSSRASLTRVHRQAYARLYPVLLVKQDGSTIHIRYREPRRMLA

SEQ ID NO: 8915 - protein, 128 aa, Homo Sapiens
MAAVGSLLGRLRQSTVKATGPALRRLHTSSWRADSSRASLTRVHRQAYARLYPVLLVKQDGSTIHIRYREPRRMLAMPIDLDTLSPEERRARLRKREAQLQSRKEYEQELSDDLHVERYRQFWTRTKK

SEQ ID NO: 8916 - protein, 128 aa, Homo Sapiens; identical to SEQ ID NO: 8915

SEQ ID NO: 8917 - protein, 128 aa, Homo Sapiens; identical to SEQ ID NO: 8915

SEQ ID NO: 8918 - protein, 128 aa, Homo Sapiens; identical to SEQ ID NO: 8915

SEQ ID NO: 8919 - protein, 128 aa, Homo Sapiens; identical to SEQ ID NO: 8915

SEQ ID NO: 8920 - protein, 128 aa, Homo Sapiens; identical to SEQ ID NO: 8915

SEQ ID NO: 8921 - protein, 128 aa, Homo Sapiens; identical to SEQ ID NO: 8915

SEQ ID NO: 8922 - protein, 128 aa, Homo Sapiens; identical to SEQ ID NO: 8915

SEQ ID NO: 8923 - protein, 128 aa, Homo Sapiens; identical to SEQ ID NO: 8915

SEQ ID NO: 8924 - protein, 128 aa, Homo Sapiens; identical to SEQ ID NO: 8915

SEQ ID NO: 8925 - protein, 128 aa, Homo Sapiens; identical to SEQ ID NO: 8915

SEQ ID NO: 8926 - protein, 128 aa, Homo Sapiens; identical to SEQ ID NO: 8915

SEQ ID NO: 8927 - protein, 128 aa, Homo Sapiens; identical to SEQ ID NO: 8915

SEQ ID NO: 8928 - protein, 128 aa, Homo Sapiens; identical to SEQ ID NO: 8915

SEQ ID NO: 8929 - protein, 128 aa, Homo Sapiens; identical to SEQ ID NO: 8915

SEQ ID NO: 8930 - protein, 128 aa, Homo Sapiens; identical to SEQ ID NO: 8915

SEQ ID NO: 8931 - protein, 55 aa, Homo Sapiens
MLAMPIDLDTLSPEERRARLRKREAQLQSRKEYEQELSDDLHVERYRQFWTRTKK

SEQ ID NO: 8932 - protein, 55 aa, Homo Sapiens; identical to SEQ ID NO: 8931

SEQ ID NO: 8933 - protein, 55 aa, Homo Sapiens; identical to SEQ ID NO: 8931

SEQ ID NO: 8934 - protein, 128 aa, Homo Sapiens
MAAFMLGSLLRTFKQMVPSSASGQVRSHYVDWRMWRDVKRRKMAYEYADERLRINSLRKNTILPKILQDVADEEIAALPRDSCPVRIRNRCVMTSRPRGVKRRWRLSRIVFRHLADHGQLSGIQRATW

SEQ ID NO: 8935 - protein, 60 aa, Homo Sapiens
MAAFMLGSLLRTFKQVRPLLLSTPLPLTAESHNPRVPHGSATCSARWFLHQLQAKFEVTM

SEQ ID NO: 8936 - protein, 200 aa, Homo Sapiens
GTTVLLWSLLRSSPGVERVCFRARIQPWHGGLLQPLPCSFEMGLPRRRFSSEAASYLLKSILAESGSPETKKPTFMDEEVQSILTKMTGLNLQKTFKPAIQELKPPTYKLMTQAQLEEATRQAVEAAKVRLKMPPVLEERVPINDVLAEDKILEGTETTKYVFTDISYSIPHRERFIVVREPSGTLRKASWEERDRMIQV

SEQ ID NO: 8937 - protein, 360 aa, Homo Sapiens
MAPLGTTVLLWSLLRSSPGVERVCFRARIQPWHGGLLQPLPCSFEMGLPRRRFSSEAAESGSPETKKPTFMDEEVQSILTKMTGLNLQKTFKPAIQELKPPTYKLMTQAQLEEATRQAVEAAKVRLKMPPVLEERVPINDVLAEDKILEGTETTKYVFTDISYSIPHRERFIVVREPSGTLRKASWEERDRMIQVYFPKEGRKILTPIIFKEENLRTMYSQDRHVDVLNLCFAQFEPDSTEYIKVHHKTYEDIDKRGKYDLLRSTRYFGGMVWYFVNNKKIDGLLIDQIQRDLIDDATNLVQLYHVLHPDGQSAQGAKDQAAEGINLIKVFAKTEAQKGAYIELTLQTYQEALSRHSAAS

SEQ ID NO: 8938 - protein, 360 aa, Homo Sapiens; identical to SEQ ID NO: 8937

SEQ ID NO: 8939 - protein, 168 aa, Homo Sapiens
MAPLGTTVLLWSLLRSSPGVERVCFRARIQPWHGGLLQPLPCSFEMGLPRRRFSSEAESGSPETKKPTFMDEEVQSILTKMTGLNLQKTFKPAIQELKPPTYKLMTQAQLEEATRQAVEAAKVRLKMPPVLEERVPINDVLAEDKILEGTETTKYVFTDISYSIPHRC

SEQ ID NO: 8940 - protein, 359 aa, Homo Sapiens
MAPLGTTVLLWSLLRSSPGVERVCFRARIQPWHGGLLQPLPCSFEMGLPRRRFSSEAESGSPETKKPTFMDEEVQSILTKMTGLNLQKTFKPAIQELKPPTYKLMTQAQLEEATRQAVEAAKVRLKMPPVLEERVPINDVLAEDKILEGTETTKYVFTDISYSIPHRERFIVVREPSGTLRKASWEERDRMIQVYFPKEGRKILTPIIFKEENLRTMYSQDRHVDVLNLCFAQFEPDSTEYIKVHHKTYEDIDKRGKYDLLRSTRYFGGMVWYFVNNKKIDGLLIDQIQRDLIDDATNLVQLYHVLHPDGQSAQGAKDQAAEGINLIKVFAKTEAQKGAYIELTLQTYQEALSRHSAAS

SEQ ID NO: 8941 - protein, 319 aa, Homo Sapiens
MSRNETEHRYLGTHFGAESGSPETKKPTFMDEEVQSILTKMTGLNLQKTFKPAIQELKPPTYKLMTQAQLEEATRQAVEAAKVRLKMPPVLEERVPINDVLAEDKILEGTETTKYVFTDISYSIPHRERFIVVREPSGTLRKASWEERDRMIQVYFPKEGRKILTPIIFKEENLRTMYSQDRHVDVLNLCFAQFEPDSTEYIKVHHKTYEDIDKRGKYDLLRSTRYFGGMVWYFVNNKKIDGLLIDQIQRDLIDDATNLVQLYHVLHPDGQSAQGAKDQAAEGINLIKVFAKTEAQKGAYIELTLQTYQEALSRHSAAS

SEQ ID NO: 8942 - protein, 51 aa, Homo Sapiens
MVQTGRSEGIPGWEQSMSKGREIPGSDSESGSPETKKPTFMDEEVQSILTK

SEQ ID NO: 8943 - protein, 121 aa, Homo Sapiens
  misc_feature (1)..(1): Xaa can be any naturally occurring amino acid
XKYVFTDISYSIPHRERFIVVREPSGTLRKASWEERDRMIQVYFPKEGRKILTPIIFKEENLRFEPDSTEYIKVHHKTYEDIDKRGKYDLLRSTRYFGGMVWYFVNNKKIDGLLIDQIQRD

SEQ ID NO: 8944 - protein, 165 aa, Homo Sapiens
  misc_feature (1)..(1): Xaa can be any naturally occurring amino acid
XTTVLLWSLLRSSPGVERVCFRARIQPWHGGLLQPLPCSFEMGLPRRRFSSEAAESGSPETKKPTFMDEEVQSILTKMTGLNLQKTFKPAIQELKPPTYKLMTQAQLEEATRQAVEAAKVRLKMPPVLEERVPINDVLAEDKILEGTETTKYVFTDISYSIPHRC

SEQ ID NO: 8945 - protein, 86 aa, Homo Sapiens
MAALCRTRAVAAESHFLRVFLFFRPFRGVGTESGSESGSSNAKEPKTRAGGFASALERHSELLQKVEPLQKEIPERNQGPVAAIRS

SEQ ID NO: 8946 - protein, 187 aa, Homo Sapiens
MAALCRTRAVAAESHFLRVFLFFRPFRGVGTESGSESGSSNAKEPKTRAGGFASALERHSELLQKVEPLQKGSPKNVESFASMLRHSPLTQMGPAKDKLVIGRIFHIVENDLYIDFGGKFHCVCRRPEVDGEKYQKGTRVRLRLLDLELTSRFLGATTDTTVLEANAVLLGIQESKDSRSKEEHHEK

SEQ ID NO: 8947 - protein, 109 aa, Homo Sapiens
MLPRLVLNSWVQVILLRWPPKVLGLQMTDMGPAKDKLVIGRIFHIVENDLYIDFGGKFHCVCRRPEVDGEKYQKGTRVRLRLLDLELTSRFLGATTDTTVLEANAVLLG

SEQ ID NO: 8948 - protein, 125 aa, Homo Sapiens
MLPRLVLNSWVQVILLRWPPKVLGLQMTDMGPAKDKLVIGRIFHIVENDLYIDFGGKFHCVCRRPEVDGEKYQKGTRVRLRLLDLELTSRFLGATTDTTVLEANAVLLGIQESKDSRSKEEHHEK

SEQ ID NO: 8949 - protein, 103 aa, Homo Sapiens
MLRHSPLTQMGPAKDKLVIGRIFHIVENDLYIDFGGKFHCVCRRPEVDGEKYQKGTRVRLRLLDLELTSRFLGATTDTTVLEANAVLLGIQESKDSRSKEEHH

SEQ ID NO: 8950 - protein, 143 aa, Homo Sapiens
  misc_feature (1)..(1): Xaa can be any naturally occurring amino acid
XFCVAFAYWAGSVHTALVFLGLNAGGKGSPKNVESFASMLRHSPLTQMGPAKDKLVIGRIFHIVENDLYIDFGGKFHCVCRRPEVDGEKYQKGTRVRLRLLDLELTSRFLGATTDTTVLEANAVLLGIQESKDSRSKEEHHEK

SEQ ID NO: 8951 - protein, 83 aa, Homo Sapiens
  misc_feature (1)..(1): Xaa can be any naturally occurring amino acid
XMLRHSPLTQMGPAKDKLVIGRIFHIVENDLYIDFGGKFHCVCRRPEVDGESPISWYAVWRRFSQVMITCFSSNSDFGKHRKR

SEQ ID NO: 8952 - protein, 163 aa, Homo Sapiens
  misc_feature (1)..(1): Xaa can be any naturally occurring amino acid
XTRAVAAESHFLRVFLFFRPFRGVGTESGSESGSSNAKEPKTRAGGFASALERHSELLQKRWGFAMLPRLVLNSWVQVILLRWPPKVLGLQMTDGSPKNVESFASMLRHSPLTQMGPAKDKLVIGRIFHIVENDLYIDFGGKFHCVCRRPEVDGEKYQKGTRV

SEQ ID NO: 8953 - protein, 170 aa, Homo Sapiens
MESTSQDRRATHVITIKPNETVLTAFPYRPHSSLLDFLKGEPRVLGATQILLALIIVGFGTIFALNYIGFSQRLPLVVLTGYPFWGALIFILTGYLTVTDKKSKLLGQGVTGMNVISSLVAITGITFTILSYRHQDKYCQMPSFEEICVFSRTLFIDFILLTPPHSSHFL

SEQ ID NO: 8954 - protein, 712 aa, Homo Sapiens
MESTSQDRRATHVITIKPNETVLTAFPYRPHSSLLDFLKGEPRVLGATQILLALIIVGFGTIFALNYIGFSQRLPLVVLTGYPFWGALIFILTGYLTVTDKKSKLLGQGVTGMNVISSLVAITGITFTILSYRHQDKYCQMPSFEEICVFSRTLFIGILLILLIISIAELSISVTIASFRSKCWTQSDEVLFFLPSDVTQNSEQPAPEENDQLQFVLQEEFSSDDSTTNAQSVIFGGYAFFKLTLSRSPLVSQPGNKGREFVPDEQKQSILPSPKFSEEEIEPLPPTLEKKPSENMSIQLDSTFKQMKDEDLQSAIVQPSQMQTKLLQDQAASLQVFPSHSALKLEDISPEDLPSQALPVEGLSEQTMPSKSTSSHVKQSSNLTANDLPPQGILSQDTSSQDMLFHDMTSQDMQSLDMLSQDTPSHAMPPQDIPSQDMLSQALSAHAILPEASTSHIVQFPEIQHLLQQPPDLQPENTEPQNQQILQMSYQDIRSEVMEETKEWKSEEELHRRKSSRRHSLNQQTKALQYLRRHSLDVQAKGQKSSKRHSLDQQSKGWQSPKQKSLDQQIKDWLSPKRHSVDKQAQLNQTKEQLPDQQAEDQQAKGEQYPEGQSKDGQVKDQQTDKEQNSKKQTQDQQTEDQPAQEKKSPKGQFQNVQAEGQQAQVEKVPKLLCQDSESQIQQYQFWQFHKGNLQAGQPRTVNLLAKNPLTG

SEQ ID NO: 8955 - protein, 679 aa, Homo Sapiens
MESTSQDRRATHVITIKPNETVLTAFPYRPHSSLLDFLKGEPRVLGATQILLALIIVGFGTIFALNYIGFSQRLPLVVLTGYPFWGALIFILTGYLTVTDKKSKLLGQGVTGMNVISSLVAITGITFTILSYRHQDKYCQMPSFEEICVFSRTLFIVLFFLPSDVTQNSEQPAPEENDQLQFVLQEEFSSDDSTTNAQSVIFGGYAFFKLTLSRSPLVSQPGNKGREFVPDEQKQSILPSPKFSEEEIEPLPPTLEKKPSENMSIQLDSTFKQMKDEDLQSAIVQPSQMQTKLLQDQAASLQVFPSHSALKLEDISPEDLPSQALPVEGLSEQTMPSKSTSSHVKQSSNLTANDLPPQGILSQDTSSQDMLFHDMTSQDMQSLDMLSQDTPSHAMPPQDIPSQDMLSQALSAHAILPEASTSHIVQFPEIQHLLQQPPDLQPENTEPQNQQILQMSYQDIRSEVMEETKEWKSEEELHRRKSSRRHSLNQQTKALQYLRRHSLDVQAKGQKSSKRHSLDQQSKGWQSPKQKSLDQQIKDWLSPKRHSVDKQAQLNQTKEQLPDQQAEDQQAKGEQYPEGQSKDGQVKDQQTDKEQNSKKQTQDQQTEDQPAQEKKSPKGQFQNVQAEGQQAQVEKVPKLLCQDSESQIQQYQFWQFHKGNLQAGQPRTVNLLAKNPLTG

SEQ ID NO: 8956 - protein, 153 aa, Homo Sapiens
MESTSQDRRATHVITIKPNETVLTAFPYRPHSSLLDFLKGEPRVLGATQILLALIIVGFGTIFALNYIGFSQRLPLVVLTGYPFWGALIGQGVTGMNVISSLVAITGITFTILSYRHQDKYCQMPSFEEICVFSRTLFIDFILLTPPHSSHFL

SEQ ID NO: 8957 - protein, 153 aa, Homo Sapiens; identical to SEQ ID NO: 8956

SEQ ID NO: 8958 - protein, 148 aa, Homo Sapiens
MESTSQDRRATHVITIKPNETVLTAFPYRPHSSLLDFLKGEPRVLGATQILLALIIVGFGTIFALNYIGFSQRLPLVVLTGYPFWGALIGQGVTGMNVISSLVAITGITFTILSYRHQDKYCQMPSFEEICVFSRTLFIGILLILLII

SEQ ID NO: 8959 - protein, 695 aa, Homo Sapiens
MESTSQDRRATHVITIKPNETVLTAFPYRPHSSLLDFLKGEPRVLGATQILLALIIVGFGTIFALNYIGFSQRLPLVVLTGYPFWGALIGQGVTGMNVISSLVAITGITFTILSYRHQDKYCQMPSFEEICVFSRTLFIGILLILLIISIAELSISVTIASFRSKCWTQSDEVLFFLPSDVTQNSEQPAPEENDQLQFVLQEEFSSDDSTTNAQSVIFGGYAFFKLTLSRSPLVSQPGNKGREFVPDEQKQSILPSPKFSEEEIEPLPPTLEKKPSENMSIQLDSTFKQMKDEDLQSAIVQPSQMQTKLLQDQAASLQVFPSHSALKLEDISPEDLPSQALPVEGLSEQTMPSKSTSSHVKQSSNLTANDLPPQGILSQDTSSQDMLFHDMTSQDMQSLDMLSQDTPSHAMPPQDIPSQDMLSQALSAHAILPEASTSHIVQFPEIQHLLQQPPDLQPENTEPQNQQILQMSYQDIRSEVMEETKEWKSEEELHRRKSSRRHSLNQQTKALQYLRRHSLDVQAKGQKSSKRHSLDQQSKGWQSPKQKSLDQQIKDWLSPKRHSVDKQAQLNQTKEQLPDQQAEDQQAKGEQYPEGQSKDGQVKDQQTDKEQNSKKQTQDQQTEDQPAQEKKSPKGQFQNVQAEGQQAQVEKVPKLLCQDSESQIQQYQFWQFHKGNLQAGQPRTVNLLAKNPLTG

SEQ ID NO: 8960 - protein, 662 aa, Homo Sapiens
MESTSQDRRATHVITIKPNETVLTAFPYRPHSSLLDFLKGEPRVLGATQILLALIIVGFGTIFALNYIGFSQRLPLVVLTGYPFWGALIGQGVTGMNVISSLVAITGITFTILSYRHQDKYCQMPSFEEICVFSRTLFIVLFFLPSDVTQNSEQPAPEENDQLQFVLQEEFSSDDSTTNAQSVIFGGYAFFKLTLSRSPLVSQPGNKGREFVPDEQKQSILPSPKFSEEEIEPLPPTLEKKPSENMSIQLDSTFKQMKDEDLQSAIVQPSQMQTKLLQDQAASLQVFPSHSALKLEDISPEDLPSQALPVEGLSEQTMPSKSTSSHVKQSSNLTANDLPPQGILSQDTSSQDMLFHDMTSQDMQSLDMLSQDTPSHAMPPQDIPSQDMLSQALSAHAILPEASTSHIVQFPEIQHLLQQPPDLQPENTEPQNQQILQMSYQDIRSEVMEETKEWKSEEELHRRKSSRRHSLNQQTKALQYLRRHSLDVQAKGQKSSKRHSLDQQSKGWQSPKQKSLDQQIKDWLSPKRHSVDKQAQLNQTKEQLPDQQAEDQQAKGEQYPEGQSKDGQVKDQQTDKEQNSKKQTQDQQTEDQPAQEKKSPKGQFQNVQAEGQQAQVEKVPKLLCQDSESQIQQYQFWQFHKGNLQAGQPRTVNLLAKNPLTG

SEQ ID NO: 8961 - protein, 94 aa, Homo Sapiens
MESTSQDRRATHVITIKPNETVLTAFPYRPHSSLLDFLKGEPRVLGATQILLALIIVGFGTIFALNYIGFSQRLPLVVLTGYPFWGALIVSTVD

SEQ ID NO: 8962 - protein, 567 aa, Homo Sapiens
MNVISSLVAITGITFTILSYRHQDKYCQMPSFEEICVFSRTLFIVLFFLPSDVTQNSEQPAPEENDQLQFVLQEEFSSDDSTTNAQSVIFGGYAFFKLTLSRSPLVSQPGNKGREFVPDEQKQSILPSPKFSEEEIEPLPPTLEKKPSENMSIQLDSTFKQMKDEDLQSAIVQPSQMQTKLLQDQAASLQVFPSHSALKLEDISPEDLPSQALPVEGLSEQTMPSKSTSSHVKQSSNLTANDLPPQGILSQDTSSQDMLFHDMTSQDMQSLDMLSQDTPSHAMPPQDIPSQDMLSQALSAHAILPEASTSHIVQFPEIQHLLQQPPDLQPENTEPQNQQILQMSYQDIRSEVMEETKEWKSEEELHRRKSSRRHSLNQQTKALQYLRRHSLDVQAKGQKSSKRHSLDQQSKGWQSPKQKSLDQQIKDWLSPKRHSVDKQAQLNQTKEQLPDQQAEDQQAKGEQYPEGQSKDGQVKDQQTDKEQNSKKQTQDQQTEDQPAQEKKSPKGQFQNVQAEGQQAQVEKVPKLLCQDSESQIQQYQFWQFHKGNLQAGQPRTVNLLAKNPLTG

SEQ ID NO: 8963 - protein, 139 aa, Homo Sapiens
  misc_feature (1)..(1): Xaa can be any naturally occurring amino acid
XRVLGATQILLALIIVGFGTIFALNYIGFSQRLPLVVLTGYPFWGALIFILTGYLTVTDKKSKLLGQGVTGMNVISSLVAITGITFTILSYRHQDKYCQMPSFEEICVFSRTLFIVSGLILHEESLKSSLNCVHDVMIH

SEQ ID NO: 8964 - protein, 214 aa, Homo Sapiens
MASHEVDNAELGSASAHGTPGSEAGPEELNTSVYQPIDGSPDYQKAKLQVLGAIQILNAAMILALGVFLGSLQYPYHFQKHFFFFTFYTGYPIWGAVFFCSSGTLSVVAGIKPTRTWIQNSFGMNIASATIALVGTAFLSLNIAVNIQSLRSCHSSSESPDLCNYMGSISNGMVSLLLILTLLELCVTISTIAMWCNANCCNSREEISSPPNSV

SEQ ID NO: 8965 - protein, 168 aa, Homo Sapiens
MASHEVDNAELGSASAHGTPGSEAGPEELNTSVYQPIDGSPDYQKAKLQVLGFCSSGTLSVVAGIKPTRTWIQNSFGMNIASATIALVGTAFLSLNIAVNIQSLRSCHSSSESPDLCNYMGSISNGMVSLLLILTLLELCVTISTIAMWCNANCCNSREEISSPPNSV

SEQ ID NO: 8966 - protein, 168 aa, Homo Sapiens; identical to SEQ ID NO: 8965

SEQ ID NO: 8967 - protein, 83 aa, Homo Sapiens
MASHEVDNAELGSASAHGTPGSEAGPEELNTSVYQPIDGSPDYQKAKLQVLGSIQREEDEDEDLYDNLLPLNEYSVVQEPCLL

SEQ ID NO: 8968 - protein, 91 aa, Homo Sapiens
MNIASATIALVGTAFLSLNIAVNIQSLRSCHSSSESPDLCNYMGSISNGMVSLLLILTLLELCVTISTIAMWCNANCCNSREEISSPPNSV

SEQ ID NO: 8969 - protein, 1137 aa, Homo Sapiens
MSRRKPASGGLAASSSAPARQAVLSRFFQSTGSLKSTSSSTGAADQVDPGAAAAAAAAAAAAPPAPPAPAFPPQLPPHIATEIDRRKKRPLENDGPVKKKVKKVQQKEGGSDLGMSGNSEPKKCLRTRNVSKSLEKLKEFCCDSALPQSRVQTESLQERFAVLPKCTDFDDISLLHAKNAVSSEDSKRQINQKDTTLFDLSQFGSSNTSHENLQKTASKSANKRSKSIYTPLELQYIEMKQQHKDAVLCVECGYKYRFFGEDAEIAARELNIYCHLDHNFMTASIPTHRLFVHVRRLVAKGYKVGVVKQTETAALKAIGDNRSSLFSRKLTALYTKSTLIGEDVNPLIKLDDAVNVDEIMTDTSTSYLLCISENKENVRDKKKGNIFIGIVGVQPATGEVVFDSFQDSASRSELETRMSSLQPVELLLPSALSEQTEALIHRATSVSVQDDRIRVERMDNIYFEYSHAFQAVTEFYAKDTVDIKGSQIISGIVNLEKPVICSLAAIIKYLKEFNLEKMLSKPENFKQLSSKMEFMTINGTTLRNLEILQNQTDMKTKGSLLWVLDHTKTSFGRRKLKKWVTQPLLKLREINARLDAVSEVLHSESSVFGQIENHLRKLPDIERGLCSIYHKKCSTQEFFLIVKTLYHLKSEFQAIIPAVNSHIQSDLLRTVILEIPELLSPVEHYLKILNEQAAKVGDKTELFKDLSDFPLIKKRKDEIQGVIDEIRMHLQEIRKILKNPSAQYVTVSGQEFMIEIKNSAVSCIPTDWVKVGSTKAVSRFHSPFIVENYRHLNQLREQLVLDCSAEWLDFLEKFSEHYHSLCKAVHHLATVDCIFSLAKVAKQGDYCRPTVQEERKIVIKNGRHPVIDVLLGEQDQYVPNNTDLSEDSERVMIITGPNMGGKSSYIKQVALITIMAQIGSYVPAEEATIGIVDGIFTRMGAADNIYKGQSTFMEELTDTAEIIRKATSQSLVILDELGRGTSTHDGIAIAYATLEYFIRDVKSLTLFVTHYPPVCELEKNYSHQVGNYHMGFLVSEDESKLDPGAAEQVPDFVTFLYQITRGIAARSYGLNVAKLADVPGEILKKAAHKSKELEGLINTKRKRLKYFAKLWTMHNAQDLQKWTEEFNMEETQTSLLH

SEQ ID NO: 8970 - protein, 166 aa, Homo Sapiens
GYSRPRYSPQVLGVRIQNGRHPLMELCARTFVPNSTECGGDKGRVKVITGPNSSGKSIYLKQVAKAVNNATAQSLVLIDEFGKGTNTVDGLALLAAVLRHWLARGPTCPHIFVATNFLSLVQLQLLPQGPLVQYLDWPRVSGQEGGLRRCCEGQPCLPHSCPGWAS

SEQ ID NO: 8971 - protein, 333 aa, Homo Sapiens
KILFLSSIIPFDCLLTVRALGGLLKFLGRRRIGVELEDYNVSVPILGFKKFMLTHLVNIDQDTYSVLQIFKSESHPSVYKVASGLKEGLSLFGILNRCHCKWGEKLLRLWFTRPTHDLGELSSRLDVIQFFLLPQNLDMAQMLHRLLGHIKNVPLILKRMKLSHTKVSDWQVLYKTVYSALGLRDACRSLPQSIQLFRDIAQEFSDDLHHIASLIGKVYLSPQVDFEGSLAENRFTVLPNIDPEIDEKKRRLMGLPSFLTEVARKELENLDSRIPSCSVIYIPLIGFLLSIPRLPSMVEASDFEINGLDFMFLSEEKLHYRSARTKELDALLG

SEQ ID NO: 8972 - protein, 822 aa, Homo Sapiens
MASLGANPRRTPQGPRPGAASSGFPSPAPVPGPREAEEEEVEEEEELAEIHLCVLWNSGYLGIAYYDTSDSTIHFMPDAPDHESLKLLQRVLDEINPQSVVTSAKQDENMTRFLGKLASQEHREPKRPEIIFLPSVDFGLEISKQRLLSGNYSFIPDAMTATEKILFLSSIIPFDCLLTPPGDLRFTPIPLLIPSQVRALGGLLKFLGRRRIGVELEDYNVSVPILGFKKFMLTHLVNIDQDTYSVLQIFKSESHPSVYKVASGLKEGLSLFGILNRCHCKWGEKLLRLWFTRPTHDLGELSSRLDVIQFFLLPQNLDMAQMLHRLLGHIKNVPLILKRMKLSHTKVSDWQVLYKTVYSALGLRDACRSLPQSIQLFRDIAQEFSDDLHHIASLIGKVVDFEGSLAENRFTVLPNIDPEIDEKKRRLMGLPSFLTEVARKELENLDSRIPSCSVIYIPLIGFLLSIPRLPSMVEASDFEINGLDFMFLSEEKLHYRSARTKELDALLGDLHCEIRDQETLLMYQLQCQVLARAAVLTRVLDLASRLDVLLALASAARDYGYSRPRYSPQVLGVRIQNGRHPLMELCARTFVPNSTECGGDKGRVKVITGPNSSGKSIYLKQVGLITFMALVGSFVPAEEAEIGAVDAIFTRIHSCESISLGLSTFMIDLNQQVAKAVNNATAQSLVLIDEFGKGTNTVDGLALLAAVLRHWLARGPTCPHIFVATNFLSLVQLQLLPQGPLVQYLTMETCEDGNDLVFFYQVSDLIRSGKPIKPVKDLLKKNQMENCQTLVDKFMKLDLEDPNLDLNVFMSQEVLPAATSIL

SEQ ID NO: 8973 - protein, 194 aa, Homo Sapiens
MASLGANPRRTPQGPRPGAASSGFPSPAPVPGPREAEEEEVEEEEELAEIHLCVLWNSGYLGIAYYDTSDSTIHFMPDAPDHESLKLLQRVLDEINPQSVVTSAKQDENMTRFLGKLASQEHREPKRPEIIFLPSVDFGLEISKQRLLSGNYSFIPDAMTATEKILFLSSIIPFDCLLTVRALGGLLKFLGRRR

SEQ ID NO: 8974 - protein, 834 aa, Homo Sapiens
MASLGANPRRTPQGPRPGAASSGFPSPAPVPGPREAEEEEVEEEEELAEIHLCVLWNSGYLGIAYYDTSDSTIHFMPDAPDHESLKLLQRVLDEINPQSVVTSAKQDENMTRFLGKLASQEHREPKRPEIIFLPSVDFGLEISKQRLLSGNYSFIPDAMTATEKILFLSSIIPFDCLLTVRALGGLLKFLGRRRIGVELEDYNVSVPILGFKKFMLTHLVNIDQDTYSVLQIFKSESHPSVYKVASGLKEGLSLFGILNRCHCKWGEKLLRLWFTRPTHDLGELSSRLDVIQFFLLPQNLDMAQMLHRLLGHIKNVPLILKRMKLSHTKVSDWQVLYKTVYSALGLRDACRSLPQSIQLFRDIAQEFSDDLHHIASLIGKVVDFEGSLAENRFTVLPNIDPEIDEKKRRLMGLPSFLTEVARKELENLDSRIPSCSVIYIPLIGFLLSIPRLPSMVEASDFEINGLDFMFLSEEKLHYRSARTKELDALLGDLHCEIRDQETLLMYQLQCQVLARAAVLTRVLDLASRLDVLLALASAARDYGYSRPRYSPQVLGVRIQNGRHPLMELCARTFVPNSTECGGDKGRVKVITGPNSSGKSIYLKQVGLITFMALVGSFVPAEEAEIGAVDAIFTRIHSCESISLGLSTFMIDLNQVAKAVNNATAQSLVLIDEFGKGTNTVDGLALLAAVLRHWLARGPTCPHIFVATNFLSLVQLQLLPQGPLVQYLTMETCEDGNDLVFFYQVCEGVAKASHASHTAAQAGLPDKLVARGKEVSDLIRSGKPIKPVKDLLKKNQMENCQTLVDKFMKLDLEDPNLDLNVFMSQEVLPAATSIL

SEQ ID NO: 8975 - protein, 835 aa, Homo Sapiens
MASLGANPRRTPQGPRPGAASSGFPSPAPVPGPREAEEEEVEEEEELAEIHLCVLWNSGYLGIAYYDTSDSTIHFMPDAPDHESLKLLQRVLDEINPQSVVTSAKQDENMTRFLGKLASQEHREPKRPEIIFLPSVDFGLEISKQRLLSGNYSFIPDAMTATEKILFLSSIIPFDCLLTVRALGGLLKFLGRRRIGVELEDYNVSVPILGFKKFMLTHLVNIDQDTYSVLQIFKSESHPSVYKVASGLKEGLSLFGILNRCHCKWGEKLLRLWFTRPTHDLGELSSRLDVIQFFLLPQNLDMAQMLHRLLGHIKNVPLILKRMKLSHTKVSDWQVLYKTVYSALGLRDACRSLPQSIQLFRDIAQEFSDDLHHIASLIGKVVDFEGSLAENRFTVLPNIDPEIDEKKRRLMGLPSFLTEVARKELENLDSRIPSCSVIYIPLIGFLLSIPRLPSMVEASDFEINGLDFMFLSEEKLHYRSARTKELDALLGDLHCEIRDQETLLMYQLQCQVLARAAVLTRVLDLASRLDVLLALASAARDYGYSRPRYSPQVLGVRIQNGRHPLMELCARTFVPNSTECGGDKGRVKVITGPNSSGKSIYLKQVGLITFMALVGSFVPAEEAEIGAVDAIFTRIHSCESISLGLSTFMIDLNQQVAKAVNNATAQSLVLIDEFGKGTNTVDGLALLAAVLRHWLARGPTCPHIFVATNFLSLVQLQLLPQGPLVQYLTMETCEDGNDLVFFYQVCEGVAKASHASHTAAQAGLPDKLVARGKEVSDLIRSGKPIKPVKDLLKKNQMENCQTLVDKFMKLDLEDPNLDLNVFMSQEVLPAATSIL

SEQ ID NO: 8976 - protein, 834 aa, Homo Sapiens; identical to SEQ ID NO: 8974

SEQ ID NO: 8977 - protein, 637 aa, Homo Sapiens
MASLGANPRRTPQGPRPGAASSGFPSPAPVPGPREAEEEEVEEEEELAEIHLCVLWNSGYLGIAYYDTSDSTIHFMPDAPDHESLKLLQRVLDEINPQSVVTSAKQDENMTRFLGKLASQEHREPKRPEIIFLPSVDFGLEISKQRLLSGNYSFIPDAMTATEKILFLSSIIPFDCLLTVRALGGLLKFLGRRRIGVELEDYNVSVPILGFKKFMLTHLVNIDQDTYSVLQIFKSESHPSVYKVASGLKEGLSLFGILNRCHCKWGEKLLRLWFTRPTHDLGELSSRLDVIQFFLLPQNLDMAQMLHRLLGHIKNVPLILKRMKLSHTKVSDWQVLYKTVYSALGLRDACRSLPQSIQLFRDIAQEFSDDLHHIASLIGKVVDFEGSLAENRFTVLPNIDPEIDEKKRRLMGLPSFLTEVARKELENLDSRIPSCSVIYIPLIGFLLSIPRLPSMVEASDFEINGLDFMFLSEEKLHYRSARTKELDALLGDLHCEIRDQETLLMYQLQCQVLARAAVLTRVLDLASRLDVLLALASAARDYGYSRPRYSPQVLGVRIQNGRHPLMELCARTFVPNSTECGGDKGRVKVITGPNSSGKSIYLKQLRIHLPWPLHLHDRPQPGGESSEQCHCTVAGPY

SEQ ID NO: 8978 - protein, 508 aa, Homo Sapiens
MWPVLLFVFLSQTVYSALGLRDACRSLPQSIQLFRDIAQEFSDDLHHIASLIGKVVDFEGSLAENRFTVLPNIDPEIDEKKRRLMGLPSFLTEVARKELENLDSRIPSCSVIYIPLIGFLLSIPRLPSMVEASDFEINGLDFMFLSEEKLHYRSARTKELDALLGDLHCEIRDQETLLMYQLQCQVLARAAVLTRVLDLASRLDVLLALASAARDYGYSRPRYSPQVLGVRIQNGRHPLMELCARTFVPNSTECGGDKGRVKVITGPNSSGKSIYLKQVGLITFMALVGSFVPAEEAEIGAVDAIFTRIHSCESISLGLSTFMIDLNQVAKAVNNATAQSLVLIDEFGKGTNTVDGLALLAAVLRHWLARGPTCPHIFVATNFLSLVQLQLLPQGPLVQYLTMETCEDGNDLVFFYQVCEGVAKASHASHTAAQAGLPDKLVARGKEVSDLIRSGKPIKPVKDLLKKNQMENCQTLVDKFMKLDLEDPNLDLNVFMSQEVLPAATSIL

SEQ ID NO: 8979 - protein, 156 aa, Homo Sapiens
TAQSLVLIDEFGKGTNTVDGLALLAAVLRHWLARGPTCPHIFVATNFLSLVQLQLLPQGPLVQYLVCEGVAKASHASHTAAQAGLPDKLVARGKEVSDLIRSGKPIKPVKDLLKKNQMENCQTLVDKFMKLDLEDPNLDLNVFMSQEVLPAATSIL

SEQ ID NO: 8980 - protein, 159 aa, Homo Sapiens
  misc_feature (1)..(1): Xaa can be any naturally occurring amino acid
XDAPDHESLKLLQRVLDEINPQSVVTSAKQDENMTRFLGKLASQEHREPKRPEIIFLPSVDFGLEISKQRLLSGNYSFIPDAMTATEKILFLSSIIPFDCLLTVRALGGLLKFLGRRRIGVELEDYNVSVPILGFKKFMLTHLVNIDQDTYRNPQQMPL

SEQ ID NO: 8981 - protein, 43 aa, Homo Sapiens
  misc_feature (1)..(1): Xaa can be any naturally occurring amino acid
XRIGVELEDYNVSVPILGFKKFMLTHLVNIDQDTYRNPQQMPL

SEQ ID NO: 8982 - protein, 170 aa, Homo Sapiens
MALPTARPLLGSCGTPALGSLLFLLFSLGWVQPSRTLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACW

SEQ ID NO: 8983 - protein, 333 aa, Homo Sapiens [sequence omitted]

SEQ ID NO: 8984 - protein, 630 aa, Homo Sapiens
MALPTARPLLGSCGTPALGSLLFLLFSLGWVQPSRTLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQAPRRPLPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQEALSGTPCLLGPGPVLTVLALLLASTLA

SEQ ID NO: 8985 - protein, 622 aa, Homo Sapiens
MALPTARPLLGSCGTPALGSLLFLLFSLGWVQPSRTLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQEALSGTPCLLGPGPVLTVLALLLASTLA

SEQ ID NO: 8986 - protein, 622 aa, Homo Sapiens; identical to SEQ ID NO: 8985

SEQ ID NO: 8987 - protein, 622 aa, Homo Sapiens; identical to SEQ ID NO: 8985

SEQ ID NO: 8988 - protein, 398 aa, Homo Sapiens
VEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQGGRGGQARAGGRAGGVEVGALSHPSLCRGPLGDALPPRTWTCSHRPGTAPSLHPGLRAPLPCWPQPCWGSPPGQEQARVVPVPPQENSRSVNGNMPPADT

SEQ ID NO: 8989 - protein, 334 aa, Homo Sapiens
  misc_feature (1)..(1): Xaa can be any naturally occurring amino acid
XSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQGPGPVLTVLALLLASTLA

SEQ ID NO: 8990 - protein, 114 aa, Homo Sapiens
MNVLLGSVVIFATFVTLCNASCYFIPNEGVPGDSTRKCMDLKGNKHPINSEWQTDNCETCTCYETEISCCTLVSTPVGYDKDNCQRIFKKEDCKYIVVEKKDPKKTCSVSEWII

SEQ ID NO: 8991 - protein, 77 aa, Homo Sapiens
MNVLLGSVVIFATFVTLCNASCYFIPNEGVPGDSTRMFLHLWVMTKTTAKESSRRRTASISWWRRRTQKRPVLSVNG

SEQ ID NO: 8992 - protein, 59 aa, Homo Sapiens
MAVFGMGCFWGAERKFWVLKGVYSTQVGFAGGYTSNPTYKEVCSDVQNNSMFISLFKSF

SEQ ID NO: 8993 - protein, 82 aa, Homo Sapiens
MAVFGMGCFWGAERKFWVLKGVYSTQVGFAGGYTSNPTYKEVCSEKTGHAEVVRVVYQPEHMSFEELLKVFWENHDPTQGMR

SEQ ID NO: 8994 - protein, 169 aa, Homo Sapiens
MAVFGMGCFWGAERKFWVLKGVYSTQVGFAGGYTSNPTYKEVCSEKTGHAEVVRVVYQPEHMSFEELLKVFWENHDPTQGMRQGNDHGTQYRSAIYPTSAKQMEAALSSKENYQKVLSEHGFGPITTDIREGQTFYYAEDYHQQYLSKNPNGYCGLGGTGVSCPVGIKK

SEQ ID NO: 8995 - protein, 192 aa, Homo Sapiens
MCSEPKHHVNGNRTVEPFPEGTQMAVFGMGCFWGAERKFWVLKGVYSTQVGFAGGYTSNPTYKEVCSEKTGHAEVVRVVYQPEHMSFEELLKVFWENHDPTQGMRQGNDHGTQYRSAIYPTSAKQMEAALSSKENYQKVLSEHGFGPITTDIREGQTFYYAEDYHQQYLSKNPNGYCGLGGTGVSCPVGIKK

SEQ ID NO: 8996 - protein, 195 aa, Homo Sapiens
MLSATRRACQLLLLHSLFPVPRMGNSASNIVSPQEALPGRKEQTPVAAKHHVNGNRTVEPFPEGTQMAVFEKTGHAEVVRVVYQPEHMSFEELLKVFWENHDPTQGMRQGNDHGTQYRSAIYPTSAKQMEAALSSKENYQKVLSEHGFGPITTDIREGQTFYYAEDYHQQYLSKNPNGYCGLGGTGVSCPVGIKK

SEQ ID NO: 8997 - protein, 213 aa, Homo Sapiens
MLSATRRACQLLLLHSLFPVPRMGNSASNIVSPQEALPGRKEQTPVAAKHHVNGNRTVEPFPEGTQMAVFGMGCFWGAERKFWVLKGVYSTQVGFAGGYTSNPTYKEVCSEKTGHAEVVRVVYQPEHMSFEELLKVFWENHDPTQGMRQGNDHGTQYRSAIYPTSAKQMEAALSSKENYQKLVLPCSSSAMLGLTAASSAQLAWVQPSSRKHY

SEQ ID NO: 8998 - protein, 235 aa, Homo Sapiens
MLSATRRACQLLLLHSLFPVPRMGNSASNIVSPQEALPGRKEQTPVAAKHHVNGNRTVEPFPEGTQMAVFGMGCFWGAERKFWVLKGVYSTQVGFAGGYTSNPTYKEVCSEKTGHAEVVRVVYQPEHMSFEELLKVFWENHDPTQGMRQGNDHGTQYRSAIYPTSAKQMEAALSSKENYQKVLSEHGFGPITTDIREGQTFYYAEDYHQQYLSKNPNGYCGLGGTGVSCPVGIKK

SEQ ID NO: 8999 - protein, 91 aa, Homo Sapiens
  misc_feature (1)..(1): Xaa can be any naturally occurring amino acid
XKTGHAEVVRVVYQPEHMSFEELLKVFWENHDPTQGMRQGNDHGTQYRSAIYPTSAKQMEAALSSKENYQKVPKHVHWKKRTQTGLQTEGR

SEQ ID NO: 9000 - protein, 182 aa, Homo Sapiens
MARLLWLLRGLTLGTAPRRAVRGQAGGGGPGTGPGLGEAGSLATCELPLAKSEWQKKLTPEQFYVTREKGTEPPFSGIYLNNKEAGMYHCVCCDSPLFSSEKKYCSGTGWPSFSEAHGTSGSDESHTGILRRLDTSLGSARTEVVCKQCEAHLGHVFPDGPGPNGQRFCINSVALKFKPRKH

SEQ ID NO: 9001 - protein, 120 aa, Homo Sapiens
  misc_feature (1)..(1): Xaa can be any naturally occurring amino acid
XSLATCELPLAKSEWQKKLTPEQFYVTREKGTEPPFSGIYLNNKEAGMYHCVCCDSPLFRSLLDIQKEVFSIKGSRSPSTSRGNGFDSEVLRKSTALALGGLRFPRLMVRLALMKATQGS

SEQ ID NO: 9002 - protein, 84 aa, Homo Sapiens
GEYTHHKDPGIYKCVVCGTPLFKSETKFDSGSGWPSFHDVINSEAITFTDDFSYGMHRVETSCSQQEGPHQMLPLNLGFPGLQN

SEQ ID NO: 9003 - protein, 117 aa, Homo Sapiens
MSAFNLLHLVTKSQPVALRACGLPSGSCRDKKNCKVVFSQQELRKRLTPLQYHVTQEKGTESAFEGEYTHHKDPGIYKCVVCGTPLFKSETKFDSGSGWPSFHDVINSEAITFTDDF

SEQ ID NO: 9004 - protein, 164 aa, Homo Sapiens
MSAFNLLHLVTKSQPVALRACGLPSGSCRDKKNCKVVFSQQELRKRLTPLQYHVTQEKGTESAFEGEYTHHKDPGIYKCVVCGTPLFKSETKFDSGSGWPSFHDVINSEAITFTDDFSYGMHRVETSCSQCGAHLGHIFDDGPRPTGKRYCINSAALSFTPADS

SEQ ID NO: 9005 - protein, 185 aa, Homo Sapiens
MSAFNLLHLVTKSQPVALRACGLPSGSCRDKKNCKVVFSQQELRKRLTPLQYHVTQEKGTESAFEGEYTHHKDPGIYKCVVCGTPLFKSETKFDSGSGWPSFHDVINSEAITFTDDFSYGMHRVETSCSQCGAHLGHIFDDGPRPTGKRYCINSAALSFTPADSSGTAEGGSGVASPAQADKAEL

SEQ ID NO: 9006 - protein, 185 aa, Homo Sapiens; identical to SEQ ID NO: 9005

SEQ ID NO: 9007 - protein, 185 aa, Homo Sapiens; identical to SEQ ID NO: 9005

SEQ ID NO: 9008 - protein, 185 aa, Homo Sapiens; identical to SEQ ID NO: 9005

SEQ ID NO: 9009 - protein, 185 aa, Homo Sapiens; identical to SEQ ID NO: 9005

SEQ ID NO: 9010 - protein, 185 aa, Homo Sapiens; identical to SEQ ID NO: 9005

SEQ ID NO: 9011 - protein, 44 aa, Homo Sapiens
MSPRRTLPRPLSLCLSLCLCLCLAAALGSAQSALAPVLCFSFCW

SEQ ID NO: 9012 - protein, 192 aa, Homo Sapiens
MSPRRTLPRPLSLCLSLCLCLCLAAALGSAQSGSCRDKKNCKVVFSQQELRKRLTPLQYHVTQEKGTESAFEGEYTHHKDPGIYKCVVCGTPLFKSETKFDSGSGWPSFHDVINSEAITFTDDFSYGMHRVETSCSQCGAHLGHIFDDGPRPTGKRYCINSAALSFTPADSSGTAEGGSGVASPAQADKAEL

SEQ ID NO: 9013 - protein, 160 aa, Homo Sapiens
MSPRRTLPRPLSLCLSLCLCLCLAAALGSAQSGSCRDKKNCKVVFSQQELRKRLTPLQYHVTQEKGTESAFEGEYTHHKDPGIYKCVVCGTPLFKSETKFDSGSGWPSFHDVINSEAITFTDDFSYGMHRVETSCSQVSSSFLKTQYIAFRTPGCAKYSN

SEQ ID NO: 9014 - protein, 117 aa, Homo Sapiens
  misc_feature (1)..(1): Xaa can be any naturally occurring amino acid
XLRKRLTPLQYHVTQEKGTESAFEGEYTHHKDPGIYKCVVCGTPLFKSETKFDSGSGWPSFHDVINSEAITFTDDFSYGMHRVETSCSQQEGPHQMLPLNLGFPGLQNCEPINFYSF

SEQ ID NO: 9015 - protein, 174 aa, Homo Sapiens
  misc_feature (1)..(1): Xaa can be any naturally occurring amino acid
XRRRLPGLSMSPRRTLPRPLSLCLSLCLCLCLAAALGSAQSGSCRDKKNCKVVFSQQELRKRLTPLQYHVTQEKGTESAFEGEYTHHKDPGIYKCVVCGTPLFKSETKFDSGSGWPSFHDVINSEAITFTDDFSYGMHRVETSCSQQEGPHQMLPLNLGFPGLQNCEPINFYSF

SEQ ID NO: 9016 - protein, 725 aa, Homo Sapiens
MGLWWVTVQPPARRMGWLPLLLLLTQCLGVPGQRSPLNDFQVLRGTELQHLLHAVVPGPWQEDVADAEECAGRCGPLMDCRAFHYNVSSHGCQLLPWTQHSPHTRLRRSGRCDLFQKKDYVRTCIMNNGVGYRGTMATTVGGLPCQAWSHKFPNDHKYTPTLRNGLEENFCRNPDGDPGGPWCYTTDPAVRFQSCGIKSCREAACVWCNGEEYRGAVDRTESGRECQRWDLQHPHQHPFEPGKFLDQGLDDNYCRNPDGSERPWCYTTDPQIEREFCDLPRCGSEAQPRQEATTVSCFRGKGEGYRGTANTTTAGVPCQRWDAQIPHQHRFTPEKYACKDLRENFCRNPDGSEAPWCFTLRPGMRAAFCYQIRRCTDDVRPQDCYHGAGEQYRGTVSKTRKGVQCQRWSAETPHKPQFTFTSEPHAQLEENFCRNPDGDSHGPWCYTMDPRTPFDYCALRRCADDQPPSILDPPDQVQFEKCGKRVDRLDQRRSKLRVVGGHPGNSPWTVSLRNRQGQHFCGGSLVKEQWILTARQCFSSCHMPLTGYEVWLGTLFQNPQHGEPSLQRVPVAKMVCGPSGSQLVLLKLERSVTLNQRVALICLPPEWYVVPPGTKCEIAGWGETKGTGNDTVLNVALLNVISNQECNIKHRGRVRESEMCTEGLLAPVGACEGDYGGPLACFTHNCWVLEGIIIPNRVCARSRWPAVFTRVSVFVDWIHKVMRLG

SEQ ID NO: 9017 - protein, 195 aa, Homo Sapiens
  misc_feature (1)..(1): Xaa can be any naturally occurring amino acid
XAGPAFLRGVSSEGAVDTDCPAVLLLLNPQHGEPSLQRVPVAKMVCGPSGSQLVLLKLERSVTLNQRVALICLPPEWYVVPPGTKCEIAGWGETKGTGNDTVLNVALLNVISNQECNIKHRGRVRESEMCTEGLLAPVGACEGDYGGPLACFTHNCWVLEGIIIPNRVCARSRWPAVFTRVSVFVDWIHKVMRLG

SEQ ID NO: 9018 - protein, 375 aa, Homo Sapiens
MQKLQLCVYIYLFMLIVAGPVDLNENSEQKENVEKEGLCNACTWRQNTKSSRIEAIKIQILSKLRLETAPNISKDVIRQLLPKAPPLRELIDQYDVQRDDSSDGSLEDDDYHATTETIITMPTESDFLMQVDGKPKCCFFKFSSKIQYNKVVKAQLWIYLRPVETPTTVFVQILRLIKPMKDGTRYTGIRSLKLDMNPGTGIWQSIDVKTVLQNWLKQPESNLGIEIKALDENGHDLAVTFPGPGEDGLNPFLEVKVTDTPKRSRRDFGLDCDEHSTESRCCRYPLTVDFEAFGWDWIIAPKRYKANYCSGECEFVFLQKYPHTHLVHQANPRGSAGPCCTPTKMSPINMLYFNGKEQIIYGKIPAMVVDRCGCS

SEQ ID NO: 9019 - protein, 62 aa, Homo Sapiens
MDPNCSCAAAGVSCTCASSCKCKECKCTSCKKSCCSCCPVGCAKCAQGCICKGASEKCSCCA

SEQ ID NO: 9020 - protein, 39 aa, Homo Sapiens
MDPNCSCAAGCCSCCPVGCAKCAQGCICKGASEKCSCCA

SEQ ID NO: 9021 - protein, 61 aa, Homo Sapiens
MDPNCSCAAGVSCTCASSCKCKECKCTSCKKSCCSCCPVGCAKCAQGCICKGASEKCSCCA

SEQ ID NO: 9022 - protein, 68 aa, Homo Sapiens
MDPNCSCAAGVSCTCASSCKCKECKCTSCKKSECGAISRNLGLWLRLGGNPRLSLSACFWGTGLPLSL

SEQ ID NO: 9023 - protein, 36 aa, Homo Sapiens
MAATSLMSALAARLLQPAHSCSLRLRPFHLAAVRAY

SEQ ID NO: 9024 - protein, 267 aa, Homo Sapiens
MAATSLMSALAARLLQPAHSCSLRLRPFHLAAVRNEAVVISGRKLAQQIKQEVRQEVEEWVASGNKRPHLSVILVGENPASHSYVLNKTRAAAVVEHIDERRICNAVSPDKDVDGFHVINVGRMCLDQYSMLPATPWGVWEIIKRTGIPTLGKNVVVAGRSKNVGMPIAMLLHTDGAHERPGGDATVTISHRYTPKEQLKKHTILADIVISAAGVRQKAGYITPVPGGVGPMTVAMLMKNTIIAAKKVLRLEEREVLKSKELGVATN

SEQ ID NO: 9025 - protein, 222 aa, Homo Sapiens
MAATSLMSALAARLLQPAHSCSLRLRPFHLAAVRNEAVVISGRKLAQQIKQEVRQEVEEWVASGNKRPHLSVILVGENPASHSYVLNKTRAAAVVGDATVTISHRYTPKEQLKKHTILADIVISAAGIPNLITADMIKEGAAVIDVGINRVHDPVTAKPKLVGDVDFEGVRQKAGYITPVPGGVGPMTVAMLMKNTIIAAKKVLRLEEREVLKSKELGVATN

SEQ ID NO: 9026 - protein, 350 aa, Homo Sapiens
MAATSLMSALAARLLQPAHSCSLRLRPFHLAAVRNEAVVISGRKLAQQIKQEVRQEVEEWVASGNKRPHLSVILVGENPASHSYVLNKTRAAAVVGINSETIMKPASISEEELLNLINKLNNDDNVDGLLVQLPLPEHIDERRICNAVSPDKDVDGFHVINVGRMCLDQYSMLPATPWGVWEIIKRTGIPTLGKNVVVAGRSKNVGMPIAMLLHTDGAHERPGGDATVTISHRYTPKEQLKKHTILADIVISAAGIPNLITADMIKEGAAVIDVGINRVHDPVTAKPKLVGDVDFEGVRQKAGYITPVPGGVGPMTVAMLMKNTIIAAKKVLRLEEREVLKSKELGVATN

SEQ ID NO: 9027 - protein, 37 aa, Homo Sapiens
MAATSLMSALAARLLQPAHSCSLRLRPFHLAAVRNQQ

SEQ ID NO: 9028 - protein, 292 aa, Homo Sapiens
MAGARAAAAAASAGSSASSGNQPPQELGLGELLEEFSRTQYRAKDGSGTGGSKCWDLVQQTQNYLKLLLSLVNSDDDSGLLVHCISGWDRTPLFISLLRLSLWADGLIHTSLKPTEILYLTVAYDWFLFGHMLVDRLSKGEEIFFFCFNFLKHITSEEFSALKTQRRKSLPARDGGFTLEDICMLRRKDRGSTTSLGSDFSLVMESSPGATGSFTYEAVELVPAGAPTQAAWLAALSDRETRLQEVRSAFLAAYSSTVGLRAVAPSPSGAIGGLLEQFARGVGLRSISSNAL

SEQ ID NO: 9029 - protein, 71 aa, Homo Sapiens
MAGARAAAAAASAGSSASSGNQPPQELGLGELLEEFSRTQYRAKDGSGTGGSKSSYRQTWRASCQLRPSPP

SEQ ID NO: 9030 - protein, 158 aa, Homo Sapiens
MAGARAAAAAASAGSSASSGNQPPQELGLGELLEEFSRTQYRAKDGSGTGGSKVERIEKRCLELFGRDYCFSVIPNTNGDICGHYPRHIVFLEYESSEKEKDTFESTVQGVQMMPGQMWRTSRRRTVLFEVVTRIFLIRSEAMTSSCFDTCQSNTSVT

SEQ ID NO: 9031 - protein, 188 aa, Homo Sapiens
MAGARAAAAAASAGSSASSGNQPPQELGLGELLEEFSRTQYRAKDGSGTGGSKVERIEKRCLELFGRDYCFSVIPNTNGDICGHYPRHIVFLEYESSEKEKDTFESTVQVSKLQDLIHRSKMARCRGRFVCPVILFKGKGVQMMPGQMWRTSRRRTVLFEVVTRIFLIRSEAMTSSCFDTCQSNTSVT

SEQ ID NO: 9032 - protein, 650 aa, Homo Sapiens
MAGARAAAAAASAGSSASSGNQPPQELGLGELLEEFSRTQYRAKDGSGTGGSKVERIEKRCLELFGRDYCFSVIPNTNGDICGHYPRHIVFLEYESSEKEKDTFESTVQVSKLQDLIHRSKMARCRGRFVCPVILFKGKHICRSATLAGWGELYGRSGYNYFFSGGADDAWADVEDVTEEDCALRSGDTHLFDKVRGYDIKLLRYLSVKYICDLMVENKKVKFGMNVTSSEKVDKAQRYADFTLLSIPYPGCEFFKEYKDRDYMAEGLIFNWKQDYVDAPLSIPDFLTHSLNIDWSQYQCWDLVQQTQNYLKLLLSLVNSDDDSGLLVHCISGWDRTPLFISLLRLSLWADGLIHTSLKPTEILYLTVAYDWFLFGHMLVDRLSKGEEIFFFCFNFLKHITSEEFSALKTQRRKSLPARDGGFTLEDICMLRRKDRGSTTSLGSDFSLVMESSPGATGSFTYEAVELVPAGAPTQAAWRKSHSSSPQSVLWNRPQPSEDRLPSQQGLAEARSSSSSSSNHSDNFFRMGSSPLEVPKPRSVDHPLPGSSLSTDYGSWQMVTGCGSIQERAVLHTDSSLPFSFPDELPNSCLLAALSDRETRLQEVRSAFLAAYSSTVGLRAVAPSPSGAIGGLLEQFARGVGLRSISSNAL

SEQ ID NO: 9033 - protein, 598 aa, Homo Sapiens
MAGARAAAAAASAGSSASSGNQPPQELGLGELLEEFSRTQYRAKDGSGTGGSKVERIEKRCLELFGRDYCFSVIPNTNGDICGHYPRHIVFLEYESSEKEKDTFESTVQVSKLQDLIHRSKMARCRGRFVCPVILFKGKHICRSATLAGWGELYGRSGYNYFFSGGADDAWADVEDVTEEDCALRSGDTHLFDKVRGYDIKLLRYLSVKYICDLMVENKKVKFGMNVTSSEKVDKAQRYADFTLLSIPYPGCEFFKEYKDRDYMAEGLIFNWKQDYVDAPLSIPDFLTHSLNIDWSQYQCWDLVQQTQNYLKLLLSLVNSDDDSGLLVHCISGWDRTPLFISLLRLSLWADGLIHTSLKPTEILYLTVAYDWFLFGHMLVDRLSKGEEIFFFCFNFLKHITSEEFSALKTQRRKSLPARDGGFTLEDICMLRRKDRGSTTSLGSDFSLVMESSPGATGSFTYEAVELVPAGAPTQAAWRKSHSSSPQSVLWNRPQPSEDRLPSQQGLAEARSSSSSSSNHSDNFFRMGSSPLEVPKPRLAALSDRETRLQEVRSAFLAAYSSTVGLRAVAPSPSGAIGGLLEQFARGVGLRSISSNAL

SEQ ID NO: 9034 - protein, 538 aa, Homo Sapiens
MAGARAAAAAASAGSSASSGNQPPQELGLGELLEEFSRTQYRAKDGSGTGGSKVERIEKRCLELFGRDYCFSVIPNTNGDICGHYPRHIVFLEYESSEKEKDTFESTVQVSKLQDLIHRSKMARCRGRFVCPVILFKGKHICRSATLAGWGELYGRSGYNYFFSGGADDAWADVEDVTEEDCALRSGDTHLFDKVRGYDIKLLRYLSVKYICDLMVENKKVKFGMNVTSSEKVDKAQRYADFTLLSIPYPGCEFFKEYKDRDYMAEGLIFNWKQDYVDAPLSIPDFLTHSLNIDWSQYQCWDLVQQTQNYLKLLLSLVNSDDDSGLLVHCISGWDRTPLFISLLRLSLWADGLIHTSLKPTEILYLTVAYDWFLFGHMLVDRLSKGEEIFFFCFNFLKHITSEEFSALKTQRRKSLPARDGGFTLEDICMLRRKDRGSTTSLGSDFSLVMESSPGATGSFTYEAVELVPAGAPTQAAWLAALSDRETRLQEVRSAFLAAYSSTVGLRAVAPSPSGAIGGLLEQFARGVGLRSISSNAL

SEQ ID NO: 9035 - protein, 187 aa, Homo Sapiens
MAGARAAAAAASAGSSASSGNQPPQELGLGELLEEFSRTQYRAKDGSGTGGSKVERIEKRCLELFGRDYCFSVIPNTNGDICGHYPRHIVFLEYESSEKEKDTSGDTHLFDKVRGYDIKLLRYLSVKYICDLMVENKKVKFGMNVTSSEKVDKAQRYADFTLLSIPYPVLGSGATNTKLPEAAAFLS

SEQ ID NO: 9036 - protein, 154 aa, Homo Sapiens
MALLILLLVPLLLPDSGSEAYSGCEFFKEYKDRDYMAEGLIFNWKQDYVDAPLSIPDFLTHSLNIDWSQYQCWDLVQQTQNYLKLLLSLVNSDDDSGLLVHCISGWDRTPLFISLLRLSLWADGLIHTSLKPTEILYLTVAYDWFLFGHMLVDR

SEQ ID NO: 9037 - protein, 60 aa, Homo Sapiens
MDAQATTIFSQGVQMMPGQMWRTSRRRTVLFEVVTRIFLIRSEAMTSSCFDTCQSNTSVT

SEQ ID NO: 9038 - protein, 36 aa, Homo Sapiens
MSHCAWPETELELDVGEPVKEPLADLTRKGLRVPYR

SEQ ID NO: 9039 - protein, 24 aa, Homo Sapiens
MATRGFSCLLLVISEIDLSVKRWV

SEQ ID NO: 9040 - protein, 725 aa, Homo Sapiens
MGAASVRAGARLVEVALCSFTVTCLEVMRRFLLLYATQQGQAKAIAEEICEQAVVHGFSADLHCISESDKYDLKTETAPLVVVVSTTGTGDPPDTARKFVKEIQNQTLPVDFFAHLRYGLLGLGDSEYTYFCNGGKIIDKRLQELGARHFYDTGHADDCVGLELVVEPWIAGLWPALRKHFRSSRGQEEISGALPVASPASSRTDLVKSELLHIESQVELLRFDDSGRKDSEVLKQNAVNSNQSNVVIEDFESSLTRSVPPLSQASLNIPGLPPEYLQVHLQESLGQEESQVSVTSADPVFQVPISKAVQLTTNDAIKTTLLVELDISNTDFSYQPGDAFSVICPNSDSEVQSLLQRLQLEDKREHCVLLKIKADTKKKGATLPQHIPAGCSLQFIFTWCLEIRAIPKKAFLRALVDYTSDSAEKRRLQELCSKQGAADYSRFVRDACACLLDLLLAFPSCQPPLSLLLEHLPKLQPRPYSCASSSLFHPGKLHFVFNIVEFLSTATTEVLRKGVCTGWLALLVASVLQPNIHASHEDSGKALAPKISISPRTTNSFHLPDDPSIPIIMVGPGTGIAPFIGFLQHREKLQEQHPDGNFGAMWLFFGCRHKDRDYLFRKELRHFLKHGILTHLKVSFSRDAPVGEEEAPAKYVQDNIQLHGQQVARILLQENGHIYVCGDAKNMAKDVHDALVQIISKEVGVEKLEAMKTLATLKEEKRYLQDIWS

SEQ ID NO: 9041 - protein, 41 aa, Homo Sapiens
MRRFLLLYATQQGQAKAIAEEICEQAVVHGFSADLHCISES

SEQ ID NO: 9042 - protein, 46 aa, Homo Sapiens
MRRFLLLYATQQGQAKAIAEEICEQAVVHGFSADLHCISESDKCEK

SEQ ID NO: 9043 - protein, 58 aa, Homo Sapiens
MRRFLLLYATQQGQAKAIAEEICEQAVVHGFSADLHCISESDKVSVIQNTPTFAMGGR

SEQ ID NO: 9044 - protein, 58 aa, Homo Sapiens; identical to SEQ ID NO: 9043

SEQ ID NO: 9045 - protein, 92 aa, Homo Sapiens
MRRFLLLYATQQGQAKAIAEEICEQAVVHGFSADLHCISESDKYDLKTETAPLVVVVSTTGTGDPPDTARKFVKEIQNQTLPVDFFAHLRSR

SEQ ID NO: 9046 - protein, 112 aa, Homo Sapiens
MRRFLLLYATQQGQAKAIAEEICEQAVVHGFSADLHCISESDKYDLKTETAPLVVVVSTTGTGDPPDTARKFVKEIQNQTLPVDFFAHLRYGLLGLGDSEYTYFCNGGKIID

SEQ ID NO: 9047 - protein, 156 aa, Homo Sapiens
MRRFLLLYATQQGQAKAIAEEICEQAVVHGFSADLHCISESDKYDLKTETAPLVVVVSTTGTGDPPDTARKFVKEIQNQTLPVDFFAHLRYGLLGLGDSEYTYFCNGGKIIDKRLQELGARHFYDTGHADDCVGLELVVEPWIAGLWPALRKHFRS

SEQ ID NO: 9048 - protein, 698 aa, Homo Sapiens
MRRFLLLYATQQGQAKAIAEEICEQAVVHGFSADLHCISESDKYDLKTETAPLVVVVSTTGTGDPPDTARKFVKEIQNQTLPVDFFAHLRYGLLGLGDSEYTYFCNGGKIIDKRLQELGARHFYDTGHADDCVGLELVVEPWIAGLWPALRKHFRSSRGQEEISGALPVASPASSRTDLVKSELLHIESQVELLRFDDSGRKDSEVLKQNAVNSNQSNVVIEDFESSLTRSVPPLSQASLNIPGLPPEYLQVHLQESLGQEESQVSVTSADPVFQVPISKAVQLTTNDAIKTTLLVELDISNTDFSYQPGDAFSVICPNSDSEVQSLLQRLQLEDKREHCVLLKIKADTKKKGATLPQHIPAGCSLQFIFTWCLEIRAIPKKAFLRALVDYTSDSAEKRRLQELCSKQGAADYSRFVRDACACLLDLLLAFPSCQPPLSLLLEHLPKLQPRPYSCASSSLFHPGKLHFVFNIVEFLSTATTEVLRKGVCTGWLALLVASVLQPNIHASHEDSGKALAPKISISPRTTNSFHLPDDPSIPIIMVGPGTGIAPFIGFLQHREKLQEQHPDGNFGAMWLFFGCRHKDRDYLFRKELRHFLKHGILTHLKVSFSRDAPVGEEEAPAKYVQDNIQLHGQQVARILLQENGHIYVCGDAKNMAKDVHDALVQIISKEVGVEKLEAMKTLATLKEEKRYLQDIWS

SEQ ID NO: 9049 - protein, 372 aa, Homo Sapiens
  misc_feature (1)..(1): Xaa can be any naturally occurring amino acid
XFTVTCLEVMRRFLLLYATQQGQAKAIAEEICEQAVVHGFSADLHCISESDKYDLKTETAPLVVVVSTTGTGDPPDTARKFVKEIQNQTLPVDFFAHLRYGLLGLGDSEYTYFCNGGKIIDKRLQELGARHFYDTGHADDCVGLELVVEPWIAGLWPALRKHFRSSRGQEEISGALPVASPASSRTDLVKSELLHIESQVELLRFDDSGRKDSEVLKQNAVNSNQSNVVIEDFESSLTRSVPPLSQASLNIPGLPPEYLQVHLQESLGQEESQVSVTSADPVFQVPISKAVQLTTNDAIKTTLLVELDISNTDFSYQPGDAFSVICPNSDSEVQSLLQRLQLEDKREHCVLLKIKADTKKKGIFASPCGLYQ

SEQ ID NO: 9050 - protein, 160 aa, Homo Sapiens
  misc_feature (1)..(1): Xaa can be any naturally occurring amino acid
XVRAGARLVEVALCRFVPGWRGVGLGDSEYTYFCNGGKIIDKRLQELGARHFYDTGHADDCVGLELVVEPWIAGLWPALRKHFRSSRGQEEISGALPVASPASSRTDLVKSELLHIESQVELLRFDDSGRKDSEVLKQNAVNSNQSNVVIEDFESSLTRS

SEQ ID NO: 9051 - protein, 81 aa, Homo Sapiens
  misc_feature (1)..(1): Xaa can be any naturally occurring amino acid
XVRAGARLVEVALCSFTVTCLEVMRRFLLLYATQQGQAKAIAEEICEQAVVHGFSADLHCISESDKVSVIQNTPTFAMGGR

SEQ ID NO: 9052 - protein, 115 aa, Homo Sapiens
  misc_feature (1)..(1): Xaa can be any naturally occurring amino acid
XVRAGARLVEVALCSFTVTCLEVMRRFLLLYATQQGQAKAIAEEICEQAVVHGFSADLHCISESDKYDLKTETAPLVVVVSTTGTGDPPDTARKFVKEIQNQTLPVDFFAHLRSR

SEQ ID NO: 9053 - protein, 178 aa, Homo Sapiens
MARAPLRPENTIVRGSANQCQDTYRAEELTGHTTGLSLNNDRLYKLTYSTEVLLDRGKGKLQDSVGYRISSNVDVALLWRNPDGDDDQLIQITMKDVNVENVNQQRGEKSIFKGKSPSKIMGKENLEALQRPTLLHLIHGKVKEFYSYQNEAVAIENIKRGLASLFQTQLSSGTTNEV

SEQ ID NO: 9054 - protein, 55 aa, Homo Sapiens
MARAPLRPENTIVRGSANQCQDTYRAEELTGRPSIITRIHKTEEGDRRDGQSDMK

SEQ ID NO: 9055 - protein, 42 aa, Homo Sapiens
MARAPLRPENTIVRGSANQCQDTYRAEELTGSEEGHSLTGCH

SEQ ID NO: 9056 - protein, 56 aa, Homo Sapiens
MEERGGVYAGRGLELVFWEWEVVTVMSVFSRSRIKCVPADVYSFIYSCEYWMKELR

SEQ ID NO: 9057 - protein, 921 aa, Homo Sapiens
MEERGGVYAGRGLELVFWEWEVVTVMSVFSRSRIKCVPADVYSFIYSCHTTGLSLNNDRLYKLTYSTEVLLDRGKGKLQDSVGYRISSNVDVALLWRNPDGDDDQLIQITMKDVNVENVNQQRGEKSIFKGKSPSKIMGKENLEALQRPTLLHLIHGKVKEFYSYQNEAVAIENIKRGLASLFQTQLSSGTTNEVDISGNCKVTYQAHQDKVIKIKALDSCKIARSGFTTPNQVLGVSSKATSVTTYKIEDSFVIAVLAEETHNFGLNFLQTIKGKIVSKQKLELKTTEAGPRLMSGKQAAAIIKAVDSKYTAIPIVGQVFQSHCKGCPSLSELWRSTRKYLQPDNLSKAEAVRNFLAFIQHLRTAKKEEILQILKMENKEVLPQLVDAVTSAQTSDSLEAILDFLDFKSDSSIILQERFLYACGFASHPNEELLRALISKFKGSIGSSDIRETVMIITGTLVRKLCQNEGCKLKAVVEAKKLILGGLEKAEKKEDTRMYLLALKNALLPEGIPSLLKYAEAGEGPISHLATTALQRYDLPFITDEVKKTLNRIYHQNRKVHEKTVRTAAAAIILNNNPSYMDVKNILLSIGELPQEMNKYMLAIVQDILRFEMPASKIVRRVLKEMVAHNYDRFSRSGSSSAYTGYIERSPRSASTYSLDILYSGSGILRRSNLNIFQYIGKAGLHGSQVVIEAQGLEALIAATPDEGEENLDSYAGMSAILFDVQLRPVTFFNGYSDLMSKMLSASGDPISVVKGLILLIDHSQELQLQSGLKANIEVQGGLAIDISGAMEFSLWYRESKTRVKNRVTVVITTDITVDSSFVKAGLETSTETEAGLEFISTVQFSQYPFLVCMQMDKDEAPFRQFEKKYERLSTGRGYVSQKRKESVLAGCEFPLHQENSEMCKVVFAPQPDSTSSGWF

SEQ ID NO: 9058 - protein, 50 aa, Homo Sapiens
MEERGGVYAGRGLELVFWEWEVVTVMSVFSRSRIKCVPADVYSFIYSCPV

SEQ ID NO: 9059 - protein, 72 aa, Homo Sapiens
MEERGGVYAGRGLELVFWEWEVVTVMSVFSRSRIKCVPADVYSFIYSCRPSIITRIHKTEEGDRRDGQSDMK

SEQ ID NO: 9060 - protein, 59 aa, Homo Sapiens
MEERGGVYAGRGLELVFWEWEVVTVMSVFSRSRIKCVPADVYSFIYSCSEEGHSLTGCH

SEQ ID NO: 9061 - protein, 894 aa, Homo Sapiens
MILLAVLFLCFISSYSASVKGHTTGLSLNNDRLYKLTYSTEVLLDRGKGKLQDSVGYRISSNVDVALLWRNPDGDDDQLIQITMKDVNVENVNQQRGEKSIFKGKSPSKIMGKENLEALQRPTLLHLIHGKVKEFYSYQNEAVAIENIKRGLASLFQTQLSSGTTNEVDISGNCKVTYQAHQDKVIKIKALDSCKIARSGFTTPNQVLGVSSKATSVTTYKIEDSFVIAVLAEETHNFGLNFLQTIKGKIVSKQKLELKTTEAGPRLMSGKQAAAIIKAVDSKYTAIPIVGQVFQSHCKGCPSLSELWRSTRKYLQPDNLSKAEAVRNFLAFIQHLRTAKKEEILQILKMENKEVLPQLVDAVTSAQTSDSLEAILDFLDFKSDSSIILQERFLYACGFASHPNEELLRALISKFKGSIGSSDIRETVMIITGTLVRKLCQNEGCKLKAVVEAKKLILGGLEKAEKKEDTRMYLLALKNALLPEGIPSLLKYAEAGEGPISHLATTALQRYDLPFITDEVKKTLNRIYHQNRKVHEKTVRTAAAAIILNNNPSYMDVKNILLSIGELPQEMNKYMLAIVQDILRFEMPASKIVRRVLKEMVAHNYDRFSRSGSSSAYTGYIERSPRSASTYSLDILYSGSGILRRSNLNIFQYIGKAGLHGSQVVIEAQGLEALIAATPDEGEENLDSYAGMSAILFDVQLRPVTFFNGYSDLMSKMLSASGDPISVVKGLILLIDHSQELQLQSGLKANIEVQGGLAIDISGAMEFSLWYRESKTRVKNRVTVVITTDITVDSSFVKAGLETSTETEAGLEFISTVQFSQYPFLVCMQMDKDEAPFRQFEKKYERLSTGRGYVSQKRKESVLAGCEFPLHQENSEMCKVVFAPQPDSTSSGWF

SEQ ID NO: 9062 - protein, 894 aa, Homo Sapiens; identical to SEQ ID NO: 9061

SEQ ID NO: 9063 - protein, 151 aa, Homo Sapiens
MILLAVLFLCFISSYSASVKGHTTGLSLNNDRLYKLTYSTEVLLDRGKGKLQDSVGYRISSNVDVALLWRNPDGDDDQLIQITMKDVNVENVNQQRGEKSIFKGKSPSKIMGKENLEALQRPTLLHLIHGKVKGRLDSTTFSPTSYFSSLQ

SEQ ID NO: 9064 - protein, 45 aa, Homo Sapiens
MSLVAEAFVSQIAAAEPWPENATLYQQLKGEQILLSDNAASLAVQ

SEQ ID NO: 9065 - protein, 263 aa, Homo Sapiens
MSLVAEAFVSQIAAAEPWPENATLYQQLKGEQILLSDNAASLAVQAFLQMCNLPIKVVCRANAEYMSPSGKVPFIHVGNQVVSELGPIVQFVKAKGHSLSDGLEEVQKAEMKAYMELVNNMLLTAELYLQWCDEATVGEITHARYGSPYPWPLNHILAYQKQWEVKRKMKAIGWGKKTLDQVLEDVDQCCQALSQRLGTQPYFFNKQPTELDALVFGHLYTILTTQLTNDELSEKVKNYSNLLAFCRRIEQHYFEDRGKGRLS

SEQ ID NO: 9066 - protein, 229 aa, Homo Sapiens
MSLVAEAFVSQIAAAEPWPENATLYQQLKGEQILLSDNAASLAVQAFLQMCNLPIKVVCRANAEYMSPSGKVPFIHVGNQVVSELGPIVQFVKAKGHSLSDGLEEVQKAEMKAYMELVNNMLLTAELYLQWCDEATVGEWEVKRKMKAIGWGKKTLDQVLEDVDQCCQALSQRLGTQPYFFNKQPTELDALVFGHLYTILTTQLTNDELSEKVKNYSNLLAFCRRIEQH

SEQ ID NO: 9067 - protein, 207 aa, Homo Sapiens
MSLVAEAFVSQIAGKVPFIHVGNQVVSELGPIVQFVKAKGHSLSDGLEEVQKAEMKAYMELVNNMLLTAELYLQWCDEATVGEITHARYGSPYPWPLNHILAYQKQWEVKRKMKAIGWGKKTLDQVLEDVDQCCQALSQRLGTQPYFFNKQPTELDALVFGHLYTILTTQLTNDELSEKVKNYSNLLAFCRRIEQHYFEDRGKGRLS

SEQ ID NO: 9068 - protein, 37 aa, Homo Sapiens
MSLVAEAFVSQIAGWSAVAQPGLTATSASRVQAILLP

SEQ ID NO: 9069 - protein, 228 aa, Homo Sapiens
ASSTHHSTVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKEWRVDRERLA

SEQ ID NO: 9070 - protein, 135 aa, Homo Sapiens
MTPGTQSPFFLLLLLTVLTATTAPKPATVVTGSGHASSTPGGEKETSATQRSSVPSSTEKNAALHQAQLLLWCTTAPLPGLPQPQPARALHSQFPATTLILLPPLPAIAPRLMPVALTIARSQHRLLPRAAERHF

SEQ ID NO: 9071 - protein, 241 aa, Homo Sapiens
MTPGTQSPFFLLLLLTVLTATTAPKPATVVTGSGHASSTPGGEKETSATQRSSVPSSTEKNAFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 9072 - protein, 159 aa, Homo Sapiens
MTPGTQSPFFLLLLLTVLTATTAPKPATVVTGSGHASSTPGGEKETSATQRSSVPSSTEKNAFNSSLEDPSTDYYQELQRDISEMAVCQCRRKNYGQLDIFPARDTYHPMSEYPTYHTHGRYVPPSSTDRSPYEKVSAGNGGSSLSYTNPAVAATSANL

SEQ ID NO: 9073 - protein, 264 aa, Homo Sapiens
MTPGTQSPFFLLLLLTVLTATTAPKPATVVTGSGHASSTPGGEKETSATQRSSVPSSTEKNAFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 9074 - protein, 189 aa, Homo Sapiens
MTPGTQSPFFLLLLLTVLTATTAPKPATVVTGSGHASSTPGGEKETSATQRSSVPSSTEKNAFNSSLEDPSTDYYQELQRDISEMSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 9075 - protein, 80 aa, Homo Sapiens
MTPGTQSPFFLLLLLTVLTATTAPKPATVVTGSGHASSTPGGEKETSATQRSSVPSSTEKNAIPAPTTTKSCRETFLKCE

SEQ ID NO: 9076 - protein, 239 aa, Homo Sapiens
MTPGTQSPFFLLLLLTVLTATTAPKPATVVTGSGHASSTPGGEKETSATQRSSVPSSTEKNAIPAPTTTKSCRETFLKWPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 9077 - protein, 268 aa, Homo Sapiens
MTPGTQSPFFLLLLLTVLTATTAPKPATVVTGSGHASSTPGGEKETSATQRSSVPSSTEKNALSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKEWRVDRERLA

SEQ ID NO: 9078 - protein, 123 aa, Homo Sapiens
MTPGTQSPFFLLLLLTVLTATTAPKPATVVTGSGHASSTPGGEKETSATQRSSVPSSTEKNALSTGVSFFFLSFHISNLQFNSSLEDPSTDYYQELQRDISEMFLQIYKQGGFLGLSNIKFSE

SEQ ID NO: 9079 - protein, 166 aa, Homo Sapiens
MTPGTQSPFFLLLLLTVLTATTAPKPATVVTGSGHASSTPGGEKETSATQRSSVPSSTEKNASGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 9080 - protein, 484 aa, Homo Sapiens
MTPGTQSPFFLLLLLTVLTATTAPKPATVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTSAPDNRPALGSTAPPVHNVTSASGSASGSASTLVHNGTSARATTTPASKSTPFSIPSHHSDTPTTLASHSTKTDASSTHHSTVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 9081 - protein, 213 aa, Homo Sapiens
MTPGTQSPFFLLLLLTVLTGSGHASSTPGGEKETSATQRSSVPSSTEKNAVSMTSSVLSSHSPGSGSSTTQGQDVTLAPATEPASGSAATWGQDVTSVPVTRPALGSTTPPAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 9082 - protein, 126 aa, Homo Sapiens
MTPGTQSPFFLLLLLTVLTVVTGSGHASSTPGGEKETSATQRSSVPSSTEKNAALHQAQLLLWCTTAPLPGLPQPQPARALHSQFPATTLILLPPLPAIAPRLMPVALTIARSQHRLLPRAAERHF

SEQ ID NO: 9083 - protein, 255 aa, Homo Sapiens
MTPGTQSPFFLLLLLTVLTVVTGSGHASSTPGGEKETSATQRSSVPSSTEKNAFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 9084 - protein, 96 aa, Homo Sapiens
MTPGTQSPFFLLLLLTVLTVVTGSGHASSTPGGEKETSATQRSSVPSSTEKNAFNSSLEDPSTDYYQELQRDISEMFLQIYKQGGFLGLSNIKFSE

SEQ ID NO: 9085 - protein, 149 aa, Homo Sapiens
MTPGTQSPFFLLLLLTVLTVVTGSGHASSTPGGEKETSATQRSSVPSSTEKNAFNSSLEDPSTDYYQELQRDISEMFLQIYKQGGFLGLSNIKFSLGLGCQAGASRCWCWSVFWLRWPLSISLPWLSVSAAERTTGSWTSFQPGIPTIL

SEQ ID NO: 9086 - protein, 203 aa, Homo Sapiens
MTPGTQSPFFLLLLLTVLTVVTGSGHASSTPGGEKETSATQRSSVPSSTEKNAIPAPTTTKSCRETFLKCFCRFINKGVFWASPILSSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 9087 - protein, 230 aa, Homo Sapiens
MTPGTQSPFFLLLLLTVLTVVTGSGHASSTPGGEKETSATQRSSVPSSTEKNAIPAPTTTKSCRETFLKWPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 9088 - protein, 229 aa, Homo Sapiens
MTPGTQSPFFLLLLLTVLTVVTGSGHASSTPGGEKETSATQRSSVPSSTEKNAIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 9089 - protein, 168 aa, Homo Sapiens
MTPGTQSPFFLLLLLTVLTVVTGSGHASSTPGGEKETSATQRSSVPSSTEKNALSTGVSFFFLSFHISNLQFNSSLEDPSTDYYQELQRDISEMAVCQCRRKNYGQLDIFPARDTYHPMSEYPTYHTHGRYVPPSSTDRSPYEKVSAGNGGSSLSYTNPAVAATSANL

SEQ ID NO: 9090 - protein, 198 aa, Homo Sapiens
MTPGTQSPFFLLLLLTVLTVVTGSGHASSTPGGEKETSATQRSSVPSSTEKNALSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSGCLSVPPKELRAAGHLSSPGYLPSYERVPHLPHPWALCAP

SEQ ID NO: 9091 - protein, 273 aa, Homo Sapiens
MTPGTQSPFFLLLLLTVLTVVTGSGHASSTPGGEKETSATQRSSVPSSTEKNALSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 9092 - protein, 475 aa, Homo Sapiens
MTPGTQSPFFLLLLLTVLTVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTSAPDNRPALGSTAPPVHNVTSASGSASGSASTLVHNGTSARATTTPASKSTPFSIPSHHSDTPTTLASHSTKTDASSTHHSTVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 9093 - protein, 1262 aa, Homo Sapiens
MTPGTQSPFFLLLLLTVLTVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPQAHGVTSAPDTRPAPGSTAPPAHGVTSAPDTRPAPGSTAPPAHGVTSAPDTRSAPGSTAPAAHGVTSAPDTRSVPGSTAPQAHGVTSAPDTRPAPGSTAPPAHGVTSAPDTRPVPGSTAPPAHGVTSAPDTRPAPGSTAPPAHGVTSAPDTRPAPGSTAPQAHGVTSAPDTRPAPGSTAPPAHGVTSAPDTRPAPGSTAPPAHGVTSAPDTRPAPGSTAPAAHGVTSAPDTRPAPGSTAPQAHGVTSAPDTRPAPGSTAPPAHGVTSAPDTRPAPGSTAPPAHGVTSAPDTRPAPGSTAPPAHGVTSAPDTRPAPGSTAPAAHGVTSAPDTRPAPGSTAPQAHGVTSAPDTRPAPGSTAPPAHGVTSAPDTRPAPGSTAPPAHGVTSAPDTRPAPGSTAPPTHGVTSAPDTSPAPGSTAPPAHGVTSAPDTRPAPGYTAPAAHGVTSAPDTRPAPGSTAPQAHGVTSAPDTRPAPGSTAPPAHGVTSAPDTRPAPGSTAPPAHGVTSAPDTRPAPGSTAPPAHGVTSAPESRPAPGSTARAAHGVTSAPESRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPSPPGSTAPPAHGVTSAPDTRPAPGSTAPPVHGVTSAPDTRPAPGSTAPPAHGVTSAPDTRPAPGSTAPPAHGVTSAPDTRPAPGSTAPPAHGVTSAPDTRRAPGSTPAPGSTAPPAHGVTSAPDTRPAPGSTAPPAHGVTSAPDNRPALGSTAPPVHNVTSASGSASGSASTLVHNGTSARATTTPASKSTPFSIPSHHSDTPTTLASHSTKTDASSTHHSTVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 9094 - protein, 85 aa, Homo Sapiens
TEAASRYNLTISDVSVWGWGARLGHRAAGAGLCSGCAGHCLSHCLGCLSVPPKELRAAGHLSSPGYLPSYERVPHLPHPWALCAP

SEQ ID NO: 9095 - protein, 512 aa, Homo Sapiens
MKAIIHLTLLALLSVNTATNQGNSADAVTTTETATSGPTVAAADTTETNFPETASTTANTPSFPTATSPAPPIISTHSSSTIPTPAPPIISTHSSSTIPIPTAADSESTTNVNSLATSDIITASSPNDGLITMVPSETQSNNEMSPTTEDNQSSGPPTGTALLETSTLNSTGPSNPCQDDPCADNSLCVKLHNTSFCLCLEGYYYNSSTCKKGKVFPGKISVTVSETFDPEEKHSMAYQDLHSEITSLFKDVFGTSVYGQTVILTVSTSLSPRSEMRADDKFVNVTIVTILAETTSDNEKTVTEKINKAIRSSSSNFLNYDLTLRCDYYGCNQTADDCLNGLACDCKSDLQRPNPQSPFCVASSLKCPDACNAQHKQCLIKKSGGAPECACVPGYQEDANGNCQKCAFGYSGLDCKDKFQLILTIVGTIAGIVILSMIIALIVTARSNNKTKHIEEENLIDEDFQNLKLRSTGFTNLGAEGSVFPKVRITASRDSQMQNPYSRHSSMPRPDY

SEQ ID NO: 9096 - protein, 184 aa, Homo Sapiens
MKAIIHLTLLALLSVNTEDNQSSGPPTGTALLETSTLNSTGPSNPCQDDPCADNSLCVKLHNTSFCLCLEGYYYNSSTCKKGKVFPGKISVTVSETFDPEEKHSMAYQDLHSEITSLFKDVFGTSVYGQTVILTVSTSLSPRSEMRADDKFVNVTIVTILAETTSDNEKTVTEKINKAIRSSSS

SEQ ID NO: 9097 - protein, 709 aa, Homo Sapiens
MGCLWGLALPLFFFCWEVGVSGSSAGPSTRRADTAMTTDDTEVPAMTLAPGHAALETQTLSAETSSRASTPAGPIPEAETRGAKRISPARETRSFTKTSPNFMVLIATSVETSAASGSPEGAGMTTVQTITGSDPREAIFDTLCTDDSSEEAKTLTMDILTLAHTSTEAKGLSSESSASSDSPHPVITPSRASESSASSDGPHPVITPSRASESSASSDGPHPVITPSRASESSASSDGPHPVITPSRASESSASSDGPHPVITPSRASESSASSDGPHPVITPSRASESSASSDGPHPVITPSRASESSASSDGPHPVITPSRASESSASSDGPHPVITPSRASESSASSDGLHPVITPSRASESSASSDGPHPVITPSRASESSASSDGPHPVITPSWSPGSDVTLLAEALVTVTNIEVINCSITEIETTTSSIPGASDTDLIPTEGVKASSTSDPPALPDSTEAKPHITEVTASAETLSTAGTTESAAPDATVGTPLPTNSATEREVTAPGATTLSGALVTVSRNPLEETSALSVETPSYVKVSGAAPVSIEAGSAVGKTTSFAGSSASSYSPSEAALKNFTPSETPTMDIATKGPFPTSRDPLPSVPPTTTNSSRGTNSTLAKITTSAKTTMKPPTATPTTARTRPTTDVSAGENGGFLLLRLSVASPEDLTDPRVAERLMQQLHRELHAHAPHFQVSLLRVRRG

SEQ ID NO: 9098 - protein, 723 aa, Homo Sapiens
MGCLWGLALPLFFFCWEVGVSGSSAGPSTRRADTAMTTDDTEVPAMTLAPGHAALETQTLSAETSSRASTPAGPIPEAETRGAKRISPARETRSFTKTSPNFMVLIATSVETSAASGSPEGAGMTTVQTITGSDPREAIFDTLCTDDSSEEAKTLTMDILTLAHTSTEAKGLSSESSASSDSPHPVITPSRASESSASSDGPHPVITPSRASESSASSDGPHPVITPSRASESSASSDGPHPVITPSRASESSASSDGPHPVITPSRASESSASSDGPHPVITPSRASESSASSDGPHPVITPSRASESSASSDGPHPVITPSRASESSASSDGPHPVITPSRASESSASSDGLHPVITPSRASESSASSDGPHPVITPSRASESSASSDGPHPVITPSWSPGSDVTLLAEALVTVTNIEVINCSITEIETTTSSIPGASDTDLIPTEGVKASSTSDPPALPDSTEAKPHITEVTASAETLSTAGTTESAAPDATVGTPLPTNSATEREVTAPGATTLSGALVTVSRNPLEETSALSVETPSYVKVSGAAPVSIEAGSAVGKTTSFAGSSASSYSPSEAALKNFTPSETPTMDIATKGPFPTSRDPLPSVPPTTTNSSRGTNSTLAKITTSAKTTMKPPTATPTTARTRPTTDVSAGENGGFLLLRLSVASPEDLTDPRVAERLMQQMERSLALSPRLECSGVISAHCKLHLLGSRDSPASAS

SEQ ID NO: 9099 - protein, 538 aa, Homo Sapiens
MGCLWGLALPLFFFCWEVGVSGSSAGPSTRRADTAMTTDDTEVPAMTLAPGHAALETQTLSAETSSRASTPAGPIPEAETRGAKRISPARETRSFTKTSPNFMVLIATSVETSAASGSPEGAGMTTVQTITGSDPREAIFDTLCTDDSSEEAKTLTMDILTLAHTSTEAKGLSSESSASSDSPHPVITPSRASESSASSDGPHPVITPSRASESSASSDGPHPVITPSWSPGSDVTLLAEALVTVTNIEVINCSITEIETTTSSIPGASDTDLIPTEGVKASSTSDPPALPDSTEAKPHITEVTASAETLSTAGTTESAAPDATVGTPLPTNSATEREVTAPGATTLSGALVTVSRNPLEETSALSVETPSYVKVSGAAPVSIEAGSAVGKTTSFAGSSASSYSPSEAALKNFTPSETPTMDIATKGPFPTSRDPLPSVPPTTTNSSRGTNSTLAKITTSAKTTMKPPTATPTTARTRPTTDVSAGENGGFLLLRLSVASPEDLTDPRVAERLMQQLHRELHAHAPHFQVSLLRVRRG

SEQ ID NO: 9100 - protein, 674 aa, Homo Sapiens
MTTDDTEVPAMTLAPGHAALETQTLSAETSSRASTPAGPIPEAETRGAKRISPARETRSFTKTSPNFMVLIATSVETSAASGSPEGAGMTTVQTITGSDPREAIFDTLCTDDSSEEAKTLTMDILTLAHTSTEAKGLSSESSASSDSPHPVITPSRASESSASSDGPHPVITPSRASESSASSDGPHPVITPSRASESSASSDGPHPVITPSRASESSASSDGPHPVITPSRASESSASSDGPHPVITPSRASESSASSDGPHPVITPSRASESSASSDGPHPVITPSRASESSASSDGPHPVITPSRASESSASSDGLHPVITPSRASESSASSDGPHPVITPSRASESSASSDGPHPVITPSWSPGSDVTLLAEALVTVTNIEVINCSITEIETTTSSIPGASDTDLIPTEGVKASSTSDPPALPDSTEAKPHITEVTASAETLSTAGTTESAAPDATVGTPLPTNSATEREVTAPGATTLSGALVTVSRNPLEETSALSVETPSYVKVSGAAPVSIEAGSAVGKTTSFAGSSASSYSPSEAALKNFTPSETPTMDIATKGPFPTSRDPLPSVPPTTTNSSRGTNSTLAKITTSAKTTMKPPTATPTTARTRPTTDVSAGENGGFLLLRLSVASPEDLTDPRVAERLMQQLHRELHAHAPHFQVSLLRVRRG

SEQ ID NO: 9101 - protein, 128 aa, Homo Sapiens
  misc_feature (1)..(1): Xaa can be any naturally occurring amino acid
XPTMDIATKGPFPTSRDPLPSVPPTTTNSSRGTNSTLAKITTSAKTTMKPPTATPTTARTRPTTDVSAGENGGFLLLRLSVASPEDLTDPRVAERLMQQLMTQGTHSAHVPSMVGVNPLPIVPGGFQH

SEQ ID NO: 9102 - protein, 3323 aa, Homo Sapiens
MQLLGLLGLLWMLKASPWATGTLSTATSISQVPFPRAEAASAVLSNSPHSRDLAGWPLGVPQLASPAPGHRENAPMTLTTSPHDTLISETLLNSPVSSNTSTTPTSKFAFKVETTPPTVLVYSATTECVYPTSFIITISHPTSICVTTTQVAFTSSYTSTPVTQKPVTTVTSTYSMTTTEKGTSAMTSSPSTTTARETPIVTVTPSSVSATDTTFHTTISSTTRTTERTPLPTGSIHTTTSPTPVFTTLKTAVTSTSPITSSITSTNTVTSMTTTASQPTATNTLSSPTRTILSSTPVLSTETITSGITNTTPLSTLVTTLPTTISRSTPTSETTYTTSPTSTVTDSTTKIAYSTSMTGTLSTETSLPPTSSSLPTTETATTPMTNLVTTTTEISSHSTPSFSSSTIYSTVSTSTTAISSLPPTSGTMVTSTTMTPSSLSTDIPFTTPTTITHHSVGSTGFLTTATDLTSTFTVSSSSAMSTSVIPSSPSIQNTETSSLVSMTSATTPNVRPTFVSTLSTPTSSLLTTFPATYSFSSSMSASSAGTTHTESISSPPASTSTLHTTAESTLAPTTTTSFTTSTTMEPPSTTAATTGTGQTTFTSSTATFPETTTPTPTTDMSTESLTTAMTSPPITSSVTSTNTVTSMTTTTSPPTTTNSFTSLTSMPLSSTPVPSTEVVTSGTINTIPPSILVTTLPTPNASSMTTSETTYPNSPTGPGTNSTTEITYPTTMTETSSTATSLPPTSPLVSTAKTAKTPTTNLVTTTTKTTSHSTTSFTSSTVYSTASTYTTAITSVPTTLGTMVTSTSMISSTVSTGIPTSQPTTITPSSVGISGSLPMMTDLTSVYTVSNMSARPTTVIPSSPTVQNTEISISVSMTSATTPSGGPTFTSTENTPTRSLLTSFPMTHSFSSSMSESSAGTTHTESISSPRGTTSTLHTTVESTPSPTTTTSFTTSTMMEPPSSTVSTTGRGQTTFPSSTATFPETTTLTPTTDISTVSLTTAMTSPPPVSSSITPTNTMTSMRTTTYWPTATNTLSPLTSSILSSTPVPSTEMITSHTTNTTPLSTLVTTLLTTITRSTPTSETTYPTSPTSIVSDSTTEITYSTSITGTLSTATTLPPTSSSLPTTETATMTPTTTLITTTPNTTSLSTPSFTSSTIYSTVSTSTTAISSASPTSGTMVTSTTMTPSSLSTDTPSTTPTTITYPSVGSTGFLTTATDLTSTFTVSSSSAMSTSVIPSSPSIQNTETSSLVSMTSATTPSLRPTITSTDSTLTSSLLTTFPSTYSFSSSMSASSAGTTHTETISSLPASTNTIHTTAESALAPTTTTSFTTSPTMEPPSTTVATTGTGQTTFPSSTATFLETTTLTPTTDFSTESLTTAMTSTPPITSSITPTDTMTSMRTTTSWPTATNTLSPLTSSILSSTPVPSTEVTTSHTTNTNPVSTLVTTLPITITRSTLTSETAYPSSPTSTVTESTTEITYPTTMTETSSTATSLPPTSSLVSTAETAKTPTTNLVTTTTKTTSHSTTSFTSSTIYSTASTPTTAITSVPTTLGTMVTSTSMIPSTVSTGIPTSQPTTITPSSVGISGSLPMMTDLTSVYTVSSMSARPTSVIPSSPTVQNTETSIFVSMMSATTPSGGPTFTSTENTPTRSLLTSFPVTHSFSSSMSASSVGTTHTQSISSPPAITSTLHTTAESTPSPTTTMSFTTFTKMETPSSTVATTGTGQTTFTSSTATSPKTTTLTPTSDISTGSFKTAVSSTPPITSSITSTYTVTSMTTTTPLGPTATNTLPSFTSSVSSSTPVPSTEAITSGTTNTTPLSTLVTTFSNSDTSSTPTSETTYPTSLTSALTDSTTRTTYSTNMTGTLSTVTSLRPTSSSLLTTVTATVPTTNLVTTTTKITSHSTPSFTSSIATTETPSHSTPRFTSSITTTETPSHSTPRFTSSITNTKTTSHSSPSFTSSITTTETTSHNTPSLTSSITTTKTTSHSTPSYTSLITTTTTTSHSTPSFTSSITTTETTSHNTPSLTSSITTTETTSHSTPSFTSSITTETTSHSTPSFTSLITITEITSHSTLSYTTSITTTETPSHSTLSFTSSITTTETTSHSTPSFTSSITTSEMPSHSTPSFTSSITTTENATHSTPNFTSSITTTETTSHSTPSFTSLITTTETTSHRWGTTETTSYSTPSFTSSNTITETTSHSTPSYITSITTTETPSSSTPSFSSSITTTETTSHSTPGFTSSITTTETTSHSTPSFTSSITTTETTSHDTPSFTSSITTSETPSHSTPSSTSLITTTKTTSHSTPSFTSSITTTETTSHSAHSFTSSITTTETTSHNTRSFTSSITTTETNSHSTTSFTSSITTTETTSHSTPSFSSSITTTETPLHSTPGLTSWVTTTKTTSHITPGLTSSITTTETTSHSTPGFTSSITTTETTSESTPSLSSSTIYSTVSTSTTAITSHFTTSETAVTPTPVTPSSLSTDIPTTSLRTLTPSSVGTSTSLTTTTDFPSIPTDISTLPTRTHIISSSPSIQSTETSSLVGTTSPTMSTVRMTLRITENTPISSFSTSIVVIPETPTQTPPVLTSATGTQTSPAPTTVTFGSTDSSTSTLHTLTPSTALSTIVSTSQVPIPSTHSSTLQTTPSTPSLQTSLTSTSEFTTESFTRGSTSTNAILTSFSTIIWSSTPTIIMSSSPSSASITPVFSTTIHSVPSSPYIFSTENVGSASITGFPSLSSSATTSTSSTSSSLTTALTEITPFSYISLPSTTPCPGTITITIVPASPTDPCVEMDPSTEATSPPTTPLTVFPFTTEMVTCPTSISIQTTLTTYMDTSSMMPESESSISPNASSSTGTGTVPTNTVFTSTRLPTSETWLSNSSVIPLPLPGVSTIPLTMKPSSSLPTILRTSSKSTHPSPPTTRTSETPVATTQTPTTLTSRRTTRITSQMTTQSTLTTTAGTCDNGGTWEQGQCACLPGFSGDRCQLQTRCQNGGQWDGLKCQCPSTFYGSSCEFAVEQVDLDVVETEVGMEVSVDQQFSPDLNDNTSQAYRDFNKTFWNQMQKIFADMQGFTFKGVEILSLRNGSIVVDYLVLLEMPFSPQLESEYEQVKTTLKEGLQNASQDVNSCQDSQTLCFKPDSIKVNNNSKTELTPAAICRRAAPTGYEEFYFPLVEATRLRCVTKCTSGVDNAIDCHQGQCVLETSGPTCRCYSTDTHWFSGPRCEVAVHWRALVGGLTAGAALLVLLLLALGVRAVRSGWWGGQRRGRSWDQDRKWFETWDEEVVGTFSNWGFEDDGTDKDTNFYVALENVDTTMKVHIKRPEMTSSSV

SEQ ID NO: 9103 - protein, 3265 aa, Homo Sapiens
MQLLGLLGLLWMLKASPWATGTLSTATSISQVPFPRAEAASAVLSNSPHSRDLAGWPLGVPQLASPAPGHRENAPMTLTTSPHDTLISETLLNSPVSSNTSTTPTSKFAFKVETTPPTVLVYSATTECVYPTSFIITISHPTSICVTTTQVAFTSSYTSTPVTQKPVTTVTSTYSMTTTEKGTSAMTSSPSTTTARETPIVTVTPSSVSATDTTFHTTISSTTRTTERTPLPTGSIHTTTSPTPVFTTLKTAVTSTSPITSSITSTNTVTSMTTTASQPTATNTLSSPTRTILSSTPVLSTETITSGITNTTPLSTLVTTLPTTISRSTPTSETTYTTSPTSTVTDSTTKIAYSTSMTGTLSTETSLPPTSSSLPTTETATTPMTNLVTTTTEISSHSTPSFSSSTIYSTVSTSTTAISSLPPTSGTMVTSTTMTPSSLSTDIPFTTPTTITHHSVGSTGFLTTATDLTSTFTVSSSSAMSTSVIPSSPSIQNTETSSLVSMTSATTPNVRPTFVSTLSTPTSSLLTTFPATYSFSSSMSASSAGTTHTESISSPPASTSTLHTTAESTLAPTTTTSFTTSTTMEPPSTTAATTGTGQTTFTSSTATFPETTTPTPTTDMSTESLTTAMTSPPITSSVTSTNTVTSMTTTTSPPTTTNSFTSLTSMPLSSTPVPSTEVVTSGTINTIPPSILVTTLPTPNASSMTTSETTYPNSPTGPGTNSTTEITYPTTMTETSSTATSLPPTSPLVSTAKTAKTPTTNLVTTTTKTTSHSTTSFTSSTVYSTASTYTTAITSVPTTLGTMVTSTSMISSTVSTGIPTSQPTTITPSSVGISGSLPMMTDLTSVYTVSNMSARPTTVIPSSPTVQNTEISISVSMTSATTPSGGPTFTSTENTPTRSLLTSFPMTHSFSSSMSESSAGTTHTESISSPRGTTSTLHTTVESTPSPTTTTSFTTSTMMEPPSSTVSTTGRGQTTFPSSTATFPETTTLTPTTDISTVSLTTAMTSPPPVSSSITPTNTMTSMRTTTYWPTATNTLSPLTSSILSSTPVPSTEMITSHTTNTTPLSTLVTTLLTTITRSTPTSETTYPTSPTSIVSDSTTEITYSTSITGTLSTATTLPPTSSSLPTTETATMTPTTTLITTTPNTTSLSTPSFTSSTIYSTVSTSTTAISSASPTSGTMVTSTTMTPSSLSTDTPSTTPTTITYPSVGSTGFLTTATDLTSTFTVSSSSAMSTSVIPSSPSIQNTETSSLVSMTSATTPSLRPTITSTDSTLTSSLLTTFPSTYSFSSSMSASSAGTTHTETISSLPASTNTIHTTAESALAPTTTTSFTTSPTMEPPSTTVATTGTGQTTFPSSTATFLETTTLTPTTDFSTESLTTAMTSTPPITSSITPTDTMTSMRTTTSWPTATNTLSPLTSSILSSTPVPSTEVTTSHTTNTNPVSTLVTTLPITITRSTLTSETAYPSSPTSTVTESTTEITYPTTMTETSSTATSLPPTSSLVSTAETAKTPTTNLVTTTTKTTSHSTTSFTSSTIYSTASTPTTAITSVPTTLGTMVTSTSMIPSTVSTGIPTSQPTTITPSSVGISGSLPMMTDLTSVYTVSSMSARPTSVIPSSPTVQNTETSIFVSMMSATTPSGGPTFTSTENTPTRSLLTSFPVTHSFSSSMSASSVGTTHTQSISSPPAITSTLHTTAESTPSPTTTMSFTTFTKMETPSSTVATTGTGQTTFTSSTATSPKTTTLTPTSDISTGSFKTAVSSTPPITSSITSTYTVTSMTTTTPLGPTATNTLPSFTSSVSSSTPVPSTEAITSGTTNTTPLSTLVTTFSNSDTSSTPTSETTYPTSLTSALTDSTTRTTYSTNMTGTLSTVTSLRPTSSSLLTTVTATVPTTNLVTTTTKITSHSTPSFTSSIATTETPSHSTPRFTSSITTTETPSHSTPRFTSSITNTKTTSHSSPSFTSSITTTETTSHNTPSLTSSITTTKTTSHSTPSYTSLITTTTTTSHSTPSFTSSITTTETTSHNTPSLTSSITTTETTSHSTPSFTSSITTETTSHSTPSFTSLITITEITSHSTLSYTTSITTTETPSHSTLSFTSSITTTETTSHSTPSFTSSITTSEMPSHSTPSFTSSITTTENATHSTPNFTSSITTTETTSHSTPSFTSLITTTETTSHRWGTTETTSYSTPSFTSSNTITETTSHSTPSYITSITTTETPSSSTPSFSSSITTTETTSHSTPGFTSSITTTETTSHSTPSFTSSITTTETTSHDTPSFTSSITTSETPSHSTPSSTSLITTTKTTSHSTPSFTSSITTTETTSHSAHSFTSSITTTETTSHNTRSFTSSITTTETNSHSTTSFTSSITTTETTSHSTPSFSSSITTTETPLHSTPGLTSWVTTTKTTSHITPGLTSSITTTETTSHSTPGFTSSITTTETTSESTPSLSSSTIYSTVSTSTTAITSHFTTSETAVTPTPVTPSSLSTDIPTTSLRTLTPSSVGTSTSLTTTTDFPSIPTDISTLPTRTHIISSSPSIQSTETSSLVGTTSPTMSTVRMTLRITENTPISSFSTSIVVIPETPTQTPPVLTSATGTQTSPAPTTVTFGSTDSSTSTLHTLTPSTALSTIVSTSQVPIPSTHSSTLQTTPSTPSLQTSLTSTSEFTTESFTRGSTSTNAILTSFSTIIWSSTPTIIMSSSPSSASITPVFSTTIHSVPSSPYIFSTENVGSASITGFPSLSSSATTSTSSTSSSLTTALTEITPFSYISLPSTTPCPGTITITIVPASPTDPCVEMDPSTEATSPPTTPLTVFPFTTEMVTCPTSISIQTTLTTYMDTSSMMPESESSISPNASSSTGTGTVPTNTVFTSTRLPTSETWLSNSSVIPLPLPGVSTIPLTMKPSSSLPTILRTSSKSTHPSPPTTRTSETPVATTQTPTTLTSRRTTRITSQMTTQSTLTTTAGTCDNGGTWEQGQCACLPGFSGDRCQLQTRCQNGGQWDGLKCQCPSTFYGSSCEFAVEQVDLDVVETEVGMEVSVDQQFSPDLNDNTSQAYRDFNKTFWNQMQKIFADMQGFTFKGVEILSLRNGSIVVDYLVLLEMPFSPQLESEYEQVKTTLKEGLQNASQDVNSCQDSQTLCFKPDSIKVNNNSKTELTPAAICRRAAPTGYEEFYFPLVEATRLRCVTKCTSGVDNAIDCHQGQCVLETSGPTCRSWDQDRKWFETWDEEVVGTFSNWGFEDDGTDKDTNFYVALENVDTTMKVHIKRPEMTSSSV

SEQ ID NO: 9104 - protein, 1002 aa, Homo Sapiens
  misc_feature (1)..(1): Xaa can be any naturally occurring amino acid
XITITEITSHSTLSYTTSITTTETPSHSTLSFTSSITTTETTSHSTPSFTSSITTSEMPSHSTPSFTSSITTTENATHSTPNFTSSITTTETTSHSTPSFTSLITTTETTSHRWGTTETTSYSTPSFTSSNTITETTSHSTPSYITSITTTETPSSSTPSFSSSITTTETTSHSTPGFTSSITTTETTSHSTPSFTSSITTTETTSHDTPSFTSSITTSETPSHSTPSSTSLITTTKTTSHSTPSFTSSITTTETTSHSAHSFTSSITTTETTSHNTRSFTSSITTTETNSHSTTSFTSSITTTETTSHSTPSFSSSITTTETPLHSTPGLTSWVTTTKTTSHITPGLTSSITTTETTSHSTPGFTSSITTTETTSESTPSLSSSTIYSTVSTSTTAITSHFTTSETAVTPTPVTPSSLSTDIPTTSLRTLTPSSVGTSTSLTTTTDFPSIPTDISTLPTRTHIISSSPSIQSTETSSLVGTTSPTMSTVRMTLRITENTPISSFSTSIVVIPETPTQTPPVLTSATGTQTSPAPTTVTFGSTDSSTSTLHTLTPSTALSTIVSTSQVPIPSTHSSTLQTTPSTPSLQTSLTSTSEFTTESFTRGSTSTNAILTSFSTIIWSSTPTIIMSSSPSSASITPVFSTTIHSVPSSPYIFSTENVGSASITGFPSLSSSATTSTSSTSSSLTTALTEITPFSYISLPSTTPCPGTITITIVPASPTDPCVEMDPSTEATSPPTTPLTVFPFTTEMVTCPTSISIQTTLTTYMDTSSMMPESESSISPNASSSTGTGTVPTNTVFTSTRLPTSETWLSNSSVIPLPLPGVSTIPLTMKPSSSLPTILRTSSKSTHPSPPTTRTSETPVATTQTPTTLTSRRTTRITSQMTTQSTLTTTAGTCDNGGTWEQGQCACLPGFSGDRCQLQTRCQNGGQWDGLKCQCPSTFYGSSCEFAVEQVDLDAEDFCRHAGLHLQGCGDPVPEEWQHRGGLPGPAGDALQPPAGERV

SEQ ID NO: 9105 - protein, 5654 aa, Homo Sapiens
MSVGRRKLALLWALALALACTRHTGHAQDGSSESSYKHHPALSPIARGPSGVPLRGATVFPSLRTIPVVRASNPAHNGRVCSTWGSFHYKTFDGDVFRFPGLCNYVFSEHCGAAYEDFNIQLRRSQESAAPTLSRVLMKVDGVVIQLTKGSVLVNGHPVLLPFSQSGVLIQQSSSYTKVEARLGLVLMWNHDDSLLLELDTKYANKTCGLCGDFNGMPVVSELLSHNTKLTPMEFGNLQKMDDPTDQCQDPVPEPPRNCSTGFGICEELLHGQLFSGCVALVDVGSYLEACRQDLCFCEDTDLLSCVCHTLAEYSRQCTHAGGLPQDWRGPDFCPQKCPNNMQYHECRSPCADTCSNQEHSRACEDHCVAGCFCPEGTVLDDIGQTGCVPVSKCACVYNGAAYAPGATYSTDCTNCTCSGGRWSCQEVPCPGTCSVLGGAHFSTFDGKQYTVHGDCSYVLTKPCDSSAFTVLAELRRCGLTDSETCLKSVTLSLDGAQTVVVIKASGEVFLNQIYTQLPISAANVTIFRPSTFFIIAQTSLGLQLNLQLVPTMQLFMQLAPKLRGQTCGLCGNFNSIQADDFRTLSGVVEATAAAFFNTFKTQAACPNIRNSFEDPCSLSVENEKYAQHWCSQLTDADGPFGRCHAAVKPGTYYSNCMFDTCNCERSEDCLCAALSSYVHACAAKGVQLGGWRDGVCTKPMTTCPKSMTYHYHVSTCQPTCRSLSEGDITCSVGFIPVDGCICPKGTFLDDTGKCVQASNCPCYHRGSMIPNGESVHDSGAICTCTHGKLSCIGGQAPAPVCAAPMVFFDCRNATPGDTGAGCQKSCHTLDMTCYSPQCVPGCVCPDGLVADGEGGCITAEDCPCVHNEASYRAGQTIRVGCNTCTCDSRMWRCTDDPCLATCAVYGDGHYLTFDGQSYSFNGDCEYTLVQNHCGGKDSTQDSFRVVTENVPCGTTGTTCSKAIKIFLGGFELKLSHGKVEVIGTDESQEVPYTIRQMGIYLVVDTDIGLVLLWDKKTSIFINLSPEFKGRVCGLCGNFDDIAVNDFATRSRSVVGDVLEFGNSWKLSPSCPDALAPKDPCTANPFRKSWAQKQCSILHGPTFAACHAHVEPARYYEACVNDACACDSGGDCECFCTAVAAYAQACHEVGLCVSWRTPSICPLFCDYYNPEGQCEWHYQPCGVPCLRTCRNPRGDCLRDVRGLEGCYPKCPPEAPIFDEDKMQCVATCPTPPLPPRCHVHGKSYRPGAVVPSDKNCQSCLCTERGVECTYKAEACVCTYNGQRFHPGDVIYHTTDGTGGCISARCGANGTIERRVYPCSPTTPVPPTTFSFSTPPLVVSSTHTPSNGPSSAHTGPPSSAWPTTAGTSPRTRLPTASASLPPVCGEKCLWSPWMDVSRPGRGTDSGDFDTLENLRAHGYRVCESPRSVECRAEDAPGVPLRALGQRVQCSPDVGLTCRNREQASGLCYNYQIRVQCCTPLPCSTSSSPAQTTPPTTSKTTETRASGSSAPSSTPGTVSLSTARTTPAPGTATSVKKTFSTPSPPPVPATSTSSMSTTAPGTSVVSSKPTPTEPSTSSCLQELCTWTEWIDGSYPAPGINGGDFDTFQNLRDEGYTFCESPRSVQCRAESFPNTPLADLGQDVICSHTEGLICLNKNQLPPICYNYEIRIQCCETVNVCRDITRLPKTVATTRPTPHPTGAQTQTTFTTHMPSASTEQPTATSRGGPTATSVTQGTHTTLVTRNCHPRCTWTKWFDVDFPSPGPHGGDKETYNNIIRSGEKICRRPEEITRLQCRAKSHPEVSIEHLGQVVQCSREEGLVCRNQDQQGPFKMCLNYEVRVLCCETPRGCHMTSTPGSTSSSPAQTTPSTTSKTTETQASGSSAPSSTPGTVSLSTARTTPAPGTATSVKKTFSTPSPPPVPATSTSSMSTTAPGTSVVSSKPTPTEPSTSSCLQELCTWTEWIDGSYPAPGINGGDFDTFQNLRDEGYTFCESPRSVQCRAESFPNTPLADLGQDVICSHTEGLICLNKNQLPPICYNYEIRIQCCETVNVCRDITRPPKTVATTRPTPHPTGAQTQTTFTTHMPSASTEQPTATSRGGPTATSVTQGTHTTPVTRNCHPRCTWTTWFDVDFPSPGPHGGDKETYNNIIRSGEKICRRPEEITRLQCRAKSHPEVSIEHLGQVVQCSREEGLVCRNQDQQGPFKMCLNYEVRVLCCETPKGCPVTSTPVTAPSTPSGRATSPTQSTSSWQKSRTTTLVTTSTTSTPQTSTTYAHTTSTTSAPTARTTSAPTTRTTSASPASTTSGPGNTPSPVPTTSTISAPTTSITSAPTTSTTSAPTSSTTSGPGTTPSPVPTTSITSAPTTSTTSAPTTSTTSARTSSTTSATTTSRISGPETTPSPVPTTSTTSATTTSTTSAPTTSTTSAPTSSTTSSPQTSTTSAPTTSTTSGPGTTPSPVPTTSTTSAPTTRTTSAPKSSTTSAATTSTTSGPETTPRPVPTTSTTSSPTTSTTSAPTTSTTSASTTSTTSGAGTTPSPVPTTSTTSAPTTSTTSAPISSTTSATTTSTTSGPGTTPSPVPTTSTTSAPTTSTTSGPGTTPSAVPTTSITSAPTTSTNSAPISSTTSATTTSRISGPETTPSPVPTASTTSASTTSTTSGPGTTPSPVPTTSTISVPTTSTTSASTTSTTSASTTSTTSGPGTTPSPVPTTSTTSAPTTSTTSAPTTSTISAPTTSTTSATTTSTTSAPTPRRTSAPTTSTISASTTSTTSATTTSTTSATTTSTISAPTTSTTLSPTTSTTSTTITSTTSAPISSTTSTPQTSTTSAPTTSTTSGPGTTSSPVPTTSTTSAPTTSTTSAPTTRTTSVPTSSTTSTATTSTTSGPGTTPSPVPTTSTTSAPTTRTTSAPTTSTTSAPTTSTTSAPTSSTTSATTTSTISVPTTSTTSVPGTTPSPVPTTSTISVPTTSTTSASTTSTTSGPGTTPSPVPTTSTTSAPTTSTTSAPTTSTISAPTTSTPSAPTTSTTLAPTTSTTSAPTTSTTSTPTSSTTSSPQTSTTSASTTSITSGPGTTPSPVPTTSTTSAPTTSTTSAATTSTISAPTTSTTSAPTTSTTSASTASKTSGLGTTPSPIPTTSTTSPPTTSTTSASTASKTSGPGTTPSPVPTTSTIFAPRTSTTSASTTSTTPGPGTTPSPVPTTSTASVSKTSTSHVSISKTTHSQPVTRDCHLRCTWTKWFDIDFPSPGPHGGDKETYNNIIRSGEKICRRPEEITRLQCRAESHPEVSIEHLGQVVQCSREEGLVCRNQDQQGPFKMCLNYEVRVLCCETPKGCPVTSTPVTAPSTPSGRATSPTQSTSSWQKSRTTTLVTTSTTSTPQTSTTSAPTTSTTSAPTTSTTSAPTTSTTSTPQTSISSAPTSSTTSAPTSSTISARTTSIISAPTTSTTSSPTTSTTSATTTSTTSAPTSSTTSTPQTSKTSAATSSTTSGSGTTPSPVTTTSTASVSKTSTSHVSVSKTTHSQPVTRDCHPRCTWTKWFDVDFPSPGPHGGDKETYNNIIRSGEKICRRPEEITRLQCRAKSHPEVSIEHLGQVVQCSREEGLVCRNQDQQGPFKMCLNYEVRVLCCETPKGCPVTSTSVTAPSTPSGRATSPTQSTSSWQKSRTTTLVTSSITSTTQTSTTSAPTTSTTPASIPSTTSAPTTSTTSAPTTSTTSAPTTSTTSTPQTTTSSAPTSSTTSAPTTSTISAPTTSTISAPTTSTTSAPTASTTSAPTSTSSAPTTNTTSAPTTSTTSAPITSTISAPTTSTTSTPQTSTISSPTTSTTSTPQTSTTSSPTTSTTSAPTTSTTSAPTTSTTSTPQTSISSAPTSSTTSAPTASTISAPTTSTTSFHTTSTTSPPTSSTSSTPQTSKTSAATSSTTSGSGTTPSPVPTTSTASVSKTSTSHVSVSKTTHSQPVTRDCHPRCTWTKWFDVDFPSPGPHGGDKETYNNIIRSGEKICRRPEEITRLQCRAESHPEVSIEHLGQVVQCSREEGLVCRNQDQQGPFKMCLNYEVRVLCCETPKGCPVTSTPVTAPSTPSGRATSPTQSTSSWQKSRTTTLVTTSTTSTPQTSTTSAPTTSTIPASTPSTTSAPTTSTTSAPTTSTTSAPTHRTTSGPTTSTTLAPTTSTTSAPTTSTNSAPTTSTISASTTSTISAPTTSTISSPTSSTTSTPQTSKTSAATSSTTSGSGTTPSPVPTTSTTSASTTSTTSAPTTSTTSGPGTTPSPVPSTSTTSAATTSTTSAPTTRTTSAPTSSMTSGPGTTPSPVPTTSTTSAPTTSTTSGPGTTPSPVPTTSTTSAPITSTTSGPGSTPSPVPTTSTTSAPTTSTTSASTASTTSGPGTTPSPVPTTSTTSAPTTRTTSASTASTTSGPGSTPSPVPTTSTTSAPTTRTTPASTASTTSGPGTTPSPVPTTSTTSASTTSTISLPTTSTTSAPITSMTSGPGTTPSPVPTTSTTSAPTTSTTSASTASTTSGPGTTPSPVPTTSTTSAPTTSTTSASTASTTSGPGTSLSPVPTTSTTSAPTTSTTSGPGTTPSPVPTTSTTSAPTTSTTSGPGTTPSPVPTTSTTPVSKTSTSHLSVSKTTHSQPVTSDCHPLCAWTKWFDVDFPSPGPHGGDKETYNNIIRSGEKICRRPEEITRLQCRAESHPEVNIEHLGQVVQCSREEGLVCRNQDQQGPFKMCLNYEVRVLCCETPRGCPVTSVTPYGTSPTNALYPSLSTSMVSASVASTSVASSSVASSSVAYSTQTCFCNVADRLYPAGSTIYRHRDLAGHCYYALCSQDCQVVRGVDSDCPSTTLPPAPATSPSISTSEPVTELGCPNAVPPRKKGETWATPNCSEATCEGNNVISLRPRTCPRVEKPTCANGYPAVKVADQDGCCHHYQCQCVCSGWGDPHYITFDGTYYTFLDNCTYVLVQQIVPVYGHFRVLVDNYFCGAEDGLSCPRSIILEYHQDRVVLTRKPVHGVMTNEIIFNNKVVSPGFRKNGIVVSRIGVKMYATIPELGVQVMFSGLIFSVEVPFSKFANNTEGQCGTCTNDRKDECRTPRGTVVASCSEMSGLWNVSIPDQPACHRPHPTPTTVGPTTVGSTTVGPTTVGSTTVGPTTPPAPCLPSPICQLILSKVFEPCHTVIPPLLFYEGCVFDRCHMTDLDVVCSSLELYAALCASHDICIDWRGRTGHMCPFTCPADKVYQPCGPSNPSYCYGNDSASLGALPEAGPITEGCFCPEGMTLFSTSAQVCVPTGCPRCLGPHGEPVKVGHTVGMDCQECTCEAATWTLTCRPKLCPLPPACPLPGFVPVPAAPQAGQCCPQYSCACNTSRCPAPVGCPEGARAIPTYQEGACCPVQNCSWTVCSINGTLYQPGAVVSSSLCETCRCELPGGPPSDAFVVSCETQICNTHCPVGFEYQEQSGQCCGTCVQVACVTNTSKSPAHLFYPGETWSDAGNHCVTHQCEKHQDGLVVVTTKKACPPLSCSLDEARMSKDGCCRFCPPPPPPYQNQSTCAVYHRSLIIQQQGCSSSEPVRLAYCRGNCGDSSSMYSLEGNTVEHRCQCCQELRTSLRNVTLHCTDGSSRAFSYTEVEECGCMGRRCPAPGDTQHSEEAEPEPSQEAESGSWERGVPVSPMH

SEQ ID NO: 9106 - protein, 5762 aa, Homo Sapiens
MGAPSACRTLVLALAAMLVVPQAETQGPVEPSWENAGHTMDGGAPTSSPTRRVSFVPPVTVFPSLSPLNPAHNGRVCSTWGDFHYKTFDGDVFRFPGLCNYVFSEHCRAAYEDFNVQLRRGLVGSRPVVTRVVIKAQGLVLEASNGSVLINGQREELPYSRTGLLVEQSGDYIKVSIRLVLTFLWNGEDSALLELDPKYANQTCGLCGDFNGLPAFNEFYAHNARLTPLQFGNLQKLDGPTEQCPDPLPLPAGNCTDEEGICHRTLLGPAFAECHALVDSTAYLAACAQDLCRCPTCPCATFVEYSRQCAHAGGQPRNWRCPELCPRTCPLNMQHQECGSPCTDTCSNPQRAQLCEDHCVDGCFCPPGTVLDDITHSGCLPLGQCPCTHGGRTYSPGTSFNTTCSSCTCSGGLWQCQDLPCPGTCSVQGGAHISTYDEKLYDLHGDCSYVLSKKCADSSFTVLAELRKCGLTDNENCLKAVTLSLDGGDTAIRVQADGGVFLNSIYTQLPLSAANITLFTPSSFFIVVQTGLGLQLLVQLVPLMQVFVRLDPAHQGQMCGLCGNFNQNQADDFTALSGVVEATGAAFANTWKAQAACANARNSFEDPCSLSVENENYARHWCSRLTDPNSAFSRCHSIINPKPFHSNCMFDTCNCERSEDCLCAALSSYVHACAAKGVQLSDWRDGVCTKYMQNCPKSQRYAYVVDACQPTCRGLSEADVTCSVSFVPVDGCTCPAGTFLNDAGACVPAQECPCYAHGTVLAPGEVVHDEGAVCSCTGGKLSCLGASLQKSTGCAAPMVYLDCSNSSAGTPGAECLRSCHTLDVGCFSTHCVSGCVCPPGLVSDGSGGCIAEEDCPCVHNEATYKPGETIRVDCNTCTCRNRRWECSHRLCLGTCVAYGDGHFITFDGDRYSFEGSCEYILAQDYCGDNTTHGTFRIVTENIPCGTTGTTCSKAIKLFVESYELILQEGTFKAVARGPGGDPPYKIRYMGIFLVIETHGMAVSWDRKTSVFIRLHQDYKGRVCGLCGNFDDNAINDFATRSRSVVGDALEFGNSWKLSPSCPDALAPKDPCTANPFRKSWAQKQCSILHGPTFAACRSQVDSTKYYEACVNDACACDSGGDCECFCTAVAAYAQACHDAGLCVSWRTPDTCPLFCDFYNPHGGCEWHYQPCGAPCLKTCRNPSGHCLVDLPGLEGCYPKCPPSQPFFNEDQMKCVAQCGCYDKDGNYYDVGARVPTAENCQSCNCTPSGIQCAHSLEACTCTYEDRTYSYQDVIYNTTDGLGACLIAICGSNGTIIRKAVACPGTPATTPFTFTTAWVPHSTTSPALPVSTVCVREVCRWSSWYNGHRPEPGLGGGDFETFENLRQRGYQVCPVLADIECRAAQLPDMPLEELGQQVDCDRMRGLMCANSQQSPPLCHDYELRVLCCEYVPCGPSPAPGTSPQPSLSASTEPAVPTPTQTTATEKTTLWVTPSIRSTAALTSQTGSSSGPVTVTPSAPGTTTCQPRCQWTEWFDEDYPKSEQLGGDVESYDKIRAAGGHLCQQPKDIECQAESFPNWTLAQVGQKVHCDVHFGLVCRNWEQEGVFKMCYNYRIRVLCCSDDHCRGRATTPPPTTELETATTTTTQALFSTPQPTSSPGLTRAPPASTTAVPTLSEGLTSPRYTSTLGTATTGGPTTPAGSTEPTVPGVATSTLPTRSALPGTTGSLGTWRPSQPPTLAPTTMATSRARPTGTASTASKEPLTTSLAPTLTSELSTSQAETSTPRTETTMSPLTNTTTSQGTTRCQPKCEWTEWFDVDFPTSGVAGGDMETFENIRAAGGKMCWAPKSIECRAENYPEVSIDQVGQVLTCSLETGLTCKNEDQTGRFNMCFNYNVRVLCCDDYSHCPSTPATSSTATPSSTPGTTWILTKPTTTATTTASTGSTATPTSTLRTAPPPKVLTTTATTPTVTSSKATPSSSPGTATALPALRSTATTPTATSVTPIPSSSLGTTWTRLSQTTTPTATMSTATPSSTPETAHTSTVLTATATTTGATGSVATPSSTPGTAHTTKVPTTTTTGFTATPSSSPGTALTPPVWISTTTTPTTRGSTVTPSSIPGTTHTATVLTTTTTTVATGSMATPSSSTQTSGTPPSLTTTATTITATGSTTNPSSTPGTTPIPPVLTTTATTPAATSNTVTPSSALGTTHTPPVPNTMATTHGRSLPPSSPHTVRTAWTSATSGILGTTHITEPSTVTSHTLAATTGTTQHSTPALSSPHPSSRTTESPPSPGTTTPGHTTATSRTTATATPSKTRTSTLLPSSPTSAPITTVVTMGCEPQCAWSEWLDYSYPMPGPSGGDFDTYSNIRAAGGAVCEQPLGLECRAQAQPGVPLRELGQVVECSLDFGLVCRNREQVGKFKMCFNYEIRVFCCNYGHCPSTPATSSTAMPSSTPGTTWILTELTTTATTTESTGSTATPSSTPGTTWILTEPSTTATVTVPTGSTATASSTQATAGTPHVSTTATTPTVTSSKATPFSSPGTATALPALRSTATTPTATSFTAIPSSSLGTTWTRLSQTTTPTATMSTATPSSTPETVHTSTVLTTTATTTGATGSVATPSSTPGTAHTTKVLTTTTTGFTATPSSSPGTARTLPVWISTTTTPTTRGSTVTPSSIPGTTHTPTVLTTTTTTVATGSMATPSSSTQTSGTPPSLTTTATTITATGSTTNPSSTPGTTPIPPVLTTTATTPAATSSTVTPSSALGTTHTPPVPNTTATTHGRSLSPSSPHTVRTAWTSATSGTLGTTHITEPSTGTSHTPAATTGTTQHSTPALSSPHPSSRTTESPPSPGTTTPGHTRATSRTTATATPSKTRTSTLLPSSPTSAPITTVVTMGCEPQCAWSEWLDYSYPMPGPSGGDFDTYSNIRAAGGAVCEQPLGLECRAQAQPGVPLRELGQVVECSLDFGLVCRNREQVGKFKMCFNYEIRVFCCNYGHCPSTPATSSTATPSSTPGTTWILTEQTTAATTTATTGSTAIPSSTPGTAPPPKVLTSTATTPTATSSKATSSSSPRTATTLPVLTSTATKSTATSFTPIPSFTLGTTGTLPEQTTTPMATMSTIHPSSTPETTHTSTVLTTKATTTRATSSMSTPSSTPGTTWILTELTTAATTTAATGPTATPSSTPGTTWILTEPSTTATVTVPTGSTATASSTRATAGTLKVLTSTATTPTVISSRATPSSSPGTATALPALRSTATTPTATSVTAIPSSSLGTAWTRLSQTTTPTATMSTATPSSTPETVHTSTVLTTTTTTTRATGSVATPSSTPGTAHTTKVPTTTTTGFTATPSSSPGTALTPPVWISTTTTPTTRGSTVTPSSIPGTTHTATVLTTTTTTVATGSMATPSSSTQTSGTPPSLTTTATTITATGSTTNPSSTPGTTPIPPVLTTTATTPAATSSTVTPSSALGTTHTPPVPNTTATTHGRSLPPSSPHTVRTAWTSATSGILGTTHITEPSTVTSHTPAATTSTTQHSTPALSSPHPSSRTTESPPSPGTTTPGHTRGTSRTTATATPSKTRTSTLLPSSPTSAPITTVVTTGCEPQCAWSEWLDYSYPMPGPSGGDFDTYSNIRAAGGAVCEQPLGLECRAQAQPGVPLRELGQVVECSLDFGLVCRNREQVGKFKMCFNYEIRVFCCNYGHCPSTPATSSTATPSSTPGTTWILTKLTTTATTTESTGSTATPSSTPGTTWILTEPSTTATVTVPTGSTATASSTQATAGTPHVSTTATTPTVTSSKATPFSSPGTATALPALRSTATTPTATSFTAIPSSSLGTTWTRLSQTTTPTATMSTATPSSTPETAHTSTVLTTTATTTRATGSVATPSSTPGTAHTTKVPTTTTTGFTVTPSSSPGTARTPPVWISTTTTPTTSGSTVTPSSVPGTTHTPTVLTTTTTTVATGSMATPSSSTQTSGTPPSLITTATTITATGSTTNPSSTPGTTPIPPVLTTTATTPAATSSTVTPSSALGTTHTPPVPNTTATTHGRSLSPSSPHTVRTAWTSATSGTLGTTHITEPSTGTSHTPAATTGTTQHSTPALSSPHPSSRTTESPPSPGTTTPGHTTATSRTTATATPSKTRTSTLLPSSPTSAPITTVVTTGCEPQCAWSEWLDYSYPMPGPSGGDFDTYSNIRAAGGAVCEQPLGLECRAQAQPGVPLGELGQVVECSLDFGLVCRNREQVGKFKMCFNYEIRVFCCNYGHCPSTPATSSTAMPSSTPGTTWILTELTTTATTTASTGSTATPSSTPGTAPPPKVLTSPATTPTATSSKATSSSSPRTATTLPVLTSTATKSTATSVTPIPSSTLGTTGTLPEQTTTPVATMSTIHPSSTPETTHTSTVLTTKATTTRATSSTSTPSSTPGTTWILTELTTAATTTAATGPTATPSSTPGTTWILTELTTTATTTASTGSTATPSSTPGTTWILTEPSTTATVTVPTGSTATASSTQATAGTPHVSTTATTPTVTSSKATPSSSPGTATALPALRSTATTPTATSFTAIPSSSLGTTWTRLSQTTTPTATMSTATPSSTPETVHTSTVLTATATTTGATGSVATPSSTPGTAHTTKVPTTTTTGFTATPSSSPGTALTPPVWISTTTTPTTTTPTTSGSTVTPSSIPGTTHTARVLTTTTTTVATGSMATPSSSTQTSGTPPSLTTTATTITATGSTTNPSSTPGTTPITPVLTSTATTPAATSSKATSSSSPRTATTLPVLTSTATKSTATSFTPIPSSTLWTTWTVPAQTTTPMSTMSTIHTSSTPETTHTSTVLTTTATMTRATNSTATPSSTLGTTRILTELTTTATTTAATGSTATLSSTPGTTWILTEPSTIATVMVPTGSTATASSTLGTAHTPKVVTTMATMPTATASTVPSSSTVGTTRTPAVLPSSLPTFSVSTVSSSVLTTLRPTGFPSSHFSTPCFCRAFGQFFSPGEVIYNKTDRAGCHFYAVCNQHCDIDRFQGACPTSPPPVSSAPLSSPSPAPGCDNAIPLRQVNETWTLENCTVARCVGDNRVVLLDPKPVANVTCVNKHLPIKVSDPSQPCDFHYECECICSMWGGSHYSTFDGTSYTFRGNCTYVLMREIHARFGNLSLYLDNHYCTASATAAAARCPRALSIHYKSMDIVLTVTMVHGKEEGLILFDQIPVSSGFSKNGVLVSVLGTTTMRVDIPALGVSVTFNGQVFQARLPYSLFHNNTEGQCGTCTNNQRDDCLQRDGTTAASCKDMAKTWLVPDSRKDGCWAPTGTPPTASPAAPVSSTPTPTPCPPQPLCDLMLSQVFAECHNLVPPGPFFNACISDHCRGRLEVPCQSLEAYAELCRARGVCSDWRGATGGLCDLTCPPTKVYKPCGPIQPATCNSRNQSPQLEGMAEGCFCPEDQILFNAHMGICVQACPCVGPDGFPKFPGERWVSNCQSCVCDEGSVSVQCKPLPCDAQGQPPPCNRPGFVTVTRPRAENPCCPETVCVCNTTTCPQSLPVCPPGQESICTQEEGDCCPTFRCRPQLCSYNGTFYGVGATFPGALPCHMCTCLSGDTQDPTVQCQEDACNNTTCPQGFEYKRVAGQCCGECVQTACLTPDGQPVQLNETWVNSHVDNCTVYLCEAEGGVHLLTPQPASCPDVSSCRGSLRKTGCCYSCEEDSCQVRINTTILWHQGCETEVNITFCEGSCPGASKYSAEAQAMQHQCTCCQERRVHEETVPLHCPNGSAILHTYTHVDECGCTPFCVPAPMAPPHTRGFPAQEATAV

SEQ ID NO: 9107 - protein, 154 aa, Homo Sapiens [sequence omitted]

SEQ ID NO: 9108 - protein, 181 aa, Homo Sapiens
MDTSRTPSVCRETGGAALSRGERRPQGRRGSPTPTAGPVHTGLANTSYTSPGLQRLKDSPQTAPDKGQCSTWGAGHFSTFDHHVYDFSGTCNYIFAATCKDAFPTFSVQLRRGPDGSISRIIVELGASVVTVSEAIISVKDIGVISLPYTSNGLQITPFGQSVRLVAKQLELELEVVWGPD

SEQ ID NO: 9109 - protein, 2439 aa, Homo Sapiens
MVQRWLLLSCCGALLSAGLANTSYTSPGLQRLKDSPQTAPDKGQCSTWGAGHFSTFDHHVYDFSGTCNYIFAATCKDAFPTFSVQLRRGPDGSISRIIVELGASVVTVSEAIISVKDIGVISLPYTSNGLQITPFGQSVRLVAKQLELELEVVWGPDSHLMVLVERKYMGQMCGLCGNFDGKVTNEFVSEEGKFLEPHKFAALQKLDDPGEICTFQDIPSTHVRQAQHARICTQLLTLVAPECSVSKEPFVLSCQADVAAAPQPGPQNSSCATLSEYSRQCSMVGQPVRRWRSPGLCSVGQCPANQVYQECGSACVKTCSNPQHSCSSSCTFGCFCPEGTVLNDLSNNHTCVPVTQCPCVLHGAMYAPGEVTIAACQTCRCTLGRWVCTERPCPGHCSLEGGSFVTTFDARPYRFHGTCTYILLQSPQLPEDGALMAVYDKSGVSHSETSLVAVVYLSRQDKIVISQDEVVTNNGEAKWLPYKTRNITVFRQTSTHLQMATSFGLELVVQLRPIFQAYVTVGPQFRGQTRGLCGNFNGDTTDDFTTSMGIAEGTASLFVDSWRAGNCPAALERETDPCSMSQLNKVCAETHCSMLLRTGTVFERCHATVNPAPFYKRCVYQACNYEETFPHICAALGDYVHACSLRGVLLWGWRSSVDNCTIPCTGNTTFSYNSQACERTCLSLSDRATECHHSAVPVDGCNCPDGTYLNQKGECVRKAQCPCILEGYKFILAEQSTVINGITCHCINGRLSCPQRPQMFLASCQAPKTFKSCSQSSENKFGAACAPTCQMLATGVACVPTKCEPGCVCAEGLYENADGQCVPPEECPCEFSGVSYPGGAELHTDCRTCSCSRGRWACQQGTHCPSTCTLYGEGHVITFDGQRFVFDGNCEYILATDVCGVNDSQPTFKILTENVICGNSGVTCSRAIKIFLGGLSVVLADRNYTVTGEEPHVQLGVTPGALSLVVDISIPGRYNLTLIWNRHMTILIRIARASQDPLCGLCGNFNGNMKDDFETRSRYVASSELELVNSWKESPLCGDVSFVTDPCSLNAFRRSWAERKCSVINSQTFATCHSKVYHLPYYEACVRDACGCDSGGDCECLCDAVAAYAQACLDKGVCVDWRTPAFCPIYCGFYNTHTQDGHGEYQYTQEANCTWHYQPCLCPSQPQSVPGSNIEGCYNCSQDEYFDHEEGVCVPCMPPTTPQPPTTPQLPTTGSRPTQVWPMTGTSTTIGLLSSTGPSPSSNHTPASPTQTPLLPATLTSSKPTASSGEPPRPTTAVTPQATSGLPPTATLRSTATKPTVTQATTRATASTASPATTSTAQSTTRTTMTLPTPATSGTSPTLPKSTNQELPGTTATQTTGPRPTPASTTGPTTPQPGQPTRPTATETTQTRTTTEYTTPQTPHTTHSPPTAGSPVPSTGPVTATSFHATTTYPTPSHPETTLPTHVPPFSTSLVTPSTHTVITPTHAQMATSASNHSAPTGTIPPPTTLKATGSTHTAPPITPTTSGTSQAHSSFSTNKTPTSLHSHTSSTHHPEVTPTSTTTITPNPTSTRTRTPVAHTNSATSSRPPPPFTTHSPPTGSSPFSSTGPMTATSFKTTTTYPTPSHPQTTLPTHVPPFSTSLVTPSTHTVITPTHAQMATSASIHSMPTGTIPPPTTLKATGSTHTAPTMTLTTSGTSQALSSLNTAKTSTSLHSHTSSTHHAEATSTSTTNITPNPTSTGTPPMTVTTSGTSQSRSSFSTAKTSTSLHSHTSSTHHPEVTSTSTTSITPNHTSTGTRTPVAHTTSATSSRLPTPFTTHSPPTGTTPISSTGPVTATSFQTTTTYPTPSHPHTTLPTHVPSFSTSLVTPSTHTVIIPTHTQMATSASIHSMPTGTIPPPTTIKATGSTHTAPPMTPTTSGTSQSPSSFSTAKTSTSLPYHTSSTHHPEVTPTSTTNITPKHTSTGTRTPVAHTTSASSSRLPTPFTTHSPPTGSSPFSSTGPMTATSFQTTTTYPTPSHPQTTLPTHVPPFSTSLVTPSTHTVIITTHTQMATSASIHSTPTGTVPPPTTLKATGSTHTAPPMTVTTSGTSQTHSSFSTATASSSFISSSSWLPQNSSSRPPSSPITTQLPHLSSATTPVSTTNQLSSSFSPSPSAPSTVSSYVPSSHSSPQTSSPSVGTSSSFVSAPVHSTTLSSGSHSSLSTHPTTASVSASPLFPSSPAASTTIRATLPHTISSPFTLSALLPISTVTVSPTPSSHLASSTIAFPSTPRTTASTHTAPAFSSQSTTSRSTSLTTRVPTSGFVSLTSGVTGIPTSPVTNLTTRHPGPTLSPTTRFLTSSLTAHGSTPASAPVSSLGTPTPTSPGVCSVREQQEEITFKGCMANVTVTRCEGACISAASFNIITQQVDARCSCCRPLHSYEQQLELPCPDPSTPGRRLVLTLQVFSHCVCSSVACGD

SEQ ID NO: 9110 - protein, 115 aa, Homo Sapiens
  misc_feature (1)..(1): Xaa can be any naturally occurring amino acid
XPPTTPQPPTTPQLPTTGSRPTQVWPMTGTSTTIGLLSSTGPSPSSNHTPASPTQTPLLPATLTSSKPTASSGGKEPPAEPMERAAAGGPRYTSGVGLGMALLPGSHLPLSRFPA

SEQ ID NO: 9111 - protein, 219 aa, Homo Sapiens
  misc_feature (1)..(1): Xaa can be any naturally occurring amino acid
XSSPFTLSALLPISTVTVSPTPSSHLASSTIAFPSTPRTTASTHTAPAFSSQSTTSRSTSLTTRVPTSGFVSLTSGVTGIPTSPVTNLTTRHPGPTLSPTTRFLTSSLTAHGSTPASAPVSSLGTPTPTSPGESTGGRPAPRPPRCSQPHPREVRAPHPGACCPISFNIITQQVDARCSCCRPLHSYEQQLELPCPDPSTPGRRLVLTLQVFSHCVCSS

SEQ ID NO: 9112 - protein, 136 aa, Homo Sapiens
MKTLPLFVCICALSACFSFSEGRERDHELRHRRHHHQSPKSHFELPHYPGLLAHQKPFIRKSYKCLHKRCRPKLPPSPNNPPKFPNPHQPPKHPDKNSSVVNPTLVATTQIPSVTFPSASTKITTLPNVTFLPQNA

SEQ ID NO: 9113 - protein, 377 aa, Homo Sapiens
MKTLPLFVCICALSACFSFSEGRERDHELRHRRHHHQSPKSHFELPHYPGLLAHQKPFIRKSYKCLHKRCRPKLPPSPNNPPKFPNPHQPPKHPDKNSSVVNPTLVATTQIPSVTFPSASTKITTLPNVTFLPQNATTISSRENVNTSSSVATLAPVNSPAPQDTTAAPPTPSATTPAPPSSSAPPETTAAPPTPSATTQAPPSSSAPPETTAAPPTPPATTPAPPSSSAPPETTAAPPTPSATTPAPLSSSAPPETTAVPPTPSATTLDPSSASAPPETTAAPPTPSATTPAPPSSPAPQETTAAPITTPNSSPTTLAPDTSETSAAPTHQTTTSVTTQTTTTKQPTSAPGQNKISRFLLYMKNLLNRIIDDMVEQ

SEQ ID NO: 9114 - protein, 377 aa, Homo Sapiens; identical to SEQ ID NO: 9113

SEQ ID NO: 9115 - protein, 377 aa, Homo Sapiens; identical to SEQ ID NO: 9113

SEQ ID NO: 9116 - protein, 85 aa, Homo Sapiens
MGGDHGYQLAVTKAENPTTAAPADTYPATGPADDEAPDAETTAAATTATTAAPTTATTAASTTARKDIPVLPKWVGDLPNGRVCP

SEQ ID NO: 9117 - protein, 90 aa, Homo Sapiens
MKFLAVLVLLGVSIFLVSAQNPTTAAPADTYPATGPADDEAPDAETTAAATTATTAAPTTATTAASTTARKDIPVLPKWVGDLPNGRVCP

SEQ ID NO: 9118 - protein, 80 aa, Homo Sapiens
MKFLAVLVLLGVSIFLVSAQNPTTAAPADTYPATGPADDEAPDAETTPTTATTAASTTARKDIPVLPKWVGDLPNGRVCP

SEQ ID NO: 9119 - protein, 2828 aa, Homo Sapiens
MPKRAHWGALSVVLILLWGHPRVALACPHPCACYVPSEVHCTFRSLASVPAGIAKHVERINLGFNSIQALSETSFAGLTKLELLMIHGNEIPSIPDGALRDLSSLQVFKFSYNKLRVITGQTLQGLSNLMRLHIDHNKIEFIHPQAFNGLTSLRLLHLEGNLLHQLHPSTFSTFTFLDYFRLSTIRHLYLAENMVRTLPASMLRNMPLLENLYLQGNPWTCDCEMRWFLEWDAKSRGILKCKKDKAYEGGQLCAMCFSPKKLYKHEIHKLKDMTCLKPSIESPLRQNRSRSIEEEQEQEEDGGSQLILEKFQLPQWSISLNMTDEHGNMVNLVCDIKKPMDVYKIHLNQTDPPDIDINATVALDFECPMTRENYEKLWKLIAYYSEVPVKLHRELMLSKDPRVSYQYRQDADEEALYYTGVRAQILAEPEWVMQPSIDIQLNRRQSTAKKVLLSYYTQYSQTISTKDTRQARGRSWVMIEPSGAVQRDQTVLEGGPCQLSCNVKASESPSIFWVLPDGSILKAPMDDPDSKFSILSSGWLRIKSMEPSDSGLYQCIAQVRDEMDRMVYRVLVQSPSTQPAEKDTVTIGKNPGESVTLPCNALAIPEAHLSWILPNRRIINDLANTSHVYMLPNGTLSIPKVQVSDSGYYRCVAVNQQGADHFTVGITVTKKGSGLPSKRGRRPGAKALSRVREDIVEDEGGSGMGDEENTSRRLLHPKDQEVFLKTKDDAINGDKKAKKGRRKLKLWKHSEKEPETNVAEGRRVFESRRRINMANKQINPERWADILAKVRGKNLPKGTEVPPLIKTTSPPSLSLEVTPPFPAISPPSASPVQTVTSAEESSADVPLLGEEEHVLGTISSASMGLEHNHNGVILVEPEVTSTPLEEVVDDLSEKTEEITSTEGDLKGTAAPTLISEPYEPSPTLHTLDTVYEKPTHEETATEGWSAADVGSSPEPTSSEYEPPLDAVSLAESEPMQYFDPDLETKSQPDEDKMKEDTFAHLTPTPTIWVNDSSTSQLFEDSTIGEPGVPGQSHLQGLTDNIHLVKSSLSTQDTLLIKKGMKEMSQTLQGGNMLEGDPTHSRSSESEGQESKSITLPDSTLGIMSSMSPVKKPAETTVGTLLDKDTTTATTTPRQKVAPSSTMSTHPSRRRPNGRRRLRPNKFRHRHKQTPPTTFAPSETFSTQPTQAPDIKISSQVESSLVPTAWVDNTVNTPKQLEMEKNAEPTSKGTPRRKHGKRPNKHRYTPSTVSSRASGSKPSPSPENKHRNIVTPSSETILLPRTVSLKTEGPYDSLDYMTTTRKIYSSYPKVQETLPVTYKPTSDGKEIKDDVATNVDKHKSDILVTGESITNAIPTSRSLVSTMGEFKEESSPVGFPGTPTWNPSRTAQPGRLQTGIPVTTSGENLTDPPLLKELEDVDFTSEFLSSLTVSTPFHQEEAGSSTTLSSIKVEVASSQAETTTLDQDHLETTVAILLSETRPQNHTPTAARMKEPASSSPSTILMSLGQTTTTKPALPSPRISQASRDSKENVFLNYVGNPETEATPVNNEGTQHMSGPNELSTPSSDQDAFNLSTKLELEKQVFGSRSLPRGPDSQRQDGRVHASHQLTRVPAKPILPTATVRLPEMSTQSASRYFVTSQSPRHWTNKPEITTYPSGALPENKQFTTPRLSSTTIPLPLHMSKPSIPSKFTDRRTDQFNGYSKVFGNNNIPEARNPVGKPPSPRIPHYSNGRLPFFTNKTLSFPQLGVTRRPQIPTSPAPVMRERKVIPGSYNRIHSHSTFHLDFGPPAPPLLHTPQTTGSPSTNLQNIPMVSSTQSSISFITSSVQSSGSFHQSSSKFFAGGPPASKFWSLGEKPQILTKSPQTVSVTAETDTVFPCEATGKPKPFVTWTKVSTGALMTPNTRIQRFEVLKNGTLVIRKVQVQDRGQYMCTASNLHGLDRMVVLLSVTVQQPQILASHYQDVTVYLGDTIAMECLAKGTPAPQISWIFPDRRVWQTVSPVEGRITLHENRTLSIKEASFSDRGVYKCVASNAAGADSLAIRLHVAALPPVIHQEKLENISLPPGLSIHIHCTAKAAPLPSVRWVLGDGTQIRPSQFLHGNLFVFPNGTLYIRNLAPKDSGRYECVAANLVGSARRTVQLNVQRAAANARITGTSPRRTDVRYGGTLKLDCSASGDPWPRILWRLPSKRMIDALFSFDSRIKVFANGTLVVKSVTDKDAGDYLCVARNKVGDDYVVLKVDVVMKPAKIEHKEENDHKVFYGGDLKVDCVATGLPNPEISWSLPDGSLVNSFMQSDDSGGRTKRYVVFNNGTLYFNEVGMREEGDYTCFAENQVGKDEMRVRVKVVTAPATIRNKTYLAVQVPYGDVVTVACEAKGEPMPKVTWLSPTNKVIPTSSEKYQIYQDGTLLIQKAQRSDSGNYTCLVRNSAGEDRKTVWIHVNVQPPKINGNPNPITTVREIAAGGSRKLIDCKAEGIPTPRVLWAFPEGVVLPAPYYGNRITVHGNGSLDIRSLRKSDSVQLVCMARNEGGEARLILQLTVLEPMEKPIFHDPISEKITAMAGHTISLNCSAAGTPTPSLVWVLPNGTDLQSGQQLQRFYHKADGMLHISGLSSVDAGAYRCVARNAAGHTERLVSLKVGLKPEANKQYHNLVSIINGETLKLPCTPPGAGQGRFSWTLPNGMHLEGPQTLGRVSLLDNGTLTVREASVFDRGTYVCRMETEYGPSVTSIPVIVIAYPPRITSEPTPVIYTRPGNTVKLNCMAMGIPKADITWELPDKSHLKAGVQARLYGNRFLHPQGSLTIQHATQRDAGFYKCMAKNILGSDSKTTYIHVF

SEQ ID NO: 9120 - protein, 213 aa, Homo Sapiens
MDTERVGDGKQHRRKQSQRLRWPCCLALVPDRHPSQLSSCTLCLLAAASQWESWAHFSKWHTEASTGTHLGKAKAEGLGCTVKNTPQLSICEPSHFGPSFVHSPHLLVDHDHRAGAATGRGQAGPSRASSVSPTFCPPTTSHHPVCAKGTDPVLVLQEEEQDLDGEKGPSSEGPEEEDGEGFSFKYSPGKLRGNQYKKMMTKEELEEEQRTEE

SEQ ID NO: 9121 - protein, 177 aa, Homo Sapiens
MEAPAELLAALPALATALALLLAWLLVRRGAAASPEPARAPPEPAPPAEATGAPAPSRPCAPEPAASPAGPEEPGEPAGLGELGEPAGPGEPEGPGDPAAAPAEAEEQAVEARQEEEQDLDGEKGPSSEGPEEEDGEGFSFKYSPGKLRGNQYKKMMTKEELEEEQRIELTSDLTSL

SEQ ID NO: 9122 - protein, 170 aa, Homo Sapiens
MEAPAELLAALPALATALALLLAWLLVRRGAAASPEPARAPPEPAPPAEATGAPAPSRPCAPEPAASPAGPEEPGEPAGLGELGEPAGPGEPEGPGDPAAAPAEAEEQAVEARQEEEQDLDGEKGPSSEGPEEEDGEGFSFKYSPGKLRGNQYKKMMTKEELEEEQRTEE

SEQ ID NO: 9123 - protein, 204 aa, Homo Sapiens
MEAPAELLAALPALATALALLLAWLLVRRGAAASPEPARAPPEPAPPAEATGAPAPSRPCAPEPAASPAGPEEPGEPAGLGELGEPAGPGEPEGPGDPAAAPAEAEEQAVEARQEEEQDLDGEKGPSSEGPEEEDGEGFSFKYSPGKLRGNQYKKMMTKEELEEEQRVQKEQLAAIFKLMKDNKETFGEMSDGDVQEQLRLYDM

SEQ ID NO: 9124 - protein, 22 aa, Homo Sapiens
MMTKEELEEEQRIELTSDLTSL

SEQ ID NO: 9125 - protein, 15 aa, Homo Sapiens
MMTKEELEEEQRTEE

SEQ ID NO: 9126 - protein, 15 aa, Homo Sapiens
MMTKEELEEEQRTEE

SEQ ID NO: 9127 - protein, 189 aa, Homo Sapiens
MAAPSGGWNGVGASLWAALLLGAVALRPAEAVSEPTTVAFDVRPGGVVHSFSHNVGPGDKYTCMFTYASQGGTNEQWQMSLGTSEDHQHFTCTIWRPQGKSYLYFTQFKAEVRGAEIEYAMAYSKAAFERESDVPLKTEEFEVTKTAGTERWGWGRGDATPIQGWAIGAVWRGGSAIGVLETVDQASTN

SEQ ID NO: 9128 - protein, 173 aa, Homo Sapiens
MAAPSGGWNGVGASLWAALLLGAVALRPAEAVSEPTTVAFDVRPGGVVHSFSHNVGPGDKYTCMFTYASQGGTNEQWQMSLGTSEDHQHFTCTIWRPQGKSYLYFTQFKAEVRGAEIEYAMAYSKAAFERESDVPLKTEEFEVTKTAVAHRPGAFKAELSKLVIVAKASRTEL

SEQ ID NO: 9129 - protein, 84 aa, Homo Sapiens
  misc_feature (1)..(1): Xaa can be any naturally occurring amino acid
XHQHFTCTIWRPQGKSYLYFTQFKAEVRGAEIEYAMAYSKAAFERESDVPLKTEEFEVTKTAVISAPQEKGDDQPHWTDGETEA

SEQ ID NO: 9130 - protein, 194 aa, Homo Sapiens
MAPKKDVKKPVAAAAAAPAPAPAPAPAPAPAKPKEEKIDLSAIKIEFSKEQQDEFKEAFLLFDRTGDSKITLSQVGDVLRALGTNPTNAEVRKVLGNPSNEELNAKKIEFEQFLPMMQAISNNKDQATYEDFVEGLRVFDKEGNGTVMGAELRHVLATLGEKMKEEEVEALMAGQEDSNGCINYEAFVKHIMSI

SEQ ID NO: 9131 - protein, 150 aa, Homo Sapiens
MSFSADQIAEFKEAFLLFDRTGDSKITLSQVGDVLRALGTNPTNAEVRKVLGNPSNEELNAKKIEFEQFLPMMQAISNNKDQATYEDFVEGLRVFDKEGNGTVMGAELRHVLATLGEKMKEEEVEALMAGQEDSNGCINYEAFVKHIMSI

SEQ ID NO: 9132 - protein, 63 aa, Homo Sapiens
MRFFCARCCSFGPEMPAVQLLLLACLVWDVGARTAQLRKANDQRSFYVEFGHFGLPGTEVRAN

SEQ ID NO: 9133 - protein, 504 aa, Homo Sapiens
MRFFCARCCSFGPEMPAVQLLLLACLVWDVGARTAQLRKANDQSGRCQYTFSVASPNESSCPEQSQAMSVIHNLQRDSSTQRLDLEATKARLSSLESLLHQLTLDQAARPQETQEGLQRELGTLRRERDQLETQTRELETAYSNLLRDKSVLEEEKKRLRQENENLARRLESSSQEVARLRRGQCPQTRDTARAVPPGSREVSTWNLDTLAFQELKSELTEVPASRILKESPSGYLRSGEGDTGCGELVWVGEPLTLRTAETITGKYGVWMRDPKPTYPYTQETTWRIDTVGTDVRQVFEYDLISQFMQGYPSKVHILPRPLESTGAVVYSGSLYFQGAESRTVIRYELNTETVKAEKEIPGAGYHGQFPYSWGGYTDIDLAVDEAGLWVIYSTDEAKGAIVLSKLNPENLELEQTWETNIRKQSVANAFIICGTLYTVSSYTSADATVNFAYDTGTGISKTLTIPFKNRYKYSSMIDYNPLEKKLFAWDNLNMVTYDIKLSKM

SEQ ID NO: 9134 - protein, 250 aa, Homo Sapiens
MAFCALTIVALYILSLKDQDRRVPNLPPSNITSSQEPALLPTASSSAPNTSLVTTPASLQVPEITFCEILPCQETYCCPIRGMKEVSSSPVQRQSEEKEFHQRRWSEDKSKSVLARNALSGPDWESDWIDTTISSIQIMEIQQIIDHQYCIQSLQCGTTEPLIVFQCKFTLGNICFHSKRGTKGLESHREISQEMTQGYQHIWSLPVAPFSDSMFHFRVAAPDLADCSTDPYFAGIFFTDYFFYFYRRCA

SEQ ID NO: 9135 - protein, 898 aa, Homo Sapiens
MDVVGENEALQQFFEAQGANGTLENPALDTSLLEEFLGNDFDLGALQRQLPDTPPYSASDSCSPPQVKGACYPTLRPTAGRTPAPFLHPTAAPAMPPMHPLQSTSGMGDSCQIHGGFHSCHSNASHLATPLDQSVSSHLGIGCSYPQQPLCHSPGASLPPTKKRKCTQALEDSGECRVWACHCRPMTSRSRSSEVQDPDSEGQNRMPTDQCSPALKWQPCHSVPWHSLLNSHYEKLPDVGYRVVTDKGFNFSPADEAFVCQKKNHFQITIHIQVWGSPKFVETEMGLKPIEMFYLKVFGTKVEATNQIIAIEQSQADRSKKIFNPVKIDLLADQVTKVTLGRLHFSETTANNMRKKGKPNPDQRYFMLVVGLYAANQDQFYLLSAHISERIIVRASNPGQFENDSDALWQRGQVPESIVCHGRVGINTDAPDEALVVCGNMKVMGTIMHPSDSRAKQNIQEVDTNEQLKRIAQMRIVEYDYKPEFASAMGINTAHQTGMIAQEVQEILPRAVREVGDVTCGNGETLENFLMVDKDQIFMENVGAVKQLCKLTNNLEERIEELEIWNRKLARLKRLSSWKSSASEASTISKSSRAVSASSPRRAVHKKNNKVYFSGKRQACPNWVFQTLVITLIAVMAFCLKDQDRRVPNLPPSNITSSQEPALLPTASSSAPNTSLVTTPASLQVPEITFCEILPCQETYCCPIRGMKEVSSSPVQRQSEEKEFHQRRWSDKSKSVLARNALSGPDWESDWIDTTISSIQIMEIQQIIDHQYCIQSLQCGSGNYNYNIPVNKHTPTNVKFSLEINTTEPLIVFQCKFTLGNICFHSKRGTKGLESHREISQEMTQGYQHIWSLPVAPFSDSMFHFRVAAPDLADCSTDPYFAGIFFTDYFFYFYRRCA

SEQ ID NO: 9136 - protein, 910 aa, Homo Sapiens
MDVVGENEALQQFFEAQGANGTLENPALDTSLLEEFLGNDFDLGALQRQLPDTPPYSASDSCSPPQVKGACYPTLRPTAGRTPAPFLHPTAAPAMPPMHPLQSTSGMGDSCQIHGGFHSCHSNASHLATPLDQSVSSHLGIGCSYPQQPLCHSPGASLPPTKKRKCTQALEDSGECRVWACHCRPMTSRSRSSEVQDPDSEGQNRMPTDQCSPALKWQPCHSVPWHSLLNSHYEKLPDVGYRVVTDKGFNFSPADEAFVCQKKNHFQITIHIQVWGSPKFVETEMGLKPIEMFYLKVFGTKVEATNQIIAIEQSQADRSKKIFNPVKIDLLADQVTKVTLGRLHFSETTANNMRKKGKPNPDQRYFMLVVGLYAANQDQFYLLSAHISERIIVRASNPGQFENDSDALWQRGQVPESIVCHGRVGINTDAPDEALVVCGNMKVMGTIMHPSDSRAKQNIQEVDTNEQLKRIAQMRIVEYDYKPEFASAMGINTAHQTGMIAQEVQEILPRAVREVGDVTCGNGETLENFLMVDKDQIFMENVGAVKQLCKLTNNLEERIEELEIWNRKLARLKRLSSWKSSASEASTISKSSRAVSASSPRRAVHKKNNKVYFSGKRQACPNWVFQTLVITLIAVMAFCALTIVALYILSLKDQDRRVPNLPPSNITSSQEPALLPTASSSAPNTSLVTTPASLQVPEITFCEILPCQETYCCPIRGMKEVSSSPVQRQSEEKEFHQRRWSEDKSKSVLARNALSGPDWESDWIDTTISSIQIMEIQQIIDHQYCIQSLQCGSGNYNYNIPVNKHTPTNVKFSLEINTTEPLIVFQCKFTLGNICFHSKRGTKGLESHREISQEMTQGYQHIWSLPVAPFSDSMFHFRVAAPDLADCSTDPYFAGIFFTDYFFYFYRRCA

SEQ ID NO: 9137 - protein, 250 aa, Homo Sapiens
MVFLALTIVALYILSLKDQDRRVPNLPPSNITSSQEPALLPTASSSAPNTSLVTTPASLQVPEITFCEILPCQETYCCPIRGMKEVSSSPVQRQSEEKEFHQRRWSEDKSKSVLARNALSGPDWESDWIDTTISSIQIMEIQQIIDHQYCIQSLQCGTTEPLIVFQCKFTLGNICFHSKRGTKGLESHREISQEMTQGYQHIWSLPVAPFSDSMFHFRVAAPDLADCSTDPYFAGIFFTDYFFYFYRRCA

SEQ ID NO: 9138 - protein, 375 aa, Homo Sapiens
  misc_feature (1)..(1): Xaa can be any naturally occurring amino acid
XIFMENVGAVKQLCKLTNNLEERIEELEIWNRKLARLKRLSSWKSSASEASTISKSSRAVSASSPRRAVHKKNNKVYFSGKRQACPNWVFQTLVITLIAVMAFCALTIVALYILSLKDQDRRVPNLPPSNITSSQEPALLPTASSSAPNTSLVTTPASLQVPEITFCEILPCQETYCCPIRGMKEVSSSPVQRQSEEKEFHQRRWSEDKSKSVLARNALSGPDWESDWIDTTISSIQIMEIQQIIDHQYCIQSLQCGSGNYNYNIPVNKHTPTNVKFSLEINTTEPLIVFQCKFTLGNICFHSKRGTKGLESHREISQEMTQGYQHIWSLPVAPFSDSMFHFRVAAPDLADCSTDPYFAGIFFTDYFFYFYRRCA

SEQ ID NO: 9139 - protein, 76 aa, Homo Sapiens
MRLSLPLLLLLLGAWAIPGGLGDRAPLTATAPQLDDEEMYSAHMPAHLRCDACRAVAYQLRSSRSGPSETSHRPRT

SEQ ID NO: 9140 - protein, 189 aa, Homo Sapiens
MRLSLPLLLLLLGAWAIPGGLGDRAPLTATAPQLDDEEMYSAHMPAHLRCDACRAVAYQMWQNLAKAETKLHTSNSGGRRELSELVYTDVLDRSCSRNWQDYGVREVDQVKRLTGPGLSEGPEPSISVMVTGGPWPTRLSRTCLHYLGEFGEDQIYEAHQQGRGALEALLCGGPQGACSEKVSATREEL

SEQ ID NO: 9141 - protein, 75 aa, Homo Sapiens
MRLSLPLLLLLLGAWAIPGGLGDRAPLTATAPQLDDEEMYSAHMPAHLRCDACRAVAYQRLCSYPPHLPLTEQQS

SEQ ID NO: 9142 - protein, 123 aa, Homo Sapiens
MRLSLPLLLLLLGAWAIPGGLGDRAPLTATAPQLDDEEMYSAHMPAHLRCDACRAVAYQSLLVPDVAKSGKGRDQTSYLKLWGAAGAERVGLHGCPGPELLPELAGLRSSRSGPSETSHRPRT

SEQ ID NO: 9143 - protein, 60 aa, Homo Sapiens
  misc_feature (1)..(1): Xaa can be any naturally occurring amino acid
XSLPLLLLLLGAWAIPGGLGDRAPLTATAPQLDDEEMYSAHMPAHLRCDACRAVAYQAHP

SEQ ID NO: 9144 - protein, 737 aa, Homo Sapiens
MALCSALMTIFTIKMGTAKQAIDQGRSPVIIDNTNIQAWEMKPYVEVAIGKGYRVEFHEPETWWKFDPEELEKRNKHGVSRKKIAQMLDRYEYQMSISIVMNSVEPSHKSTQRPPPPQGRQRERVLKKTGHRLSKTKQKRNRKRNKKQNSQNRIMEENSLEFLSDLTPGDQDPSQSEEEDIEKTRRESEYPFIDGLQNEVGDFVTGYKEKRWKNKDPKDSFQNVMSIVELDNTPKNYLSKEGDNLFVSLLLRPNEISVTCPILTQNLSCVTTDDCSGMKVEKHIRNRHTIALDTQDLSAETSCLFMKKREIVDKNLSHEPILCHQHGIRMSDKVLREEQVYTTKINHWAFFTTNLSDEDLQLGSDRQPYFGSWPAGPHKFICEQRPKKDRACKLAGPDSRGQWIQMIFTSVAASEPGNNPEILTDKLLIGNEDFSPPPETMDSFIETNLFRSCLPQPDIPKNALESTKNKKRRKKRIFNLVPNFDLLGQSRIGVKEREKCDLLTKNHGLKITLGEEKDRISERNSEEENKQKLMTFDHHPLWFYLDIIKATPLNIDGQRYSHCLSFNRLRCSASLYKNYIPSFVLHNLSSIWKPSFTNKKLFLTFESQTRVGNKLNDAGFISPEILHSHPDTSCSLGVTSDFHFLNERFDRKLKRWEEPKELPAEDSQDLTSTDYRSLELPLSQGFAFQLVKLFGSPGVPMESLLPDDYVVPLDWKTLKMIYLQWKMSVEKRQKKIG

SEQ ID NO: 9145 - protein, 737 aa, Homo Sapiens; identical to SEQ ID NO: 9144

SEQ ID NO: 9146 - protein, 752 aa, Homo Sapiens
MSYGEIEEFCLVRIVMALCSALMTIFTIKMGTAKQAIDQGRSPVIIDNTNIQAWEMKPYVEVAIGKGYRVEFHEPETWWKFDPEELEKRNKHGVSRKKIAQMLDRYEYQMSISIVMNSVEPSHKSTQRPPPPQGRQRERVLKKTGHRLSKTKQKRNRKRNKKQNSQNRIMEENSLEFLSDLTPGDQDPSQSEEEDIEKTRRESEYPFIDGLQNEVGDFVTGYKEKRWKNKDPKDSFQNVMSIVELDNTPKNYLSKEGDNLFVSLLLRPNEISVTCPILTQNLSCVTTDDCSGMKVEKHIRNRHTIALDTQDLSAETSCLFMKKREIVDKNLSHEPILCHQHGIRMSDKVLREEQVYTTKINHWAFFTTNLSDEDLQLGSDRQPYFGSWPAGPHKFICEQRPKKDRACKLAGPDSRGQWIQMIFTSVAASEPGNNPEILTDKLLIGNEDFSPPPETMDSFIETNLFRSCLPQPDIPKNALESTKNKKRRKKRIFNLVPNFDLLGQSRIGVKEREKCDLLTKNHGLKITLGEEKDRISERNSEEENKQKLMTFDHHPLWFYLDIIKATPLNIDGQRYSHCLSFNRLRCSASLYKNYIPSFVLHNLSSIWKPSFTNKKLFLTFESQTRVGNKLNDAGFISPEILHSHPDTSCSLGVTSDFHFLNERFDRKLKRWEEPKELPAEDSQDLTSTDYRSLELPLSQGFAFQLVKLFGSPGVPMESLLPDDYVVPLDWKTLKMIYLQWKMSVEKRQKKIG

SEQ ID NO: 9147 - protein, 583 aa, Homo Sapiens
MSYGEIEGKFLGPREEVTSEPRCKKLKSTTESYVFHNHSNADFHRIQEKTGNDWVPVTIIDVRGHSYLQENKIKTTDLHRPLHDEMPGNRPDVIESIDSQVLQEARPPLVSADDEIYSTSKAFIGPIYKPPEKKKRNEGRNEAHVLNGINDRGGQKEKQKFNSEKSEIDNELFQFYKEIEELEKEKDGFENSCKESEPSQEQFVPFYEGHNNGLLKPDEEKKDLSNKAMPSHCDYQQNLGNEPDKYPCNGQVIPTFCDTSFTSFRPEWQSVYPFIVPYGPPLPSLNYHLNIQRFSGPPNPPSNIFQAQDDSQIQNGYYVNNCHVNWNCMTFDQNNEYTDCSENRSSVHPSGNGCSMQDRYVSNGFCEVRERCWKDHCMDKHNGTDRFVNQQFQEEKLNKLQKLLILLRGLPGSGKTTLSRILLGQNRDGIVFSTDDYFHHQDGYRYNVNQLGDAHDWNQNRAKQAIDQGRSPVIIDNTNIQAWEMKPYVEVAIGKGYRVEFHEPETWWKFDPEELEKRNKHGVSRKKIAQMLDRYEYQMSISIVMNSVEPSHKSTQRPPPPQGRQRWGGSLGSHNRVCVTNNH

SEQ ID NO: 9148 - protein, 655 aa, Homo Sapiens
MSYGEIEGKFLGPREEVTSEPRCKKLKSTTESYVFHNHSNADFHRIQEKTGNDWVPVTIIDVRGHSYLQENKIKTTDLHRPLHDEMPGNRPDVIESIDSQVLQEARPPLVSADDEIYSTSKAFIGPIYKPPEKKKRNEGRNEAHVLNGINDRGGQKEKQKFNSEKSEIDNELFQFYKEIEELEKEKDGFENSCKESEPSQEQFVPFYEGHNNGLLKPDEEKKDLSNKAMPSHCDYQQNLGNEPDKYPCNGQVIPTFCDTSFTSFRPEWQSVYPFIVPYGPPLPSLNYHLNIQRFSGPPNPPSNIFQAQDDSQIQNGYYVNNCHVNWNCMTFDQNNEYTDCSENRSSVHPSGNGCSMQDRYVSNGFCEVRERCWKDHCMDKHNGTDRFVNQQFQEEKLNKLQKLLILLRGLPGSGKTTLSRILLGQNRDGIVFSTDDYFHHQDGYRYNVNQLGDAHDWNQNRAKQAIDQGRSPVIIDNTNIQAWEMKPYVEVAIGKGYRVEFHEPETWWKFDPEELEKRNKHGVSRKKIAQMLDRYEYQMSISIVMNSVEPSHKSTQRPPPPQGRQRFDRKLKRWEEPKELPAEDSQDLTSTDYRSLELPLSQGFAFQLVKLFGSPGVPMESLLPDDYVVPLDWKTLKMIYLQWKMSVEKRQKKIG

SEQ ID NO: 9149 - protein, 709 aa, Homo Sapiens
MSYGEIEGKFLGPREEVTSEPRCKKLKSTTESYVFHNHSNADFHRIQEKTGNDWVPVTIIDVRGHSYLQENKIKTTDLHRPLHDEMPGNRPDVIESIDSQVLQEARPPLVSADDEIYSTSKAFIGPIYKPPEKKKRNEGRNEAHVLNGINDRGGQKEKQKFNSEKSEIDNELFQFYKEIEELEKEKDGFENSCKESEPSQEQFVPFYEGHNNGLLKPDEEKKDLSNKAMPSHCDYQQNLGNEPDKYPCNGQVIPTFCDTSFTSFRPEWQSVYPFIVPYGPPLPSLNYHLNIQRFSGPPNPPSNIFQAQDDSQIQNGYYVNNCHVNWNCMTFDQNNEYTDCSENRSSVHPSGNGCSMQDRYVSNGFCEVRERCWKDHCMDKHNGTDRFVNQQFQEEKLNKLQKLLILLRGLPGSGKTTLSRILLGQNRDGIVFSTDDYFHHQDGYRYNVNQLGDAHDWNQNRAKQAIDQGRSPVIIDNTNIQAWEMKPYVEVAIGKGYRVEFHEPETWWKFDPEELEKRNKHGVSRKKIAQMLDRYEYQMSISIVMNSVEPSHKSTQRPPPPQGRQRERVLKKTGHRLSKTKQKRNRKRNKKQNSQNRIMEENSLEFLSDLTPGDQDPSQSEEEDIEKTRRESEYPFIDGLQNEVGDFVTGYKEKRWKNKDPKDSFQNVMSIVELDNTPKNYLSKEGDNLFVSLLLRPNEISVTCPILTQ

SEQ ID NO: 9150 - protein, 125 aa, Homo Sapiens
MAGAGPTMLLREENGCCSRRQSSSSAGDSDGEREDSAAERARQQLEALLNKTMRIRMTDGRTLVGCFLCTDRDCNVILGSAQEFLKPSDSFSAGEPRVLGLAMVPGHHIVSIEVQRESLTGPPYL

SEQ ID NO: 9151 - protein, 135 aa, Homo Sapiens
MAGAGPTMLLREENGCCSRRQSSSSAGDSDGEREDSAAERARQQLEALLNKTMRIRMTDGRTLVGCFLCTDRDCNVILGSAQEFLKPSGQCPGNAHPPDSFSAGEPRVLGLAMVPGHHIVSIEVQRESLTGPPYL

SEQ ID NO: 9152 - protein, 173 aa, Homo Sapiens
MAVAVGVRAAPVLGLARALVLGLRGSQAARWRGWGTAAPGSLWALCECPAGCRELWFRGRAAWAARSERLLHPAQDSDGEREDSAAERARQQLEALLNKTMRIRMTDGRTLVGCFLCTDRDCNVILGSAQEFLKPSDSFSAGEPRVLGLAMVPGHHIVSIEVQRESLTGPPYL

SEQ ID NO: 9153 - protein, 99 aa, Homo Sapiens
MDSDGEREDSAAERARQQLEALLNKTMRIRMTDGRTLVGCFLCTDRDCNVILGSAQEFLKPSDSFSAGEPRVLGLAMVPGHHIVSIEVQRESLTGPPYL

SEQ ID NO: 9154 - protein, 73 aa, Homo Sapiens
MRIRMTDGRTLVGCFLCTDRDCNVILGSAQEFLKPSDSFSAGEPRVLGLAMVPGHHIVSIEVQRESLTGPPYL

SEQ ID NO: 9155 - protein, 83 aa, Homo Sapiens
MRIRMTDGRTLVGCFLCTDRDCNVILGSAQEFLKPSGQCPGNAHPPDSFSAGEPRVLGLAMVPGHHIVSIEVQRESLTGPPYL

SEQ ID NO: 9156 - protein, 252 aa, Homo Sapiens
MCDFMNLSLADCLLVNLAYESSVFCTSIVAQDSRGHIYHGRNLDYPFGNVLRKLTVDVQFLKNGQIAFTGTTFIGYVGLWTGQSPHKFTVSGDERDKGWWWENAIAALFRRHIPVSWLIRATLSESENFEAAVGKLAKTPLIADVYYIVGGTSPREGVVITRNRDGPADIWPLDPLNGAWFRVETNYDHWKPAPKEDDRRTSAIKALNATGQANLSLEALFQVTCVTVSCIPRMFGVLLIVNMKNSVKSSGR

SEQ ID NO: 9157 - protein, 359 aa, Homo Sapiens
MRTADREARPGLPSLLLLLLAGAGLSAASPPAAPRFNVSLDSVPELRWLPVLRHYDLDLVRAAMAQVIGDRVPKWVHVLIGKVVLELERFLPQPFTGEIRGMCDFMNLSLADCLLVNLAYESSVFCTSIVAQDSRGHIYHGRNLDYPFGNVLRKLTVDVQFLKNGQIAFTGTTFIGYVGLWTGQSPHKFTVSGDERDKGWWWENAIAALFRRHIPVSWLIRATLSESENFEAAVGKLAKTPLIADVYYIVGGTSPREGVVITRNRDGPADIWPLDPLNGAWFRVETNYDHWKPAPKEDDRRTSAIKALNATGQANLSLEALFQILSVVPVYNNFTIYTTVMSAGSPDKYMTRIRNPSRK

SEQ ID NO: 9158 - protein, 323 aa, Homo Sapiens
MRTADREARPGLPSLLLLLLAGAGLSAASPPAAPRFNVSLDSVPELRWLPVLRHYDLDLVRAAMAQVIGDRVPKWVHVLIGKVVLELERFLPQPFTGEIRGMCDFMNLSLADCLLVNLAYESSVFCTSIVAQDSRGHIYHGRNLDYPFGNVLRKLTVDVQFLKNGQIAFTGTTFIGYVGLWTGQSPHKFTVSGDERDKGWWWENAIAALFRRHIPVSWLIRATLSESENFEAAVGKLAKTPLIADVYYIVGGTSPREGVVITRNRDGPADIWPLDPLNGAWFRVETNYDHWKPAPKEDDRRTSAIKALNATGQANLSLEALFQ

SEQ ID NO: 9159 - protein, 167 aa, Homo Sapiens
MRTADREARPGLPSLLLLLLAGAGLSAASPPAAPRFNVSLDSVPELRWLPVLRHYDLDLVRAAMAQVIGDRVPKWVHVLIGKVVLELERFLPQPFTGEIRGMCDFMNLSLADCLLVNLAYESSVFCTSIVAQDSRGHIYHGRNLDYPFGNVLRKLTVDVQFLKNGQV

SEQ ID NO: 9160 - protein, 139 aa, Homo Sapiens
  misc_feature (1)..(1): Xaa can be any naturally occurring amino acid
XDKGWWWENAIAALFRRHIPVSWLIRATLSESENFEAAVGKLAKTPLIADVYYIVGGTSPREGVVITRNRDGPADIWPLDPLNGAWFRVETNYDHWKPAPKEDDRRTSAIKALNATGQANLSLEALFQLHNLYYGNERR

SEQ ID NO: 9161 - protein, 222 aa, Homo Sapiens
  misc_feature (1)..(1): Xaa can be any naturally occurring amino acid
XTSIVAQDSRGHIYHGRNLDYPFGNVLRKLTVDVQFLKNGQIAFTGTTFIGYVGLWTGQSPHKFTVSGDERDKGWWWENAIAALFRRHIPVSWLIRATLSESENFEAAVGKLAKTPLIADVYYIVGGTSPREGVVITRNRDGPADIWPLDPLNGAWFRVETNYDHWKPAPKEDDRRTSAIKALNATGQANLSLEALFQILSVVPVYNKLFPLAEFPEVGLLS

SEQ ID NO: 9162 - protein, 411 aa, Homo Sapiens
MLLKTVLLLGHVAQVLMLDNGLLQTPPMGWLAWERFRCNINCDEDPKNCISEQLFMEMADRMAQDGWRDMGYTYLNIDDCWIGGRDASGRLMPDPKRFPHGIPFLADYVHSLGLKLGIYADMGNFTCMGYPGTTLDKVVQDAQTFAEWKVDMLKLDGCFSTPEERAQGYPKMAAALNATGRPIAFSCSWPAYEGGLPPRVNYSLLADICNLWRNYDDIQDSWWSVLSILNWFVEHQDILQPVAGPGHWNDPDMLLIGNFGLSLEQSRAQMALWTVLAAPLLMSTDLRTISAQNMDILQNPLMIKINQDPLGIQGRRIHKEKSLIEVYMRPLSNKASALVFFSCRTDMPYRYHSSLGQLNFTGSVIYEAQDVYSGDIISGLRDETNFTVIINPSGVVMWYLYPIKNLEMSQQ

SEQ ID NO: 9163 - protein, 411 aa, Homo Sapiens; identical to SEQ ID NO: 9162

SEQ ID NO: 9164 - protein, 411 aa, Homo Sapiens; identical to SEQ ID NO: 9162

SEQ ID NO: 9165 - protein, 743 aa, Homo Sapiens
MEAVAVAAAVGVLLLAGAGGAAGDEAREAAAVRALVARLLGPGPAADFSVSVERALAAKPGLDTYSLGGGGAARVRVRGSTGVAAAAGLHRYLRDFCGCHVAWSGSQLRLPRPLPAVPGELTEATPNRYRYYQNVCTQSYSFVWWDWARWEREIDWMALNGINLALAWSGQEAIWQRVYLALGLTQAEINEFFTGPAFLAWGRMGNLHTWDGPLPPSWHIKQLYLQHRVLDQMRSFGMTPVLPAFAGHVPEAVTRVFPQVNVTKMGSWGHFNCSYSCSFLLAPEDPIFPIIGSLFLRELIKEFGTDHIYGADTFNEMQPPSSEPSYLAAATTAVYEAMTAVDTEAVWLLQGWLFQHQPQFWGPAQIRAVLGAVPRGRLLVLDLFAESQPVYTRTASFQGQPFIWCMLHNFGGNHGLFGALEAVNGGPEAARLFPNSTMVGTGMAPEGISQNEVVYSLMAELGWRKDPVPDLAAWVTSFAARRYGVSHPDAGAAWRLLLRSVYNCSGEACRGHNRSPLVRRPSLQMNTSIWYNRSDVFEAWRLLLTSAPSLATSPAFRYDLLDLTRQAVQELVSLYYEEARSAYLSKELASLLRAGGVLAYELLPALDEVLASDSRFLLGSWLEQARAAAVSEAEADFYEQNSRYQLTLWGPEGNILDYANKQLAGLVANYYTPRWRLFLEALVDSVAQGIPFQQHQFDKNVFQLEQAFVLSKQRYPSQPRGDTVDLAKKIFLKYYPRWVAGSW

SEQ ID NO: 9166 - protein, 81 aa, Homo Sapiens
MGDLFQGRGPSRVGCAPAHDTARRYRYYQNVCTQSYSFVWWDWARWEREIDWMALNGINLALAWSGQEAIWQRVYLALGLT

SEQ ID NO: 9167 - protein, 122 aa, Homo Sapiens
RGAAPLPARLLWLPRGLVRLSAAPAAATASRAGGADRGHAQQVYLALGLTQAEINEFFTGPAFLAWGRMGNLHTWDGPLPPSWHIKQLYLQHRVLDQMRSFGMTPVLPAFAGHVPEAVTSGY

SEQ ID NO: 9168 - protein, 65 aa, Homo Sapiens
  misc_feature (1)..(1): Xaa can be any naturally occurring amino acid
XFGTDHIYGADTFNEMQPPSSEPSYLAAATTAVYEAMTAVLGARPDQGCAGSCAPWPPPGSGPVC

SEQ ID NO: 9169 - protein, 170 aa, Homo Sapiens
  misc_feature (1)..(1): Xaa can be any naturally occurring amino acid
XGRRGAAPLPARLLWLPRGLVRLSAAPAAATASRAGGADRGHAQQVYLALGLTQAEINEFFTGPAFLAWGRMGNLHTWDGPLPPSWHIKQLYLQHRVLDQMRSFGMTPVLPAFAGHVPEAVTRVFPQVNVTKMGSWGHFNCSYSCSFLLAPEDPIFPIIGSLFLRELIKE

SEQ ID NO: 9170 - protein, 534 aa, Homo Sapiens
MATALMAVVLRAAAVAPRLRGRGGTGGARRLSCGARRRAARGTSPGRRLSTAWSQPQPPPEEYAGADDVSQSPVAEEPSWVPSPRPPVPHESPEPPSGRSLVQRDIQAFLNQCGASPGEARHWLTQFQTCHHSADKPFAVIEVDEEVLKCQQGVSSLAFALAFLQRMDMKPLVVLGLPAPTAPSGCLSFWEAKAQLAKSCKVLVDALRHNAAAAVPFFGGGSVLRAAEPAPHASYGGIVSVETDLLQWCLESGSIPILCPIGETAARRSVLLDSLEVTASLAKALRPTKIIFLNNTGGLRDSSHKVLSNVNLPADLDLVCNAEWVSTKERQQMRLIVDVLSRLPHHSSAVITAASTLLTELFSNKGSGTLFKNAERMLRVRSLDKLDQGRLVDLVNASFGKKLRDDYLASLRPRLHSIYVSEGYNAAAILTMEPVLGGTPYLDKFVVSSSRQGQGSGQMLWECLRRDLQTLFWRSRVTNPINPWYFKHSDGSFSNKQWIFFWFGLADIRDSYELVNHAKGLPDSFHKPASDPGS

SEQ ID NO: 9171 - protein, 511 aa, Homo Sapiens
SCGARRRAARGTSPGRRLSTAWSQPQPPPEEYAGADDVSQSPVAEEPSWVPSPRPPVPHESPEPPSGRSLVQRDIQAFLNQCGASPGEARHWLTQFQTCHHSADKPFAVIEVDEEVLKCQQGVSSLAFALAFLQRMDMKPLVVLGLPAPTAPSGCLSFWEAKAQLAKSCKVLVDALRHNAAAAVPFFGGGSVLRAAEPAPHASYGGIVSVETDLLQWCLESGSIPILCPIGETAARRSVLLDSLEVTASLAKALRPTKIIFLNNTGGLRDSSHKVLSNVNLPADLDLVCNAEWVSTKERQQMRLIVDVLSRLPHHSSAVITAASTLLTELFSNKGSGTLFKNAERMLRVRSLDKLDQGRLVDLVNASFGKKLRDDYLASLRPRLHSIYVSEGLPLSRCARYNAAAILTMEPVLGGTPYLDKFVVSSSRQGQGSGQMLWECLRRDLQTLFWRSRVTNPINPWYFKHSDGSFSNKQWIFFWFGLADIRDSYELVNHAKGLPDSFHKPASDPGS

SEQ ID NO: 9172 - protein, 104 aa, Homo Sapiens
MSPPPLLQPLLLLLPLLNVEPSGATLIRIPLHRVQPGRRILNLLRGWREPAELPKLGAPSPGDKPIFVPLSNYRDGYTTDLIPKPLAPSRPMGPSLPFNMELGG

SEQ ID NO: 9173 - protein, 268 aa, Homo Sapiens
MSPPPLLQPLLLLLPLLNVEPSGATLIRIPLHRVQPGRRILNLLRGWREPAELPKLGAPSPGDKPIFVPLSNYRDVQYFGEIGLGTPPQNFTVAFDTGSSNLWVPSRRCHFFSVPCSSSSFQANGTKFAIQYGTGRVDGILSEDKLTIGGIKGASVIFGEALWEPSLVFAFAHFDGILGLGFPILSVEGVRPPMDVLVEQGLLDKPVFSFYLNRDPEEPDGGELVLGGSDPAHYIPPLTFVPVTVPAYWQIHMERVKVGPGLTLCAKG

SEQ ID NO: 9174 - protein, 420 aa, Homo Sapiens
MSPPPLLQPLLLLLPLLNVEPSGATLIRIPLHRVQPGRRILNLLRGWREPAELPKLGAPSPGDKPIFVPLSNYRDVQYFGEIGLGTPPQNFTVAFDTGSSNLWVPSRRCHFFSVPCWLHHRFDPKASSSFQANGTKFAIQYGTGRVDGILSEDKLTIGGIKGASVIFGEALWEPSLVFAFAHFDGILGLGFPILSVEGVRPPMDVLVEQGLLDKPVFSFYLNRDPEEPDGGELVLGGSDPAHYIPPLTFVPVTVPAYWQIHMERVKVGPGLTLCAKGCAAILDTGTSLITGPTEEIRALHAAIGGIPLLAGEYIILCSEIPKLPAVSFLLGGVWFNLTAHDYVIQTTRNGVRLCLSGFQALDVPPPAGPFWILGDVFLGTYVAVFDRGDMKSSARVGLARARTRGADLGWGETAQAQFPG

SEQ ID NO: 9175 - protein, 237 aa, Homo Sapiens
MLPDGPGSSLWGNPGLQTSDSPNAVHEVEKWLPRLHALVVGPGLGRDDALLRNVQGILEVSKARDIPVVIDADGLWLVAQQPALIHGYRKAVLTPNHVEFSRLYDAVLRGPMDSDDSHGSVLRLSQALGNVTVVQKGERDILSNGQQVLVCSQEGSSRRCGGQGDLLSGSLGVLVHWALLAGPQKTNGSSPLLVAAFGACSLTRQCNHQAFQKHGRSTTTSDMIAEVGAAFSKLFET

SEQ ID NO: 9176 - protein, 390 aa, Homo Sapiens
MVTRAGAGTAVAGAVVVALLSAALALYGPPLDAVLERAFSLRKAHSIKDMENTLQLVRNIIPPLSSTKHKGQDGRIGVVGGCQEYTGAPYFAAISALKVGADLSHVFCASAAAPVIKAYSPELIVHPVLDSPNAVHEVEKWLPRLHALVVGPGLGRDDALLRNVQGILEVSKARDIPVVIDADGLWLVAQQPALIHGYRKAVLTPNHVEFSRLYDAVLRGPMDSDDSHGSVLRLSQALGNVTVVQKGERDILSNGQQVLVCSQEGSSRRCGGQGDLLSGSLGVLVHWALLAGPQKTNGGISDLKLTIWGPEIETGVKTRAQGSCGPRTTTPTSPHLLLSPSPQVQPSPGGRVWRLLSHQAVQPPSLPEARSLHHHLRHDRRGGGRLQQAL

SEQ ID NO: 9177 - protein, 260 aa, Homo Sapiens
MSRLRALLGLGLLVAGSRVPRIKSQTIACRSGPTWWGPQRLNSGGRWDSEVMASTVVKYLSQEEAQAVDQELFNEYQFSVDQLMELAGLSCATAIAKAYPPTSMSRSPPTVLVICGPGNNGGDGLVCARHLKLFGYEPTIYYPKRPNKPLFTALVTQCQKMDIPFLGEMPAELQGRCSGTVPQHPECPEGTHCAHCQHRHSLRMGRGEGKCWRDPARLAHIPHSPQKICNPVYRSLPLPGGSFCATCSGEEVPAEPATLP

SEQ ID NO: 9178 - protein, 245 aa, Homo Sapiens
MSRLRALLGLGLLVAGSRVPRIKSQTIACRSGPTWWGPQRLNSGGRWDSEVMASTVVKYLSQEEAQAVDQELFNEYQFSVDQLMELAGLSCATAIAKAYPPTSMSRSPPTVLVICGPGNNGGDGLVCARHLKLFGYEPTIYYPKRPNKPLFTALVTQCQKMDIPFLGEMPAEPMTIDELYELVVDAIFGFSFKGDVREPFHSILSVLKGLTVPIASIDIPSGAGIQKVGWGRLGPYPPDSCPHQV

SEQ ID NO: 9179 - protein, 288 aa, Homo Sapiens
MSRLRALLGLGLLVAGSRVPRIKSQTIACRSGPTWWGPQRLNSGGRWDSEVMASTVVKYLSQEEAQAVDQELFNEYQFSVDQLMELAGLSCATAIAKAYPPTSMSRSPPTVLVICGPGNNGGDGLVCARHLKLFGYEPTIYYPKRPNKPLFTALVTQCQKMDIPFLGEMPAEPMTIDELYELVVDAIFGFSFKGDVREPFHSILSVLKGLTVPIASIDIPSGWDVEKGNAGGIQPDLLISLTAPKKSATQFTGRYHYLGGRFVPPALEKKYQLNLPPYPDTECVYRLQ

SEQ ID NO: 9180 - protein, 128 aa, Homo Sapiens
MCSLALQQLISMDLFWRLFFVCGQEGLRALEATGMMLRVLVGAVLPAMLLAAPPPINKLALFPDKSAWCEAKNITQIVGHSGCEAKSIQNRACLGQCFSYSVPNTFPQSTESLVHCDSCMPAQSMWEI

SEQ ID NO: 9181 - protein, 215 aa, Homo Sapiens
MCSLALQQLISMDLFWRLFFVCGQEGLRALEATGMMLRVLVGAVLPAMLLAAPPPINKLALFPDKSAWCEAKNITQIVGHSGCEAKSIQNRACLGQCFSYSVPNTFPQSTESLVHCDSCMPAQSMWEIVTLECPGHEEVPRVDKLVEKILHCSCQACGKEPSHEGLSVYVQGEDGPGSQPGTHPHPHPHPHPGGQTPEPEDPPGAPHTEEEGAED

SEQ ID NO: 9182 - protein, 163 aa, Homo Sapiens
MLRVLVGAVLPAMLLAAPPPINKLALFPDKSAWCEAKNITQIVGHSGCEAKSIQNRACLGQCFSYSVPNTFPQSTESLVHCDSCMPAQSMWEIVTLECPGHEEVPRVDKLVEKILHCSCQACGKEPSHEGLSVYVQGEDGPGSQPGTHPHPHPHPHPGGQTPE

SEQ ID NO: 9183 - protein, 109 aa, Homo Sapiens
MMLRVLVGAVLPAMLLAAPPPINKLALFPDKSAWCEAKNITQIVGHSGCEAKSIQNRACLGQCFSYSVPNTFPQSTESLVHCDSCMPAQSMWEIVTLECPGHEEVPRVD

SEQ ID NO: 9184 - protein, 116 aa, Homo Sapiens
MMLRVLVGAVLPAMLLAAPPPINKLALFPDKSAWCEAKNITQIVGHSGCEAKSIQNRACLGQCFSYSVPNTFPQSTESLVHCDSCMPAQSMWEIVTLECPGHEEVPRVDKLVEKIL

SEQ ID NO: 9185 - protein, 117 aa, Homo Sapiens
MMLRVLVGAVLPAMLLAAPPPINKLALFPDKSAWCEAKNITQIVGHSGCEAKSIQNRACLGQCFSYSVPNTFPQSTESLVHCDSCMPAQSMWEIVTLECPGHEEVPRVDKLVEKILH

SEQ ID NO: 9186 - protein, 128 aa, Homo Sapiens
MMLRVLVGAVLPAMLLAAPPPINKLALFPDKSAWCEAKNITQIVGHSGCEAKSIQNRACLGQCFSYSVPNTFPQSTESLVHCDSCMPAQSMWEIVTLECPGHEEVPRVDKLVEKILHCSCQACGKEPS

SEQ ID NO: 9187 - protein, 181 aa, Homo Sapiens
MMLRVLVGAVLPAMLLAAPPPINKLALFPDKSAWCEAKNITQIVGHSGCEAKSIQNRACLGQCFSYSVPNTFPQSTESLVHCDSCMPAQSMWEIVTLECPGHEEVPRVDKLVEKILHCSCQACGKEPSHEGLSVYVQGEDGPGSQPGTHPHPHPHPHPGGQTPEPEDPPGAPHTEEEGAED

SEQ ID NO: 9188 - protein, 181 aa, Homo Sapiens; identical to SEQ ID NO: 9187

SEQ ID NO: 9189 - protein, 181 aa, Homo Sapiens; identical to SEQ ID NO: 9187

SEQ ID NO: 9190 - protein, 181 aa, Homo Sapiens; identical to SEQ ID NO: 9187

SEQ ID NO: 9191 - protein, 181 aa, Homo Sapiens; identical to SEQ ID NO: 9187

SEQ ID NO: 9192 - protein, 181 aa, Homo Sapiens; identical to SEQ ID NO: 9187

SEQ ID NO: 9193 - protein, 216 aa, Homo Sapiens
MPGNLMSQTSRAVSIWKFPAKLGKTHGHRALEATGMMLRVLVGAVLPAMLLAAPPPINKLALFPDKSAWCEAKNITQIVGHSGCEAKSIQNRACLGQCFSYSVPNTFPQSTESLVHCDSCMPAQSMWEIVTLECPGHEEVPRVDKLVEKILHCSCQACGKEPSHEGLSVYVQGEDGPGSQPGTHPHPHPHPHPGGQTPEPEDPPGAPHTEEEGAED

SEQ ID NO: 9194 - protein, 165 aa, Homo Sapiens
EFILVQADTPSSPSIDQVEPYSSTAQVQFDEPEATGGVPILKYKAEWRAVGEEVWHSKWYDAKEASMEGIVTIVGLKPETTYAVRLAALNGKGLGEISAASEFKTQPVHSPPPPASASSSTPVPLSPPDTTWPLPALATTEPAKNIAQNHCCNMFQAGLHNALMK

SEQ ID NO: 9195 - protein, 133 aa, Homo Sapiens
MLQTKDLIWTLFFLGTAAKPKITYVENQTAMELEEQVTLTCEASGDPIPSITWRTSTRNISSEEKTLDGHMVVRSHARVSSLTLKSIQYTDAGEYICTASNTIGQDSQSMYLEVQYAPKLQGPVAVYTWEGNQ

SEQ ID NO: 9196 - protein, 136 aa, Homo Sapiens [sequence omitted]

SEQ ID NO: 9197 - protein, 858 aa, Homo Sapiens
MLQTKDLIWTLFFLGTAVSLQVDIVPSQGEISVGESKFFLCQVAGDAKDKDISWFSPNGEKLTPNQQRISVVWNDDSSSTLTIYNANIDDAGIYKCVVTGEDGSESEATVNVKIFQKLMFKNAPTPQEFREGEDAVIVCDVVSSLPPTIIWKHKGRDVILKKDVRFIVLSNNYLQIRGIKKTDEGTYRCEGRILARGEINFKDIQVIVNVPPTIQARQNIVNATANLGQSVTLVCDAEGFPEPTMSWTKDGEQIEQEEDDEKYIFSDDSSQLTIKKVDKNDEAEYICIAENKAGEQDATIHLKVFAKPKITYVENQTAMELEEQVTLTCEASGDPIPSITWRTSTRNISSEEKASWTRPEKQETLDGHMVVRSHARVSSLTLKSIQYTDAGEYICTASNTIGQDSQSMYLEVQYAPKLQGPVAVYTWEGNQVNITCEVFAYPSATISWFRDGQLLPSSNYSNIKIYNTPSASYLEVTPDSENDFGNYNCTAVNRIGQESLEFILVQADTPSSPSIDQVEPYSSTAQVQFDEPEATGGVPILKYKAEWRAVGEEVWHSKWYDAKEASMEGIVTIVGLKPETTYAVRLAALNGKGLGEISAASEFKTQPVQGEPSAPKLEGQMGEDGNSIKVNLIKQDDGGSPIRHYLVRYRALSSEWKPEIRLPSGSDHVMLKSLDWNAEYEVYVVAENQQGKSKAAHFVFRTSAQPTAIPANGSPTSGLSTGAIVGILIVIFVLLLVVVDITCYFLNKCGLFMCIAVNLCGKAGPGAKGKDMEEGKAAFSKDESKEPIVEVRTEEERTPNHDGGKHTEPNETTPLTEPEKGPVEAKPECQETETKPAPAEVKTVPNDATQTKENESKA

SEQ ID NO: 9198 - protein, 725 aa, Homo Sapiens
MLQTKDLIWTLFFLGTAVSLQVDIVPSQGEISVGESKFFLCQVAGDAKDKDISWFSPNGEKLTPNQQRISVVWNDDSSSTLTIYNANIDDAGIYKCVVTGEDGSESEATVNVKIFQKLMFKNAPTPQEFREGEDAVIVCDVVSSLPPTIIWKHKGRDVILKKDVRFIVLSNNYLQIRGIKKTDEGTYRCEGRILARGEINFKDIQVIVNVPPTIQARQNIVNATANLGQSVTLVCDAEGFPEPTMSWTKDGEQIEQEEDDEKYIFSDDSSQLTIKKVDKNDEAEYICIAENKAGEQDATIHLKVFAKPKITYVENQTAMELEEQVTLTCEASGDPIPSITWRTSTRNISSEEKTLDGHMVVRSHARVSSLTLKSIQYTDAGEYICTASNTIGQDSQSMYLEVQYAPKLQGPVAVYTWEGNQVNITCEVFAYPSATISWFRDGQLLPSSNYSNIKIYNTPSASYLEVTPDSENDFGNYNCTAVNRIGQESLEFILVQADTPSSPSIDQVEPYSSTAQVQFDEPEATGGVPILKYKAEWRAVGEEVWHSKWYDAKEASMEGIVTIVGLKPETTYAVRLAALNGKGLGEISAASEFKTQPVREPSAPKLEGQMGEDGNSIKVNLIKQDDGGSPIRHYLVRYRALSSEWKPEIRLPSGSDHVMLKSLDWNAEYEVYVVAENQQGKSKAAHFVFRTSAQPTAIPATLGGNSASYTFVSLLFSAVTLLLLC

SEQ ID NO: 9199 - protein, 364 aa, Homo Sapiens
MLQTKDLIWTLFFLGTAVSLQVDIVPSQGEISVGESKFFLCQVAGDAKDKDISWFSPNGEKLTPNQQRISVVWNDDSSSTLTIYNANIDDAGIYKCVVTGEDGSESEATVNVKIFQKLMFKNAPTPQEFREGEDAVIVCDVVSSLPPTIIWKHKGRDVILKKDVRFIVLSNNYLQIRGIKKTDEGTYRCEGRILARGEINFKDIQVIVNVPPTIQARQNIVNATANLGQSVTLVCDAEGFPEPTMSWTKDGEQIEQEEDDEKYIFSDDSSQLTIKKVDKNDEAEYICIAENKAGEQDATIHLKVFAKPKITYVENQTAMELEEQVTLTCEASGDPIPSITWRTSTRNISSEEKASWTRPEKQEV

SEQ ID NO: 9200 - protein, 761 aa, Homo Sapiens
MLQTKDLIWTLFFLGTAVSLQVDIVPSQGEISVGESKFFLCQVAGDAKDKDISWFSPNGEKLTPNQQRISVVWNDDSSSTLTIYNANIDDAGIYKCVVTGEDGSESEATVNVKIFQKLMFKNAPTPQEFREGEDAVIVCDVVSSLPPTIIWKHKGRDVILKKDVRFIVLSNNYLQIRGIKKTDEGTYRCEGRILARGEINFKDIQVIVNVPPTIQARQNIVNATANLGQSVTLVCDAEGFPEPTMSWTKDGEQIEQEEDDEKYIFSDDSSQLTIKKVDKNDEAEYICIAENKAGEQDATIHLKVFAKPKITYVENQTAMELEEQVTLTCEASGDPIPSITWRTSTRNISSEEKTLDGHMVVRSHARVSSLTLKSIQYTDAGEYICTASNTIGQDSQSMYLEVQYAPKLQGPVAVYTWEGNQVNITCEVFAYPSATISWFRDGQLLPSSNYSNIKIYNTPSASYLEVTPDSENDFGNYNCTAVNRIGQESLEFILVQADTPSSPSIDQVEPYSSTAQVQFDEPEATGGVPILKYKAEWRAVGEEVWHSKWYDAKEASMEGIVTIVGLKPETTYAVRLAALNGKGLGEISAASEFKTQPVHSPPPPASASSSTPVPLSPPDTTWPLPALATTEPAKGEPSAPKLEGQMGEDGNSIKVNLIKQDDGGSPIRHYLVRYRALSSEWKPEIRLPSGSDHVMLKSLDWNAEYEVYVVAENQQGKSKAAHFVFRTSAQPTAIPATLGGNSASYTFVSLLFSAVTLLLLC

SEQ ID NO: 9201 - protein, 848 aa, Homo Sapiens [sequence omitted]

SEQ ID NO: 9202 - protein, 761 aa, Homo Sapiens [sequence omitted]

SEQ ID NO: 9203 - protein, 726 aa, Homo Sapiens
MLQTKDLIWTLFFLGTAVSLQVDIVPSQGEISVGESKFFLCQVAGDAKDKDISWFSPNGEKLTPNQQRISVVWNDDSSSTLTIYNANIDDAGIYKCVVTGEDGSESEATVNVKIFQKLMFKNAPTPQEFREGEDAVIVCDVVSSLPPTIIWKHKGRDVILKKDVRFIVLSNNYLQIRGIKKTDEGTYRCEGRILARGEINFKDIQVIVNVPPTIQARQNIVNATANLGQSVTLVCDAEGFPEPTMSWTKDGEQIEQEEDDEKYIFSDDSSQLTIKKVDKNDEAEYICIAENKAGEQDATIHLKVFAKPKITYVENQTAMELEEQVTLTCEASGDPIPSITWRTSTRNISSEEKTLDGHMVVRSHARVSSLTLKSIQYTDAGEYICTASNTIGQDSQSMYLEVQYAPKLQGPVAVYTWEGNQVNITCEVFAYPSATISWFRDGQLLPSSNYSNIKIYNTPSASYLEVTPDSENDFGNYNCTAVNRIGQESLEFILVQADTPSSPSIDQVEPYSSTAQVQFDEPEATGGVPILKYKAEWRAVGEEVWHSKWYDAKEASMEGIVTIVGLKPETTYAVRLAALNGKGLGEISAASEFKTQPVQGEPSAPKLEGQMGEDGNSIKVNLIKQDDGGSPIRHYLVRYRALSSEWKPEIRLPSGSDHVMLKSLDWNAEYEVYVVAENQQGKSKAAHFVFRTSAQPTAIPATLGGNSASYTFVSLLFSAVTLLLLC

SEQ ID NO: 9204 - protein, 884 aa, Homo Sapiens [sequence omitted]

SEQ ID NO: 9205 - protein, 884 aa, Homo Sapiens
MLQTKDLIWTLFFLGTAVSLQVDIVPSQGEISVGESKFFLCQVAGDAKDKDISWFSPNGEKLTPNQQRISVVWNDDSSSTLTIYNANIDDAGIYKCVVTGEDGSESEATVNVKIFQKLMFKNAPTPQEFREGEDAVIVCDVVSSLPPTIIWKHKGRDVILKKDVRFIVLSNNYLQIRGIKKTDEGTYRCEGRILARGEINFKDIQVIVNVPPTIQARQNIVNATANLGQSVTLVCDAEGFPEPTMSWTKDGEQIEQEEDDEKYIFSDDSSQLTIKKVDKNDEAEYICIAENKAGEQDATIHLKVFAKPKITYVENQTAMELEEQVTLTCEASGDPIPSITWRTSTRNISSEEKASWTRPEKQEVHAPWNWQVGRQKGQAGSAGFPGSHETLDGHMVVRSHARVSSLTLKSIQYTDAGEYICTASNTIGQDSQSMYLEVQYAPKLQGPVAVYTWEGNQVNITCEVFAYPSATISWFRDGQLLPSSNYSNIKIYNTPSASYLEVTPDSENDFGNYNCTAVNRIGQESLEFILVQADTPSSPSIDQVEPYSSTAQVQFDEPEATGGVPILKYKAEWRAVGEEVWHSKWYDAKEASMEGIVTIVGLKPETTYAVRLAALNGKGLGEISAASEFKTQPVQGEPSAPKLEGQMGEDGNSIKVNLIKQDDGGSPIRHYLVRYRALSSEWKPEIRLPSGSDHVMLKSLDWNAEYEVYVVAENQQGKSKAAHFVFRTSAQPTAIPANGSPTSGLSTGAIVGILIVIFVLLLVVVDITCYFLNKCGLFMCIAVNLCGKAGPGAKGKDMEEGKAAFSKDESKEPIVEVRTEEERTPNHDGGKHTEPNETTPLTEPEKGPVEAKPECQETETKPAPAEVKTVPNDATQTKENESKA

SEQ ID NO: 9206 - protein, 858 aa, Homo Sapiens [sequence omitted]

SEQ ID NO: 9207 - protein, 848 aa, Homo Sapiens
MLQTKDLIWTLFFLGTAVSLQVDIVPSQGEISVGESKFFLCQVAGDAKDKDISWFSPNGEKLTPNQQRISVVWNDDSSSTLTIYNANIDDAGIYKCVVTGEDGSESEATVNVKIFQKLMFKNAPTPQEFREGEDAVIVCDVVSSLPPTIIWKHKGRDVILKKDVRFIVLSNNYLQIRGIKKTDEGTYRCEGRILARGEINFKDIQVIVNVPPTIQARQNIVNATANLGQSVTLVCDAEGFPEPTMSWTKDGEQIEQEEDDEKYIFSDDSSQLTIKKVDKNDEAEYICIAENKAGEQDATIHLKVFAKPKITYVENQTAMELEEQVTLTCEASGDPIPSITWRTSTRNISSEEKTLDGHMVVRSHARVSSLTLKSIQYTDAGEYICTASNTIGQDSQSMYLEVQYAPKLQGPVAVYTWEGNQVNITCEVFAYPSATISWFRDGQLLPSSNYSNIKIYNTPSASYLEVTPDSENDFGNYNCTAVNRIGQESLEFILVQADTPSSPSIDQVEPYSSTAQVQFDEPEATGGVPILKYKAEWRAVGEEVWHSKWYDAKEASMEGIVTIVGLKPETTYAVRLAALNGKGLGEISAASEFKTQPVQGEPSAPKLEGQMGEDGNSIKVNLIKQDDGGSPIRHYLVRYRALSSEWKPEIRLPSGSDHVMLKSLDWNAEYEVYVVAENQQGKSKAAHFVFRTSAQPTAIPANGSPTSGLSTGAIVGILIVIFVLLLVVVDITCYFLNKCGLFMCIAVNLCGKAGPGAKGKDMEEGKAAFSKDESKEPIVEVRTEEERTPNHDGGKHTEPNETTPLTEPEKGPVEAKPECQETETKPAPAEVKTVPNDATQTKENESKA

SEQ ID NO: 9208 - protein, 229 aa, Homo Sapiens
TISWFRDGQLLPSSNYSNIKIYNTPSASYLEVTPDSENDFGNYNCTAVNRIGQESLEFILVQADTPSSPSIDQVEPYSSTAQVQFDEPEATGGVPILKYKAEWRAVGEEVWHSKWYDAKEASMEGIVTIVGLKPETTYAVRLAALNGKGLGEISAASEFKTQPVHSPPPREPSAPKLEGQMGEDGNSIKVNLIKQDDGGSPIRHYLVRYRALSSEWKPEIRLPSGSDHV

SEQ ID NO: 9209 - protein, 357 aa, Homo Sapiens
  misc_feature (1)..(1): Xaa can be any naturally occurring amino acid
XFILVQADTPSSPSIDQVEPYSSTAQVQFDEPEATGGVPILKYKAEWRAVGEEVWHSKWYDAKEASMEGIVTIVGLKPETTYAVRLAALNGKGLGEISAASEFKTQPVREPSAPKLEGQMGEDGNSIKVNLIKQDDGGSPIRHYLVRYRALSSEWKPEIRLPSGSDHVMLKSLDWNAEYEVYVVAENQQGKSKAAHFVFRTSAQPTAIPANGSPTSGLSTGAIVGILIVIFVLLLVVVDITCYFLNKCGLFMCIAVNLCGKAGPGAKGKDMEEGKAAFSKDESKEPIVEVRTEEERTPNHDGGKHTEPNETTPLTEPEKGPVEAKPECQETETKPAPAEVKTVPNDATQTKENESKA

SEQ ID NO: 9210 - protein, 84 aa, Homo Sapiens
  misc_feature (1)..(1): Xaa can be any naturally occurring amino acid
XQDDGGSPIRHYLVRYRALSSEWKPEIRLPSGSDHVMLKSLDWNAEYEVYVVAENQQGKSKAAHFVFRTSAQPTAIPVTLLLLC

SEQ ID NO: 9211 - protein, 468 aa, Homo Sapiens
  misc_feature (1)..(1): Xaa can be any naturally occurring amino acid
XSGSDHVMLKSLDWNAEYEVYVVAENQQGKSKAAHFVFRTSAQPTAIPANGSPTSGLSTGAIVGILIVIFVLLLVVVDITCYFLNKCGLFMCIAVNLCGKAGPGAKGKDMEEGKAAFSKDESKEPIVEVRTEEERTPNHDGGKHTEPNETTPLTEPELPADTTATVEDMLPSVTTVTTNSDTITETFATAQNSPTSETTTLTSSIAPPATATPDSNSVPAGQATPSKGPSASAPSPAPASAPKVAPLVDLSDTPTSTPAASNLSSSVLANQGAVLSPSAPAGVGEASKAPPASKPTPAPVPTPTGAASPLAAAAAPATEAPQAKQEAPSTKGPDPEPTQPGAAKSPAEAATALASPKSEAASVSTTNPSQGEDFKMDEGNFKTPDIDLAKDVFAALGSPAPAAGASGQAPELAPSTADSSVSPAPAKTEKGPVEAKPECQETETKPAPAEVKTVPNDATQTKENESKA

SEQ ID NO: 9212 - protein, 372 aa, Homo Sapiens
  misc_feature (1)..(1): Xaa can be any naturally occurring amino acid
XTPSSPSIDQVEPYSSTAQVQFDEPEATGGVPILKYKAEWRAVGEEVWHSKWYDAKEASMEGIVTIVGLKPETTYAVRLAALNGKGLGEISAASEFKTQPVHSPPPPASASSSTPVPLSPPDKGEPSAPKLEGQMGEDGNSIKVNLIKQDDGGSPIRHYLVRYRALSSEWKPEIRLPSGSDHVMLKSLDWNAEYEVYVVAENQQGKSKAAHFVFRTSAQPTAIPANGSPTSGLSTGAIVGILIVIFVLLLVVVDITCYFLNKCGLFMCIAVNLCGKAGPGAKGKDMEEGKAAFSKDESKEPIVEVRTEEERTPNHDGGKHTEPNETTPLTEPEKGPVEAKPECQETETKPAPAEVKTVPNDATQTKENESKA

SEQ ID NO: 9213 - protein, 305 aa, Homo Sapiens
YNTPSASYLEVTPDSENDFGNYNCTAVNRIGQESLEFILVQADTPSSPSIDQVEPYSSTAQVQFDEPEATGGVPILKYKAEWRAVGEEVWHSKWYDAKEASMEGIVTIVGLKPETTYAVRLAALNGKGLGEISAASEFKTQPVHSPPPPASASSSTPVPLSPPDTTWPLPALATTEPAREPSAPKLEGQMGEDGNSIKVNLIKQDDGGSPIRHYLVRYRALSSEWKPEIRLPSGSDHVMLKSLDWNAEYEVYVVAENQQGKSKAAHFVFRTSAQPTAIPATLGGNSASYTFVSLLFSAVTLLLLC

SEQ ID NO: 9214 - protein, 1321 aa, Homo Sapiens
MGAPFVWALGLLMLQMLLFVAGEQGTQDITDASERGLHMQKLGSGSVQAALAELVALPCLFTLQPRPSAARDAPRIKWTKVRTASGQRQDLPILVAKDNVVRVAKSWQGRVSLPSYPRRRANATLLLGPLRASDSGLYRCQVVRGIEDEQDLVPLEVTGVVFHYRSARDRYALTFAEAQEACRLSSAIIAAPRHLQAAFEDGFDNCDAGWLSDRTVRYPITQSRPGCYGDRSSLPGVRSYGRRNPQELYDVYCFARELGGEVFYVGPARRLTLAGARAQCRRQGAALASVGQLHLAWHEGLDQCDPGWLADGSVRYPIQTPRRRCGGPAPGVRTVYRFANRTGFPSPAERFDAYCFRAHHPTSQHGDLETPSSGDEGEILSAEGPPVRELEPTLEEEEVVTPDFQEPLVSSGEEETLILEEKQESQQTLSPTPGDPMLASWPTGEVWLSTVAPSPSDMGAGTAASSHTEVAPTDPMPRRRGRFKGLNGRYFQQQEPEPGLQGGMEASAQPPTSEAAVNQMEPPLAMAVTEMLGSGQSRSPWADLTNEVDMPGAGSAGGKSSPEPWLWPPTMVPPSISGHSRAPVLELEKAEGPSARPATPDLFWSPLEATVSAPSPAPWEAFPVATSPDLPMMAMLRGPKEWMLPHPTPISTEANRVEAHGEATATAPPSPAAETKVYSLPLSLTPTGQGGEAMPTTPESPRADFRETGETSPAQVNKAEHSSSSPWPSVNRNVAVGFVPTETATEPTGLRGIPGSESGVFDTAESPTSGLQATVDEVQDPWPSVYSKGLDASSPSAPLGSPGVFLVPKVTPNLEPWVATDEGPTVNPMDSTVTPAPSDASGIWEPGSQVFEEAESTTLSPQVALDTSIVTPLTTLEQGDKVGVPAMSTLGSSSSQPHPEPEDQVETQGTSGASVPPHQSSPLGKPAVPPGTPTAASVGESASVSSGEPTVPWDPSSTLLPVTLGIEDFELEVLAGSPGVESFWEEVASGEEPALPGTPMNAGAEEVHSDPCENNPCLHGGTCNANGTMYGCSCDQGFAGENCEIDIDDCLCSPCENGGTCIDEVNGFVCLCLPSYGGSFCEKDTEGCDRGWHKFQGHCYRYFAHRRAWEDAEKDCRRRSGHLTSVHSPEEHSFINSFGHENTWIGLNDRIVERDFQWTDNTGLQFENWRENQPDNFFAGGEDCVVMVAHESGRWNDVPCNYNLPYVCKKGTVLCGPPPAVENASLIGARKAKYNVHATVRYQCNEGFAQHHVATIRCRSNGKWDRPQIVCTKPRRSHRMRRHHHHHQHHHQHHHHKSRKERRKHKKHPTEDWEKDEGNFC

SEQ ID NO: 9215 - protein, 175 aa, Homo Sapiens
  misc_feature (1)..(1): Xaa can be any naturally occurring amino acid
XGCDRGWHKFQGHCYRYFAHRRAWEDAEKDCRRRSGHLTSVHSPEEHSFINSFGHENTWIGLNDRIVERDFQWTDNTGLQFENWRENQPDNFFAGGEDCVVMVAHESGRWNDVPCNYNLPYVCKKGTARRSHRMRRHHHHHQHHHQHHHHKSRKERRKHKKHPTEDWEKDEGNFC

SEQ ID NO: 9216 - protein, 99 aa, Homo Sapiens
MVLRRLLAALLHSPQLVERLSESRPIRRAAQLTAFALLQAQLRGQDAARRLQDLAAGPVGSLCRRAERFRDAFTQELRRGLRGRSGPPPGSQRGPGANI

SEQ ID NO: 9217 - protein, 709 aa, Homo Sapiens
MATAGGGSGADPGSRGLLRLLSFCVLLAGLCRGNSVERKIYIPLNKTAPCVRLLNATHQIGCQSSISGDTGVIHVVEKEEDLQWVLTDGPNPPYMVLLESKHFTRDLMEKLKGRTSRIAGLAVSLTKPSPASGFSPSVQCPNDGFGVYSNSYGPEFAHCREIQWNSLGNGLAYEDFSFPIFLLEDENETKVIKQCYQDHNLSQNGSAPTFPLCAMQLFSHMHAVISTATCMRRSSIQSTFSINPEIVCDPLSDYNVWSMLKPINTTGTLKPDDRVVVAATRLDSRSFFWNVAPGAESAVASFVTQLAAAEALQKAPDVTTLPRNVMFVFFQGETFDYIGSSRMVYDMEKGKFPVQLENVDSFVELGQVALRTSLELWMHTDPVSQKNESVRNQVEDLLATLEKSGAGVPAVILRRPNQSQPLPPSSLQRFLRARNISGVVLADHSGAFHNKYYQSIYDTAENINVSYPEWLSPEEDLNFVTDTAKALADVATVLGRALYELAGGTNFSDTVQADPQTVTRLLYGFLIKANNSWFQSILRQDLRSYLGDGPLQHYIAVSSPTNTTYVVQYALANLTGTVVNLTREQCQDPSKVPSENKDLYEYSWVQGPLHSNETDRLPRCVRSTARLARALSPAFELSQWSSTEYSTWTESRWKDIRARIFLIASKELELITLTVGFGILIFSLIVTYCINAKADVLFIAPREPGAVSY

SEQ ID NO: 9218 - protein, 255 aa, Homo Sapiens
MATAGGGSGADPGSRGLLRLLSFCVLLAGLCRGNSVERKIYIPLNKTAPCVRLLNATHQIGCQSSISGDTGVIHVVEKEEDLQWVLTDGPNPPYMVLLESKHFTRDLMEKLKGRTSRIAGLAVSLTKPSPASGFSPSVQCPNDGFGVYSNSYGPEFAHCREIQWNSLGNGLAYEDFSFPIFLLEDENETKVIKQETFDYIGSSRMVYDMEKGKFPVQLENVDSFVELGQVALRTSLELWMHTDPVSQKNESVRNQ

SEQ ID NO: 9219 - protein, 134 aa, Homo Sapiens
MATAGGGSGADPGSRGLLRLLSFCVLLAGLCRGNSVERKIYIPLNKTAPCVRLLNATHQIGCQSSISGDTGVIHVVEKEEDLQWVLTDGPNPPYMVLLESKHFTRQNVRLSDTFLCSFMEFLSYSRDLMEKLKG

SEQ ID NO: 9220 - protein, 232 aa, Homo Sapiens
MATAGGGSGADPGSRGLLRLLSFCVLLAGLFLDFEPDPLPLCPDVSFFPQPQPPTPQSKGTGLCRGNSVERKIYIPLNKTAPCVRLLNATHQIGCQSSISGDTGVIHVVEKEEDLQWVLTDGPNPPYMVLLESKHFTRDLMEKLKGRTSRIAGLAVSLTKPSPASGFSPSVQCPNDGFGVYSNSYGPEFAHCREIQWNSLGNGLAYEDFSFPIFLLEDENETKVIKQCYQDH

SEQ ID NO: 9221 - protein, 71 aa, Homo Sapiens
MATAGGGSGADPGSRGLLRLLSFCVLLAGLFLDFEPDPLPLCPDVSFFPQPQPPTPQSKGTGVKVSFLPRV

SEQ ID NO: 9222 - protein, 69 aa, Homo Sapiens
MATAGGGSGADPGSRGLLRLLSFCVLLAVSLSMALHGLCNNPLRHIAGCHVEHVSVTISVCPRNQKNGL

SEQ ID NO: 9223 - protein, 219 aa, Homo Sapiens
RSSIQSTFSINPEIVCDPLSDYNVWSMLKPINTTGTLKPDDRVVVAATRLAAAEALQKAPDVTTLPRNVMFVFFQGETFDYIGSSRMVYDMEKGKFPVQLENVDSFVELGQVALRTSLELWMHTDPVSQKNESVRNQVEDLLATLEKSGAGVPAVILRRPNQSQPLPPSSLQRFLRARNISGVVLADHSGAFHNKYYQSIYDTAENINVSYPEWLSPEE

SEQ ID NO: 9224 - protein, 69 aa, Homo Sapiens
  misc_feature (1)..(1): Xaa can be any naturally occurring amino acid
XNDGFGVYSNSYGPEFAHCREIQWNSLGNGLAYEDFSFPIFLLEDENETKVIKQKSSVTPCLITMCGAC

SEQ ID NO: 9225 - protein, 275 aa, Homo Sapiens
  misc_feature (1)..(1): Xaa can be any naturally occurring amino acid
XNVAPGAESAVASFVTQLAAAEALQKAPDVTTLPRNVMFVFFQGVALRTSLELWMHTDPVSQKNESVRNQVEDLLATLEKSGAGVPAVILRRPNQSQPLPPSSLQRFLRARNISGVVLADHSGAFHNKYYQSIYDTAENINVSYPEWLSPEEDLNFVTDTAKALADVATVLGRALYELAGGTNFSDTVQADPQTVTRLLYGFLIKANNSWFQSILRQDLRSYLGDGPLQHYIAVSSPTNTTYVVQYALANLTGTVVNLTREQCQDPSKVPSENKD

SEQ ID NO: 9226 - protein, 317 aa, Homo Sapiens
  misc_feature (1)..(1): Xaa can be any naturally occurring amino acid
XVYSNSYGPEFAHCREIQWNSLGNGLAYEDFSFPIFLLEDENETKVIKQLFSHMHAVISTATCMRRSSIQSTFSINPEIVCDPLSDYNVWSMLKPINTTGTLKPDDRVVVAATRLDSRSFFWNVAPGAESAVASFVTQLAAAEALQKAPDVTTLPRNVMFVFFQGETFDYIGSSRMVYDMEKGKFPVQLENVDSFVELGQVALRTSLELWMHTDPVSQKNESVRNQVEDLLATLEKSGAGVPAVILRRPNQSQPLPPSSLQRFLRARNISGVVLADHSGAFHNKYYQSIYDTAENINVSYPEWLSPEEDLNFVTDTA

SEQ ID NO: 9227 - protein, 116 aa, Homo Sapiens
MVLLHWCLLWLLFPLSSRTQKLPTRDEELFQMQIRDKAFFHDSSVIPDGAEISSYLFRDTPKRYFFVVEEDNTPLSVTVTPCDAPLEWKLSLQELPEDRSGEGSGDLEPLEQQKQQ

SEQ ID NO: 9228 - protein, 145 aa, Homo Sapiens
MVLLHWCLLWLLFPLSSRTQKLPTRDEELFQMQIRDKAFFHDSSVIPDGAEISSYLFRDTPKRYFFVVEEDNTPLSVTVTPCDAPLEWKLSLQELPEDRSGEGSGDLEPLEQQKQQIINEEGTELFSYKGNDVEYFISSSSPSGL

SEQ ID NO: 9229 - protein, 568 aa, Homo Sapiens
MVLLHWCLLWLLFPLSSRTQKLPTRDEELFQMQIRDKAFFHDSSVIPDGAEISSYLFRDTPKRYFFVVEEDNTPLSVTVTPCDAPLEWKLSLQELPEDRSGEGSGDLEPLEQQKQQIINEEGTELFSYKGNDVEYFISSSSPSGLYQLDLLSTEKDTHFKVYATTTPESDQPYPELPYDPRVDVTSLGRTTVTLAWKPSPTASLLKQPIQYCVVINKEHNFKSLCAVEAKLSADDAFMMAPKPGLDFSPFDFAHFGFPSDNSGKERSFQAKPSPKLGRHVYSRPKVDIQKICIGNKNIFTVSDLKPDTQYYFDVFVVNINSNMSTAYVGTFARTKEEAKQKTVELKDGKITDVFVKRKGAKFLRFAPVSSHQKVTFFIHSCLDAVQIQVRRDGKLLLSQNVEGIQQFQLRGKPKAKYLVRLKGNKKGASMLKILATTRPTKQSFPSLPEDTRIKAFDKLRTCSSATVAWLGTQERNKFCIYKKEVDDNYNEDQKKREQNQCLGPDIRKKSEKVLCKYFHSQNLQKAVTTETIKGLQPGKSYLLDVYVIGHGGHSVKYQSKVVKTRKFC

SEQ ID NO: 9230 - protein, 133 aa, Homo Sapiens
MRKHVLAASFSMLSLLVIMGDTDSKTDSSFIMDSDPRRCMRHHYVDSISHPLYKCSSKMVLLARCEGHCSQASRSEPLVSFSTVLKQPFRSSCHCCRPQTSKLKALRLRCSGGMRLTATYRYILSCHCEECNS

SEQ ID NO: 9231 - protein, 133 aa, Homo Sapiens; identical to SEQ ID NO: 9230

SEQ ID NO: 9232 - protein, 133 aa, Homo Sapiens; identical to SEQ ID NO: 9230

SEQ ID NO: 9233 - protein, 129 aa, Homo Sapiens
DIENAYKKTFLPEMSEKCEVLQYSAREAQDSKKVVEDIEYLKFDKGPWLKQDNRTLYHLRLLVQDKFEVLNYTSIPIFLPEVTIGAHQTDRVLHQFREVPADQEHRWVSLLSSPLGSLFSEWSVCGEDS

SEQ ID NO: 9234 - protein, 138 aa, Homo Sapiens
ENAYKKTFLPEMSEKCEVLQYSAREAQDSKKVVEDIEYLKFDKGPWLKQDNRTLYHLRLLVQDKFEVLNYTSIPIFLPEVTIGAHQTDRVLHQFREFSLFNGRKPDAVKILCSLLEADRSLLEADRSLLEADRVQDSC

SEQ ID NO: 9235 - protein, 94 aa, Homo Sapiens
MALRLLKLAATSASARVVAAGAQRVASSTFLKRGFIIQTVPQEMGSPSPPTIMATVVWRNFTMIREAMMATVTACSPGCTAVACCSTQMPWSTC

SEQ ID NO: 9236 - protein, 429 aa, Homo Sapiens
MALRLLKLAATSASARVVAAGAQRVRGIHSSVQCKLRYGMWHFLLGDKASKRLTERSRVITVDGNICTGKGKLAKEIAEKLGFKHFPEAGIHYPDSTTGDGKPLATDYNGNCSLEKFYDDPRSNDGNSYRLQSWLYSSRLLQYSDALEHLLTTGQGVVLERSIFSDFVFLEAMYNQGFIRKQCESALQTHFWTGVAGASGKLESGSSEEVLLINERGGRSKPGVDHYNEVKSVTICDYLPPHLVIYIDVPVPEPHEMKITSAYLQDIENAYKKTFLPEMSEKCEVLQYSAREAQDSKKVVEDIEYLKFDKGPWLKQDNRTLYHLRLLVQDKFEVLNYTSIPIFLPEVTIGAHQTDRVLHQFRERLDWTVCFGEESTEVKHQGHLLSVQPGTVALTVGSWLRSCLLGLHWKLLFLFPESPMHTTAFMFLC

SEQ ID NO: 9237 - protein, 201 aa, Homo Sapiens
MALRLLKLAATSASARVVAAGAQRVRGIHSSVQCKLRYGMWHFLLGDKASKRLTERSRVITVDGNICTGKGKLAKEIAEKLGFKHFPEAGIHYPDSTTGDGKPLATDYNGNCSLEKFYDDPRSNDGNSYRLQSWLYSSRLLQYSDALEHLLTTGQGVVLERSIFSDFVFLEAMYNQGFIRKQCESALQTHFWVCGATLQGL

SEQ ID NO: 9238 - protein, 355 aa, Homo Sapiens
MALRLLKLAATSASARVVAAGAQRVRGIHSSVQCKLRYGMWHFLLGDKASKRLTERSRVITVDGNICTGKGKLAKEIAEKLGFKHFPEAGIHYPDSTTGDGKPLATDYNGNCSLEKFYDDPRSNDGNSYRLQSWLYSSRLLQYSDALEHLLTTGQGVVLERSIFSDFVFLEAMYNQGFIRKQCVDHYNEVKSVTICDYLPPHLVIYIDVPVPEVQRRIQKKGDPHEMKITSAYLQDIENAYKKTFLPEMSEKCEVLQYSAREAQDSKKVVEDIEYLKFDKGPWLKQDNRTLYHLRLLVQDKFEVLNYTSIPIFLPEVTIGAHQTDRVLHQFRELPGRKYSPGYNTEVGDKWIWLK

SEQ ID NO: 9239 - protein, 390 aa, Homo Sapiens
MALRLLKLAATSASARVVAAGAQRVRGIHSSVQCKLRYGMWHFLLGDKASKRLTERSRVITVDGNICTGKGKLAKEIAEKLGFKHFPEAGIHYPDSTTGDGKPLATDYNGNCSLEKFYDDPRSNDGNSYRLQSWLYSSRLLQYSDALEHLLTTGQGVVLERSIFSDFVFLEAMYNQGFIRKQCVDHYNEVKSVTICDYLPPHLVIYIDVPVPEVQRRIQKKGDPHEMKITSAYLQDIENAYKKTFLPEMSEKCEVLQYSAREAQDSKKVVEDIEYLKFDKGPWLKQDNRTLYHLRLLVQDKFEVLNYTSIPIFLPEVTIGAHQTDRVLHQFRELGIPYPQRAVQSTREGPEVLLTGLWRWEDLLIGLQLPGRKYSPGYNTEVGDKWIWLK

SEQ ID NO: 9240 - protein, 245 aa, Homo Sapiens [sequence omitted]

SEQ ID NO: 9241 - protein, 355 aa, Homo Sapiens
MALRLLKLAATSASARVVARAPSAWRGIHSSVQCKLRYGMWHFLLGDKASKRLTERSRVITVDGNICTGKGKLAKEIAEKLGFKHFPEAGIHYPDSTTGDGKPLATDYNGNCSLEKFYDDPRSNDGNSYRLQSWLYSSRLLQYSDALEHLLTTGQGVVLERSIFSDFVFLEAMYNQGFIRKQCVDHYNEVKSVTICDYLPPHLVIYIDVPVPEVQRRIQKKGDPHEMKITSAYLQDIENAYKKTFLPEMSEKCEVLQYSAREAQDSKKVVEDIEYLKFDKGPWLKQDNRTLYHLRLLVQDKFEVLNYTSIPIFLPEVTIGAHQTDRVLHQFRELPGRKYSPGYNTEVGDKWIWLK

SEQ ID NO: 9242 - protein, 133 aa, Homo Sapiens
  misc_feature (1)..(1): Xaa can be any naturally occurring amino acid
XSAYLQDIENAYKKTFLPEMSEKCEVLQYSAREAQDSKKVVEDIEYLKFDKGPWLKQDNRTLYHLRLLVQDKFEVLNYTSIPIFLPEVTIGAHQTDRVLHQFREVFQESEAKRLDVEEVCWKKTPLKDRGEEV

SEQ ID NO: 9243 - protein, 100 aa, Homo Sapiens
GFRLLRWQLCLAGPLALASDLGASSLVAFRRLLGNSIFPAPVRHSGDHGKRLFVIRPSRFYDRRFLKLLRFYIALTGIPVAIFITLVNVFIASHIKMDCP

SEQ ID NO: 9244 - protein, 56 aa, Homo Sapiens
IPVAIFITLVNVFIGQAELAEIPEGYVPEHWEYYKGKGAGSAKIDACERRWTLVLL

SEQ ID NO: 9245 - protein, 177 aa, Homo Sapiens
MAAMSLLRRVSVTAVAALSGRPLGTRLGFGGFLTRGFPKAAAPGNHHSAVFMILTTLFLIFYIALTGIPVAIFITLVNVFIGQAELAEIPEGYVPEHWEYYKHPISRWIARNFYDSPEKIYERTMAVLQIEAEKAELRVKELEVRKLMHVRGDGPWYYYETIDKELIDHSPKATPDN

SEQ ID NO: 9246 - protein, 135 aa, Homo Sapiens
MAAMSLLRRVSVTAVAALSGRPLGTRLGFGGFLTRGFPKAAAPVRHSGDHGKRLFVIRPSRFYDRRFLKLLRFYIALTGIPVAIFITLVNVFIGQAELAEIPEGYVPEHWEYYKGKGAGSAKIDACERRWTLVLL

SEQ ID NO: 9247 - protein, 189 aa, Homo Sapiens
MAAMSLLRRVSVTAVAALSGRPLGTRLGFGGFLTRGFPKAAAPVRHSGDHGKRLFVIRPSRFYDRRFLKLLRFYIALTGIPVAIFITLVNVFIGQAELAEIPEGYVPEHWEYYKHPISRWIARNFYDSPEKIYERTMAVLQIEAEKAELRVKELEVRKLMHVRGDGPWYYYETIDKELIDHSPKATPDN

SEQ ID NO: 9248 - protein, 66 aa, Homo Sapiens
MAAMSLLRRVSVTAVAALSGRPLGTRLGFGGFLTRGFPKAAEILHCIDWDSSSNFHNSGECIHWSS

SEQ ID NO: 9249 - protein, 42 aa, Homo Sapiens
MAAMSLLRRVSVTAVAALSGRPLGTRLGFGGFLTRGFPKAAG

SEQ ID NO: 9250 - protein, 137 aa, Homo Sapiens
MAAMSLLRRVSVTAVAALSGRPLGTRLGFGGFLTRGFPKAAGQAELAEIPEGYVPEHWEYYKHPISRWIARNFYDSPEKIYERTMAVLQIEAEKAELRVKELEVRKLMHVRGDGPWYYYETIDKELIDHSPKATPDN

SEQ ID NO: 9251 - protein, 206 aa, Homo Sapiens
  misc_feature (1)..(1): Xaa can be any naturally occurring amino acid
XSLLRRVSVTAVAALSGRPLGTRLGFGGFLTRGFPKAAAPVRHSGDHGKRLFVIRPSRFYDRRFLKLLALYEQSRGLENGRLSGPSATRFYIALTGIPVAIFITLVNVFIGQAELAEIPEGYVPEHWEYYKHPISRWIARNFYDSPEKIYERTMAVLQIEAEKAELRVKELEVRKLMHVRGDGPWYYYETIDKELIDHSPKATPDN

SEQ ID NO: 9252 - protein, 40 aa, Homo Sapiens
LTTPMLLRALAQAARAGPPGGRSLHSSAVAATYSEYLGGL

SEQ ID NO: 9253 - protein, 110 aa, Homo Sapiens
MRCLTTPMLLRALAQAARAGPPGGRSLHSSAVAATYKYVNMQDPEMDMKSVTDRAARTLLWTELFRGLGMTLSYLFREPATINYPFEKGPLSPRFRGEHALRRYPSGEER

SEQ ID NO: 9254 - protein, 124 aa, Homo Sapiens
MRCLTTPMLLRALAQAARAGPPGGRSLHSSAVAATYKYVNMQDPEMDMKSVTDRAARTLLWTELFRGLGMTLSYLFREPATINYPFEKGPLSPRFRGEHALRRYPSGEERCIACKLCEAICPAQ

SEQ ID NO: 9255 - protein, 184 aa, Homo Sapiens
MRCLTTPMLLRALAQAARAGPPGGRSLHSSAVAATYKYVNMQDPEMDMKSVTDRAARTLLWTELFRGLGMTLSYLFREPATINYPFEKGPLSPRFRGEHALRRYPSGEERCIACKLCEAICPAQAITIEAEPRADGSRRTTRYDIDMTKCIYCGFCQEACPVDAIVEGPNFEFSTETHEELLYN

SEQ ID NO: 9256 - protein, 210 aa, Homo Sapiens
MRCLTTPMLLRALAQAARAGPPGGRSLHSSAVAATYKYVNMQDPEMDMKSVTDRAARTLLWTELFRGLGMTLSYLFREPATINYPFEKGPLSPRFRGEHALRRYPSGEERCIACKLCEAICPAQAITIEAEPRADGSRRTTRYDIDMTKCIYCGFCQEACPVDAIVEGPNFEFSTETHEELLYNKEKLLNNGDKWEAEIAANIQADYLYR

SEQ ID NO: 9257 - protein, 43 aa, Homo Sapiens
MRCLTTPMLLRALAQAARAGPPGGRSLHSSAVAATYSEYLGGL

SEQ ID NO: 9258 - protein, 70 aa, Homo Sapiens
MRRPLCATGLVRVGDHWEDALPDHAYAAAGPGPGCTCRTSWWPEPPQQCSGSHLQVCEHAGSRDGHEVSD

SEQ ID NO: 9259 - protein, 138 aa, Homo Sapiens
MRRPLCATGLVRVGDHWEEYVNMQDPEMDMKSVTDRAARTLLWTELFRGLGMTLSYLFREPATINYPFEKGPLSPRFRGEHALRRYPSGEERCIACKLCEAICPAQAITIEAEPRADGSRRTTRYDIDMTKCIYCGFC

SEQ ID NO: 9260 - protein, 64 aa, Homo Sapiens
MTKCIYCGFCQEACPVDAIVEGPNFEFSTETHEELLYNKEKLLNNGDKWEAEIAANIQADYLYR

SEQ ID NO: 9261 - protein, 93 aa, Homo Sapiens
  misc_feature (1)..(1): Xaa can be any naturally occurring amino acid
XEPATINYPFEKGPLSPRFRGEHALRRYPSGEERCIACKLCEAICPAQGETLRAAGATLNKAVNSPLVRGGSWQMTPAADKQARQAGHGGSRL

SEQ ID NO: 9262 - protein, 127 aa, Homo Sapiens
CPTTVANVETVAVSPTICRRGGTWFAGFGRERNSGTKLFNISGHVNHPCTVEEEMSVPLKELIEKHAGGVTGGWDNLLAVIPGGSSTPLIPKSVCETVLMDFDALVQAQTGLGTAAVIVMDRSVWTG

SEQ ID NO: 9263 - protein, 133 aa, Homo Sapiens
EAYEAGLIGKNACGSGYDFDVFVVRGAGAYICGEETALIESIEGKQGKPRLKPPFPADVGVFGCPTTVANVETVAVSPTICRRGGTWFAGFGRERNSGTKLFNISGHVNHPCTVEEEMSVPLKELIEKHAVCV

SEQ ID NO: 9264 - protein, 75 aa, Homo Sapiens
MGIPSPSAAPKKTSFGSLKDEDRIFTNLYGRHDWRLKGSLSRGDWYKTKEILLKGPDWILGEIKTSGLRGRGGAG

SEQ ID NO: 9265 - protein, 144 aa, Homo Sapiens
MKTGFSPTCTAAMTGGSLSRGDWYKTKEILLKGPDWILGEIKTSGLRGRGGAGFPTGLKWSFMNKPSDGRPKYLVVNADEGEPGTCKDREILRHDPHKLLEGCLVGGRAMGARAAYIYIRGEFYNEASNLQVAIREAYEAGLIG

SEQ ID NO: 9266 - protein, 455 aa, Homo Sapiens
MLATRRLLGWSLPARTAPKKTSFGSLKDEDRIFTNLYGRHDWRLKGSLSRGDWYKTKEILLKGPDWILGEIKTSGLRGRGGAGFPTGLKWSFMNKPSDGRPKYLVVNADEGEPGTCKDREILRHDPHKLLEGCLVGGRAMGARAAYIYIRGEFYNEASNLQVAIREAYEAGLIGKNACGSGYDFDVFVVRGAGAYICGEETALIESIEGKQGKPRLKPPFPADVGVFGCPTTVANVETVAVSPTICRRGGTWFAGFGRERNSGTKLFNISGHVNHPCTVEEEMSVPLKELIEKHAGGVTGGWDNLLAVIPGGSSTPLIPKSVCETVLMDFDALVQAQTGLGTAAVIVMDRSTDIVKAIARLIEFYKHESCGQCTPCREGVDWMNKVMARFVRGDARPAEIDSLWEISKQIEGHTICALGDGAAWPVQGLIRHFRPELEERMQRFAQQHQARQAAS

SEQ ID NO: 9267 - protein, 457 aa, Homo Sapiens
MLATRRLLGWSLPARVSTAPKKTSFGSLKDEDRIFTNLYGRHDWRLKGSLSRGDWYKTKEILLKGPDWILGEIKTSGLRGRGGAGFPTGLKWSFMNKPSDGRPKYLVVNADEGEPGTCKDREILRHDPHKLLEGCLVGGRAMGARAAYIYIRGEFYNEASNLQVAIREAYEAGLIGKNACGSGYDFDVFVVRGAGAYICGEETALIESIEGKQGKPRLKPPFPADVGVFGCPTTVANVETVAVSPTICRRGGTWFAGFGRERNSGTKLFNISGHVNHPCTVEEEMSVPLKELIEKHAGGVTGGWDNLLAVIPGGSSTPLIPKSVCETVLMDFDALVQAQTGLGTAAVIVMDRSTDIVKAIARLIEFYKHESCGQCTPCREGVDWMNKVMARFVRGDARPAEIDSLWEISKQIEGHTICALGDGAAWPVQGLIRHFRPELEERMQRFAQQHQARQAAS

SEQ ID NO: 9268 - protein, 178 aa, Homo Sapiens
MLATRRLLGWSLPARVSVRFSGDTDEDRIFTNLYGRHDWRLKGSLSRGDWYKTKEILLKGPDWILGEIKTSGLRGRGGAGFPTGLKWSFMNKPSDGRPKYLVVNADEGEPGTCKDREILRHDPHKLLEGCLVGGRAMGARAAYIYIRGEFYNEASNLQVAIREAYEAGLIGKNACGSG

SEQ ID NO: 9269 - protein, 43 aa, Homo Sapiens
MLATRRLLGWSLPARVSVRFSGDTSSAWRKFCRQHPRKPHLAR

SEQ ID NO: 9270 - protein, 178 aa, Homo Sapiens
MLATRRLLGWSLPARVSVRFSGDTTAPKKTSFGSLKDEDRIFTNLLKGSLSRGDWYKTKEILLKGPDWILGEIKTSGLRGRGGAGFPTGLKWSFMNKPSDGRPKYLVVNADEGEPGTCKDREILRHDPHKLLEGCLVGGRAMGARAAYIYIRGEFYNEASNLQVAIREAYEAGLIGKN

SEQ ID NO: 9271 - protein, 464 aa, Homo Sapiens
MLATRRLLGWSLPARVSVRFSGDTTAPKKTSFGSLKDEDRIFTNLYGRHDWRLKGSLSRGDWYKTKEILLKGPDWILGEIKTSGLRGRGGAGFPTGLKWSFMNKPSDGRPKYLVVNADEGEPGTCKDREILRHDPHKLLEGCLVGGRAMGARAAYIYIRGEFYNEASNLQVAIREAYEAGLIGKNACGSGYDFDVFVVRGAGAYICGEETALIESIEGKQGKPRLKPPFPADVGVFGCPTTVANVETVAVSPTICRRGGTWFAGFGRERNSGTKLFNISGHVNHPCTVEEEMSVPLKELIEKHAGGVTGGWDNLLAVIPGGSSTPLIPKSVCETVLMDFDALVQAQTGLGTAAVIVMDRSTDIVKAIARLIEFYKHESCGQCTPCREGVDWMNKVMARFVRGDARPAEIDSLWEISKQIEGHTICALGDGAAWPVQGLIRHFRPELEERMQRFAQQHQARQAAS

SEQ ID NO: 9272 - protein, 53 aa, Homo Sapiens
MNKPSDGRPKYLVVNADEGEPGTCKDREILRHDPHKLLEGCLVGGRAMGARAA

SEQ ID NO: 9273 - protein, 96 aa, Homo Sapiens
MNKPSDGRPKYLVVNADEGEPGTCKDREILRHDPHKLLEGCLVGGRAMGARAAYIYIRGEFYNEASNLQVAIREAYEAGLIGKNACGSGYDFDVFV

SEQ ID NO: 9274 - protein, 136 aa, Homo Sapiens
MNKPSDGRPKYLVVNADEGEPGTCKDREILRHDPHKLLEGCLVGGRAMGARAAYIYIRGEFYNEASNLQVAIREAYEAGLIGKNACGSGYDFDVFVVRGAGAYICGEETALIESIEGKQGKPRLKPPFPADVGKAW

SEQ ID NO: 9275 - protein, 363 aa, Homo Sapiens
MNKPSDGRPKYLVVNADEGEPGTCKDREILRHDPHKLLEGCLVGGRAMGARAAYIYIRGEFYNEASNLQVAIREAYEAGLIGKNACGSGYDFDVFVVRGAGAYICGEETALIESIEGKQGKPRLKPPFPADVGVFGCPTTVANVETVAVSPTICRRGGTWFAGFGRERNSGTKLFNISGHVNHPCTVEEEMSVPLKELIEKHAGGVTGGWDNLLAVIPGGSSTPLIPKSVCETVLMDFDALVQAQTGLGTAAVIVMDRSTDIVKAIARLIEFYKHESCGQCTPCREGVDWMNKVMARFVRGDARPAEIDSLWEISKQIEGHTICALGDGAAWPVQGLIRHFRPELEERMQRFAQQHQARQAAS

SEQ ID NO: 9276 - protein, 54 aa, Homo Sapiens
MACAGLLTVCLLRPPAPQPQPQTPRHPQLAPDPGPAGHTLFQDVFRRADKNALI

SEQ ID NO: 9277 - protein, 210 aa, Homo Sapiens
MACAGLLTVCLLRPPAPQPQPQTPRHPQLAPDPGPAGHTLFQDVFRRADKNDDGKLSFEEFQNYFADGVLSLGELQELFSGIDGHLTDNLETEKLCDYFSEHLGVYRPVLAALESLNRAVLAAMDATKLEYERASKVDQFVTRFLLRETVSQLQALQSSLEGASDTLEAQAHGWRCRERGGAEQALRQPAGRTPSPEECQPVIHLVPRLF

SEQ ID NO: 9278 - protein, 192 aa, Homo Sapiens
MACAGLLTVCLLRPPAPQPQPQTPRHPQLAPDPGPAGHTLFQDVFRRADKNDDGKLSFEEFQNYFADGVLSLGELQELFSGIDGHLTDNLETEKLCDYFSEHLGVYRPVLAALESLNRAVLAAMDATKLEYERASKVDQFVTRFLLRETVSQLQALQSSLEGASDTLEAQAHGWRLIPSWGPSPRPCEPHFL

SEQ ID NO: 9279 - protein, 362 aa, Homo Sapiens
MACAGLLTVCLLRPPAPQPQPQTPRHPQLAPDPGPAGHTLFQDVFRRADKNDDGKLSFEEFQNYFADGVLSLGELQELFSGIDGHLTDNLETEKLCDYFSEHLGVYRPVLAALESLNRAVLAAMDATKLEYERASKVDQFVTRFLLRETVSQLQALQSSLEGASDTLEAQAHGWRSDAESVEAQSRLCGSRRAGRRALRSVSRSSTWSPGSSDTGRSSEAEMQWRLQVNRLQELIDQLECKAPRLEPLREEDLAKGPDLHILMAQRQVQVAEEGLQDFHRALRCYVDFTGAQSHCLHVSAQKMLDGASFTLYEFWQDEASWRRHQQSPGSKAFQRILIDHLRAPDTLTTVFFPASWWIMNNN

SEQ ID NO: 9280 - protein, 289 aa, Homo Sapiens
MACAGLLTVCLLRPPAPQPQPQTPRHPQLAPDPGPAGHTLFQDVFRRADKNDDGKLSFEEFQNYFADGVLSLGELQELFSGIDGHLTDNLETEKLCDYFSEHLGVYRPVLAALESLNRAVLAAMDATKLEYERASKVDQFVTRFLLRETVSQLQALQSSLEGASDTLEAQAHGWRSDAESVEAQSRLCGSRRAGRRALRSVSRSSTWSPGSSDTGRSSEAEMQWRLQVNRLQELIDQLECKHILMAQRQVQVAEEGLQDFHRALRCYVDFTGAQSHCLHVSAQKMLDGA

SEQ ID NO: 9281 - protein, 297 aa, Homo Sapiens
MACAGLLTVCLLRPPAPQPQPQTPRHPQLAPDPGPAGHTLFQDVFRRADKNDDGKLSFEEFQNYFADGVLSLGELQELFSGIDGHLTDNLETEKLCDYFSEHLGVYRPVLAALESLNRAVLAAMDATKLEYERASKVDQFVTRFLLRETVSQLQALQSSLEGASDTLEAQAHGWRSDAESVEAQSRLCGSRRAGRRALRSVSRSSTWSPGSSDTGRSSEAEMQWRLQVNRLQELIDQLECKRQVQVAEEGLQDFHRALRCYVDFTGAQSHCLHVSAQKMLDGASFTLYEFWQDEASW

SEQ ID NO: 9282 - protein, 396 aa, Homo Sapiens
MACAGLLTVCLLRPPAPQPQPQTPRHPQLAPDPGPAGHTLFQDVFRRADKNDDGKLSFEEFQNYFADGVLSLGELQELFSGIDGHLTDNLETEKLCDYFSEHLGVYRPVLAALESLNRAVLAAMDATKLEYERASKVDQFVTRFLLRETVSQLQALQSSLEGASDTLEAQAHGWRSDAESVEAQSRLCGSRRAGRRALRSVSRSSTWSPGSSDTGRSSEAEMQWRLQVNRLQELIDQLECKVRAVGPGPHKGGPSWYPPEPGPCWRPGPHSVPSQAPRLEPLREEDLAKGPDLHILMAQRQVQVAEEGLQDFHRALRCYVDFTGAQSHCLHVSAQKMLDGASFTLYEFWQDEASWRRHQQSPGSKAFQRILIDHLRAPDTLTTVFFPASWWIMNNN

SEQ ID NO: 9283 - protein, 71 aa, Homo Sapiens
MACAGLLTVCLLRPPAPQPQPQTPRHPQLAPDPGPAGHTLFQDVFRRADKNELLCRWGSQPGGAAGTVQRH

SEQ ID NO: 9284 - protein, 126 aa, Homo Sapiens
MQWRLQVNRLQELIDQLECKAPRLEPLREEDLAKGPDLHILMAQRQVQVAEEGLQDFHRALRCYVDFTGAQSHCLHVSAQKMLDGASFTLYEFWQDEASWRRHQQSPGSKAFQRILIDHLRAPDTL

SEQ ID NO: 9285 - protein, 95 aa, Homo Sapiens
  misc_feature (1)..(1): Xaa can be any naturally occurring amino acid
XQNYFADGVLSLGELQELFSGIDGHLTDNLETEKLCDYFSEHLGVYRPVLAALESLNRAVLAAMDATKLVSGVADGGGSTVRQWASAVLWDPPQS

SEQ ID NO: 9286 - protein, 517 aa, Homo Sapiens
MARMGLAGAAGRWWGLALGLTAFFLPGVHSQVVQVNDSMYGFIGTDVVLHCSFANPLPSVKITQVTWQKSTNGSKQNVAIYNPSMGVSVLAPYRERVEFLRPSFTDGTIRLSRLELEDEGVYICEFATFPTGNRESQLNLTVMAKPTNWIEGTQAVLRAKKGQDDKVLVATCTSANGKPPSVVSWETRLKGEAEYQEIRNPNGTVTVISRYRLVPSREAHQQSLACIVNYHMDRFKESLTLNVQYEPEVTIEGFDGNWYLQRMDVKLTCKADANPPATEYHWTTLNGSLPKGVEAQNRTLFFKGPINYSLAGTYICEATNPIGTRSGQVEVNITEFPYTPSPPEHGRRAGPVPTAIIGGVAGSILLVLIVVGGIVVALRRRRHTFKGDYSTKKHVYGNGYSKAGIPQHHPPMAQNLQYPDDSDDEKKAGPLGGSSYEEEEEEEEGGGGGERKVGGPHPKYDEDAKRPYFTVDEAEARQDGYGDRTLGYQYDPEQLDLAENMVSQNDGSFISKKEWYV

SEQ ID NO: 9287 - protein, 458 aa, Homo Sapiens
MARMGLAGAAGRWWGLALGLTAFFLPGVHSQVVQVNDSMYGFIGTDVVLHCSFANPLPSVKITQVTWQKSTNGSKQNVAIYNPSMGVSVLAPYRERVEFLRPSFTDGTIRLSRLELEDEGVYICEFATFPTGNRESQLNLTVMAKPTNWIEGTQAVLRAKKGQDDKVLVATCTSANGKPPSVVSWETRLKGEAEYQEIRNPNGTVTVISRYRLVPSREAHQQSLACIVNYHMDRFKESLTLNVQYEPEVTIEGFDGNWYLQRMDVKLTCKADANPPATEYHWTTLNGSLPKGVEAQNRTLFFKGPINYSLAGTYICEATNPIGTRSGQVEVNITEKPRPQRGLGSAARLLAGTVAVFLILVAVLTVFFLYNRQQKSPPETDGAGTDQPLSQKPEPSPSRQSSLVPEDIQVVHLDPGRQQQQEEEDLQKLSLQPPYYDLGVSPSYHPSVRTTEPRGECP

SEQ ID NO: 9288 - protein, 352 aa, Homo Sapiens
MARMGLAGAAGRWWGLALGLTAFFLPGVHSQVVQVNDSMYGFIGTDVVLHCSFANPLPSVKITQVTWQKSTNGSKQNVAIYNPSMGVSVLAPYRERVEFLRPSFTDGTIRLSRLELEDEGVYICEFATFPTGNRESQLNLTVMAKPTNWIEGTQAVLRAKKGQDDKVLVATCTSANGKPPSVVSWETRLKGEAEYQEIRNPNGTVTVISRYRLVPSREAHQQSLACIVNYHMDRFKESLTLNVQYEPEVTIEGFDGNWYLQRMDVKLTCKADANPPATEYHWTTLNGSLPKGVEAQNRTLFFKGPINYSLAGTYICEATNPIGTRSGQVEVNITAFCQLIYPGKGRTRARMF

SEQ ID NO: 9289 - protein, 838 aa, Homo Sapiens
MPMDLILVVWFCVCTARTAEDMKPPVLSLIWRTRVLKSLLQQSLQGVVGFGMDPDLQMDIVTELDLVNTTLGVAQVSGMHNASKAFLFQDIEREIHAAPHVSEKLIQLFRNKSEFTILATVQQKPSTSGVILSIRELEHSYFELESSGLRDEIRYHYIHNGKPRTEALPYRMADGQWHKVALSVSASHLLLHVDCNRIYERVIDPPDTNLPPGINLWLGQRNQKHGLFKGIIQDGKIIFMPNGYITQCPNLNHTCPTCSDFLSLVQGIMDLQELLAKMTAKLNYAETRLSQLENCHCEKTCQVSGLLYRDQDSWVDGDHCRNCTCKSGAVECRRMSCPPLNCSPDSLPVHIAGQCCKVCRPKCIYGGKVLAEGQRILTKSCRECRGGVLVKITEMCPPLNCSEKDHILPENQCCRVCRGHNFCAEGPKCGENSECKNWNTKATCECKSGYISVQGDSAYCEDIDECAAKMHYCHANTVCVNLPGLYRCDCVPGYIRVDDFSCTEHDECGSGQHNCDENAICTNTVQGHSCTCKPGYVGNGTICRAFCEEGCRYGGTCVAPNKCVCPSGFTGSHCEKDIDECSEGIIECHNHSRCVNLPGWYHCECRSGFHDDGTYSLSGESCIDIDECALRTHTCWNDSACINLAGGFDCLCPSGPSCSGDCPHEGGLKHNGQVWTLKEDRCSVCSCKDGKIFCRRTACDCQNPSADLFCCPECDTRVTSQCLDQNGHKLYRSGDNWTHSCQQCRCLEGEVDCWPLTCPNLSCEYTAILEGECCPRCVSDPCLADNITYDIRKTCLDSYGVSRLSGSVWTMAGSPCTTCKCKNGRVCCSVDFECLQNN

SEQ ID NO: 9290 - protein, 753 aa, Homo Sapiens
MPMDLILVVWFCVCTARTVVGFGMDPDLQMDIVTELDLVNTTLGVAQVSGMHNASKAFLFQDIEREIHAAPHVSEKLIQLFRNKSEFTILATVQQKPSTSGVILSIRELEHRIYERVIDPPDTNLPPGINLWLGQRNQKHGLFKGIIQDGKIIFMPNGYITQCPNLNHTCPTCSDFLSLVQGIMDLQELLAKMTAKLNYAETRLSQLENCHCEKTCQVSGLLYRDQDSWVDGDHCRNCTCKSGAVECRRMSCPPLNCSPDSLPVHIAGQCCKVCRPKCIYGGKVLAEGQRILTKSCRECRGGVLVKITEMCPPLNCSEKDHILPENQCCRVCRGHNFCAEGPKCGENSECKNWNTKATCECKSGYISVQGDSAYCEDIDECAAKMHYCHANTVCVNLPGLYRCDCVPGYIRVDDFSCTEHDECGSGQHNCDENAICTNTVQGHSCTCKPGYVGNGTICRAFCEEGCRYGGTCVAPNKCVCPSGFTGSHCEKDIDECSEGIIECHNHSRCVNLPGWYHCECRSGFHDDGTYSLSGESCIDIDECALRTHTCWNDSACINLAGGFDCLCPSGPSCSGDCPHEGGLKHNGQVWTLKEDRCSVCSCKDGKIFCRRTACDCQNPSADLFCCPECDTRVTSQCLDQNGHKLYRSGDNWTHSCQQCRCLEGEVDCWPLTCPNLSCEYTAILEGECCPRCVSDPCLADNITYDIRKTCLDSYGVSRLSGSVWTMAGSPCTTCKCKNGRVCCSVDFECLQNN

SEQ ID NO: 9291 - protein, 810 aa, Homo Sapiens
MPMDLILVVWFCVCTARTVVGFGMDPDLQMDIVTELDLVNTTLGVAQVSGMHNASKAFLFQDIEREIHAAPHVSEKLIQLFRNKSEFTILATVQQKPSTSGVILSIRELEHSYFELESSGLRDEIRYHYIHNGKPRTEALPYRMADGQWHKVALSVSASHLLLHVDCNRIYERVIDPPDTNLPPGINLWLGQRNQKHGLFKGIIQDGKIIFMPNGYITQCPNLNHTCPTCSDFLSLVQGIMDLQELLAKMTAKLNYAETRLSQLENCHCEKTCQVSGLLYRDQDSWVDGDHCRNCTCKSGAVECRRMSCPPLNCSPDSLPVHIAGQCCKVCRPKCIYGGKVLAEGQRILTKSCRECRGGVLVKITEMCPPLNCSEKDHILPENQCCRVCRGHNFCAEGPKCGENSECKNWNTKATCECKSGYISVQGDSAYCEDIDECAAKMHYCHANTVCVNLPGLYRCDCVPGYIRVDDFSCTEHDECGSGQHNCDENAICTNTVQGHSCTCKPGYVGNGTICRAFCEEGCRYGGTCVAPNKCVCPSGFTGSHCEKDIDECSEGIIECHNHSRCVNLPGWYHCECRSGFHDDGTYSLSGESCIDIDECALRTHTCWNDSACINLAGGFDCLCPSGPSCSGDCPHEGGLKHNGQVWTLKEDRCSVCSCKDGKIFCRRTACDCQNPSADLFCCPECDTRVTSQCLDQNGHKLYRSGDNWTHSCQQCRCLEGEVDCWPLTCPNLSCEYTAILEGECCPRCVSDPCLADNITYDIRKTCLDSYGVSRLSGSVWTMAGSPCTTCKCKNGRVCCSVDFECLQNN

SEQ ID NO: 9292 - protein, 763 aa, Homo Sapiens
MPMDLILVVWFCVCTARTVVGFGMDPDLQMDIVTELDLVNTTLGVAQVSGMHNASKAFLFQDIEREIHAAPHVSEKLIQLFRNKSEFTILATVQQKPSTSGVILSIRELEHSYFELESSGLRDEIRYHYIHNGKPRTEALPYRMADGQWHKVALSVSASHLLLHVDCNRIYERVIDPPDTNLPPGINLWLGQRNQKHGLFKGIIQDGKIIFMPNGYITQCPNLNHTCPTCSDFLSLVQGIMDLQELLAKMTAKLNYAETRLSQLENCHCEKTCQVSGLLYRDQDSWVDGDHCRNCTCKSGAVECRRMSCPPLNCSPDSLPVHIAGQCCKVCRPKCIYGGKVLAEGQRILTKSCRECRGGVLVKITEMCPPLNCSEKDHILPENQCCRVCRGHNFCAEGPKCGENSECKNWNTKATCECKSGYISVQGDSAYCEDIDECAAKMHYCHANTVCVNLPGLYRCDCVPGYIRVDDFSCTEHDECGSGQHNCDENAICTNTVQGHSCTCKPGYVGNGTICRAFCEEGCRYGGTCVAPNKCVCPSGFTGSHCEKDIDECALRTHTCWNDSACINLAGGFDCLCPSGPSCSGDCPHEGGLKHNGQVWTLKEDRCSVCSCKDGKIFCRRTACDCQNPSADLFCCPECDTRVTSQCLDQNGHKLYRSGDNWTHSCQQCRCLEGEVDCWPLTCPNLSCEYTAILEGECCPRCVSDPCLADNITYDIRKTCLDSYGVSRLSGSVWTMAGSPCTTCKCKNGRVCCSVDFECLQNN

SEQ ID NO: 9293 - protein, 122 aa, Homo Sapiens
CPTCNDFHGLVQKIMELQDILAKTSAKLSRAEQRMNRLDQCYCERTCTMKGTTYREFESWIDGCKNCTCLNGTIQCETLICPNPDCPLKSALAYVDGKCCKECKCEHNFYDEYFLWKNKALY

SEQ ID NO: 9294 - protein, 166 aa, Homo Sapiens
MELFLFLSPTSYPSPVWGLGVDPSLQIDVLTELELGESTTGVRQVPGLHNGTKAFLFQDTPRSIKASTATAEQFFQKLRNKHEFTILVTLKQTHLNSGVILSIHHLDHRYLELESSGHRNEVRLHYRSGSHRPHTEVFPYILADDKWHKLSLAISASHLILHIDCN

SEQ ID NO: 9295 - protein, 22 aa, Homo Sapiens
MESRVLLRTFCLIFGLGAVWGL

SEQ ID NO: 9296 - protein, 112 aa, Homo Sapiens
MESRVLLRTFCLIFGLGAVWGLGVDPSLQIDVLTELELGESTTGVRQVPGLHNGTKAFLFQDTPRSIKASTATAEQFFQKLRNKHEFTILVTLKQTHLNSGVILSIHHLDHR

SEQ ID NO: 9297 - protein, 816 aa, Homo Sapiens
MESRVLLRTFCLIFGLGAVWGLGVDPSLQIDVLTELELGESTTGVRQVPGLHNGTKAFLFQDTPRSIKASTATAEQFFQKLRNKHEFTILVTLKQTHLNSGVILSIHHLDHRYLELESSGHRNEVRLHYRSGSHRPHTEVFPYILADDKWHKLSLAISASHLILHIDCNKIYERVVEKPSTDLPLGTTFWLGQRNNAHGYFKGIMQDVQLLVMPQGFIAQCPDLNRTCPTCNDFHGLVQKIMELQDILAKTSAKLSRAEQRMNRLDQCYCERTCTMKGTTYREFESWIDGCKNCTCLNGTIQCETLICPNPDCPLKSALAYVDGKCCKECKSICQFQGRTYFEGERNTVYSSSGVCVLYECKDQTMKLVESSGCPALDCPESHQITLSHSCCKVCKGYDFCSERHNCMENSICRNLNDRAVCSCRDGFRALREDNAYCEDIDECAEGRHYCRENTMCVNTPGSFMCICKTGYIRIDDYSCTEHDECITNQHNCDENALCFNTVGGHNCVCKPGYTGNGTTCKAFCKDGCRNGGACIAANVCACPQGFTGPSCETDIDECSDGFVQCDSRANCINLPGWYHCECRDGYHDNGMFSPSGESCEDIDECGTGRHSCANDTICFNLDGGYDCRCPHGKNCTGDCIHDGKVKHNGQIWVLENDRCSVCSCQNGFVMCRRMVCDCENPTVDLFCCPECDPRLSSQCLHQNGETLYNSGDTWVQNCQQCRCLQGEVDCWPLPCPDVECEFSILPENECCPRCVTDPCQADTIRNDITKTCLDEMNVVRFTGSSWIKHGTECTLCQCKNGHICCSVDPQCLQEL

SEQ ID NO: 9298 - protein, 816 aa, Homo Sapiens; identical to SEQ ID NO: 9297

SEQ ID NO: 9299 - protein, 321 aa, Homo Sapiens
MESRVLLRTFCLIFGLGAVWGLGVDPSLQIDVLTELELGESTTGVRQVPGLHNGTKAFLFQDTPRSIKASTATAEQFFQKLRNKHEFTILVTLKQTHLNSGVILSIHHLDHRYLELESSGHRNEVRLHYRSGSHRPHTEVFPYILADDKWHKLSLAISASHLILHIDCNKIYERVVEKPSTDLPLGTTFWLGQRNNAHGYFKGIMQDVQLLVMPQGFIAQCPDLNRTCPTCNDFHGLVQKIMELQDILAKTSAKLSRAEQRMNRLDQCYCERTCTMKGTTYREFESWIDGCKNCTCLNGTIQCETLICPNPDCPLKSALAY

SEQ ID NO: 9300 - protein, 110 aa, Homo Sapiens
METGLGAPLFKAWLLISVWGLGVDPSLQIDVLTELELGESTTGVRQVPGLHNGTKAFLFQDTPRSIKASTATAEQFFQKLRNKHEFTILVTLKQTHLNSGVILSIHHLDH

SEQ ID NO: 9301 - protein, 815 aa, Homo Sapiens
METGLGAPLFKAWLLISVWGLGVDPSLQIDVLTELELGESTTGVRQVPGLHNGTKAFLFQDTPRSIKASTATAEQFFQKLRNKHEFTILVTLKQTHLNSGVILSIHHLDHRYLELESSGHRNEVRLHYRSGSHRPHTEVFPYILADDKWHKLSLAISASHLILHIDCNKIYERVVEKPSTDLPLGTTFWLGQRNNAHGYFKGIMQDVQLLVMPQGFIAQCPDLNRTCPTCNDFHGLVQKIMELQDILAKTSAKLSRAEQRMNRLDQCYCERTCTMKGTTYREFESWIDGCKNCTCLNGTIQCETLICPNPDCPLKSALAYVDGKCCKECKSICQFQGRTYFEGERNTVYSSSGVCVLYECKDQTMKLVESSGCPALDCPESHQITLSHSCCKVCKGYDFCSERHNCMENSICRNLNDRAVCSCRDGFRALREDNAYCEDIDECAEGRHYCRENTMCVNTPGSFMCICKTGYIRIDDYSCTEHDECITNQHNCDENALCFNTVGGHNCVCKPGYTGNGTTCKAFCKDGCRNGGACIAANVCACPQGFTGPSCETDIDECSDGFVQCDSRANCINLPGWYHCECRDGYHDNGMFSPSGESCEDIDECGTGRHSCANDTICFNLDGGYDCRCPHGKNCTGDCIHDGKVKHNGQIWVLENDRCSVCSCQNGFVMCRRMVCDCENPTVDLFCCPECDPRLSSQCLHQNGETLYNSGDTWVQNCQQCRCLQGEVDCWPLPCPDVECEFSILPENECCPRCVTDPCQADTIRNDITKTCLDEMNVVRFTGSSWIKHGTECTLCQCKNGHICCSVDPQCLQEL

SEQ ID NO: 9302 - protein, 768 aa, Homo Sapiens
METGLGAPLFKAWLLISVWGLGVDPSLQIDVLTELELGESTTGVRQVPGLHNGTKAFLFQDTPRSIKASTATAEQFFQKLRNKHEFTILVTLKQTHLNSGVILSIHHLDHRYLELESSGHRNEVRLHYRSGSHRPHTEVFPYILADDKWHKLSLAISASHLILHIDCNKIYERVVEKPSTDLPLGTTFWLGQRNNAHGYFKGIMQDVQLLVMPQGFIAQCPDLNRTCPTCNDFHGLVQKIMELQDILAKTSAKLSRAEQRMNRLDQCYCERTCTMKGTTYREFESWIDGCKNCTCLNGTIQCETLICPNPDCPLKSALAYVDGKCCKECKSICQFQGRTYFEGERNTVYSSSGVCVLYECKDQTMKLVESSGCPALDCPESHQITLSHSCCKVCKGYDFCSERHNCMENSICRNLNDRAVCSCRDGFRALREDNAYCEDIDECAEGRHYCRENTMCVNTPGSFMCICKTGYIRIDDYSCTEHDECITNQHNCDENALCFNTVGGHNCVCKPGYTGNGTTCKAFCKDGCRNGGACIAANVCACPQGFTGPSCETDIDECGTGRHSCANDTICFNLDGGYDCRCPHGKNCTGDCIHDGKVKHNGQIWVLENDRCSVCSCQNGFVMCRRMVCDCENPTVDLFCCPECDPRLSSQCLHQNGETLYNSGDTWVQNCQQCRCLQGEVDCWPLPCPDVECEFSILPENECCPRCVTDPCQADTIRNDITKTCLDEMNVVRFTGSSWIKHGTECTLCQCKNGHICCSVDPQCLQEL

SEQ ID NO: 9303 - protein, 815 aa, Homo Sapiens; identical to SEQ ID NO: 9301

SEQ ID NO: 9304 - protein, 866 aa, Homo Sapiens
MGFPPLLKGQASATRSSLASCSWVVFFLSCLSRHAPEIEGGRRWTELIRTMESRVLLRTFCLIFGLGAVWGLGVDPSLQIDVLTELELGESTTGVRQVPGLHNGTKAFLFQDTPRSIKASTATAEQFFQKLRNKHEFTILVTLKQTHLNSGVILSIHHLDHRYLELESSGHRNEVRLHYRSGSHRPHTEVFPYILADDKWHKLSLAISASHLILHIDCNKIYERVVEKPSTDLPLGTTFWLGQRNNAHGYFKGIMQDVQLLVMPQGFIAQCPDLNRTCPTCNDFHGLVQKIMELQDILAKTSAKLSRAEQRMNRLDQCYCERTCTMKGTTYREFESWIDGCKNCTCLNGTIQCETLICPNPDCPLKSALAYVDGKCCKECKSICQFQGRTYFEGERNTVYSSSGVCVLYECKDQTMKLVESSGCPALDCPESHQITLSHSCCKVCKGYDFCSERHNCMENSICRNLNDRAVCSCRDGFRALREDNAYCEDIDECAEGRHYCRENTMCVNTPGSFMCICKTGYIRIDDYSCTEHDECITNQHNCDENALCFNTVGGHNCVCKPGYTGNGTTCKAFCKDGCRNGGACIAANVCACPQGFTGPSCETDIDECSDGFVQCDSRANCINLPGWYHCECRDGYHDNGMFSPSGESCEDIDECGTGRHSCANDTICFNLDGGYDCRCPHGKNCTGDCIHDGKVKHNGQIWVLENDRCSVCSCQNGFVMCRRMVCDCENPTVDLFCCPECDPRLSSQCLHQNGETLYNSGDTWVQNCQQCRCLQGEVDCWPLPCPDVECEFSILPENECCPRCVTDPCQADTIRNDITKTCLDEMNVVRFTGSSWIKHGTECTLCQCKNGHICCSVDPQCLQEL

SEQ ID NO: 9305 - protein, 839 aa, Homo Sapiens
MSIRRLLILILKIGRRWTELIRTMESRVLLRTFCLIFGLGAVWGLGVDPSLQIDVLTELELGESTTGVRQVPGLHNGTKAFLFQDTPRSIKASTATAEQFFQKLRNKHEFTILVTLKQTHLNSGVILSIHHLDHRYLELESSGHRNEVRLHYRSGSHRPHTEVFPYILADDKWHKLSLAISASHLILHIDCNKIYERVVEKPSTDLPLGTTFWLGQRNNAHGYFKGIMQDVQLLVMPQGFIAQCPDLNRTCPTCNDFHGLVQKIMELQDILAKTSAKLSRAEQRMNRLDQCYCERTCTMKGTTYREFESWIDGCKNCTCLNGTIQCETLICPNPDCPLKSALAYVDGKCCKECKSICQFQGRTYFEGERNTVYSSSGVCVLYECKDQTMKLVESSGCPALDCPESHQITLSHSCCKVCKGYDFCSERHNCMENSICRNLNDRAVCSCRDGFRALREDNAYCEDIDECAEGRHYCRENTMCVNTPGSFMCICKTGYIRIDDYSCTEHDECITNQHNCDENALCFNTVGGHNCVCKPGYTGNGTTCKAFCKDGCRNGGACIAANVCACPQGFTGPSCETDIDECSDGFVQCDSRANCINLPGWYHCECRDGYHDNGMFSPSGESCEDIDECGTGRHSCANDTICFNLDGGYDCRCPHGKNCTGDCIHDGKVKHNGQIWVLENDRCSVCSCQNGFVMCRRMVCDCENPTVDLFCCPECDPRLSSQCLHQNGETLYNSGDTWVQNCQQCRCLQGEVDCWPLPCPDVECEFSILPENECCPRCVTDPCQADTIRNDITKTCLDEMNVVRFTGSSWIKHGTECTLCQCKNGHICCSVDPQCLQEL

SEQ ID NO: 9306 - protein, 246 aa, Homo Sapiens
  misc_feature (1)..(1): Xaa can be any naturally occurring amino acid
XAKLSRAEQRMNRLDQCYCERTCTMKGTTYREFESWIDGCKNCTCLNGTIQCETLICPNPDCPLKSALAYVDGKCSICQFQGRTYFEGERNTVYSSSGVCVLYECKDQTMKLVESSGCPALDCPESHQITLSHSCCKVCKGYDFCSERHNCMENSICRNLNDRAVCSCRDGFRALREDNAYCEDIDECAEGRHYCRENTMCVNTPGSFMCICKTGYIRIDDYSCTEHDECITNQHNCDENALCFNT

SEQ ID NO: 9307 - protein, 86 aa, Homo Sapiens
  misc_feature (1)..(1): Xaa can be any naturally occurring amino acid
XDNGMFSPSGESCEDIDECGTGRHSCANDTICFNLDGGYDCRCPHGKNCTGDCIHDGKVKHNGQIWVLENDRCSVCSCQVGINEKL

SEQ ID NO: 9308 - protein, 172 aa, Homo Sapiens
MVGPAPRRRLRPLAALALVLALAPGLPTARAGQTPRPAERGPPVRLFTEEELARYGGEEEDQPIYLAVKGVVFDVTSGKEFYGRGAPYNALTGKDSTRGVAKMSLDPADLTHDTTGLTAKELEALDEVFTKVYKAKYPIVGYTARRILNEDGSPNLDFKPEDQPHFDIKDEF

SEQ ID NO: 9309 - protein, 533 aa, Homo Sapiens
MIHGRSVLHIVASLIILHLSGATKKGTEKQTTSETQKSVQCGTWTKHAEGGIFTSPNYPSKYPPDRECIYIIEAAPRQCIELYFDEKYSIEPSWECKFDHIEVRDGPFGFSPIIGRFCGQQNPPVIKSSGRFLWIKFFADGELESMGFSARYNFTPDPDFKDLGALKPLPACEFEMGGSEGIVESIQIMKEGKATASEAVDCKWYIRAPPRSKIYLRFLDYEMQNSNECKRNFVAVYDGSSSVEDLKAKFCSTVANDVMLRTGLGVIRMWADEGSRNSRFQMLFTSFQEPPCEGNTFFCHSNMCINNTLVCNGLQNCVYPWDENHCKEKRKTSLLDQLTNTSGTVIGVTSCIVIILIIISVIVQIKQPRKKYVQRKSDFDQTVFQEVFEPPHYELCTLRGTGATADFADVADDFENYHKLRRSSSKCIHDHHCGSQLSSTKGSRSNLSTRDASILTEMPTQPGKPLIPPMNRRNILVMKHSYSQDAADACDIDEIEEVPTTSHRLSRHDKAVQRFCLIGSLSKHESEYNTTRV

SEQ ID NO: 9310 - protein, 533 aa, Homo Sapiens; identical to SEQ ID NO: 9309

SEQ ID NO: 9311 - protein, 156 aa, Homo Sapiens
MLAEPFPKVVASLIILHLSGATKKGTEKQTTSETQKSVQCGTWTKHAEGGIFTSPNYPSKYPPDRECIYIIEAAPRQCIELYFDEKYSIEPSWECKFDHIEVRDGPFGFSPIIGRFCGQQNPPVIKSSGRFLWIKFFADGELESMGFSARYNFTPE

SEQ ID NO: 9312 - protein, 101 aa, Homo Sapiens
MSLYGFVASLIILHLSGATKKGTEKQTTSETQKSVQCGTWTKHAEGGIFTSPNYPSKYPPDRECIYIIEAAPRQCIELYFDEKYSIEPSWECKFDHIEVRD

SEQ ID NO: 9313 - protein, 1165 aa, Homo Sapiens
IEIPMDLTQPPTITKQSAKDHIVDPRDNILIECEAKGNPAPSFHWTRNSRFFNIAKDPRVSMRRRSGTLVIDFRSGGRPEEYEGEYQCFARNKFGTALSNRIRLQVSKSPLWPKENLDPVVVQEGAPLTLQCNPPPGLPSPVIFWMSSSMEPITQDKRVSQGHNGDLYFSNVMLQDMQTDYSCNARFHFTHTIQQKNPFTLKVLTNHPYNDSSLRNHPDMYSARGVAERTPSFMYPQGTASSQMVLRGMDLLLECIASGVPTPDIAWYKKGGDLPSDKAKFENFNKALRITNVSEEDSGEYFCLASNKMGSIRHTISVRVKAAPYWLDEPKNLILAPGEDGRLVCRANGNPKPTVQWMVNGEPLQSAPPNPNREVAGDTIIFRDTQISSRAVYQCNTSNEHGYLLANAFVSVLDVPPRMLSPRNQLIRVILYNRTRLDCPFFGSPIPTLRWFKNGQGSNLDGGNYHVYENGSLEIKMIRKEDQGIYTCVATNILGKAENQVRLEVKDPTRIYRMPEDQVARRGTTVQLECRVKHDPSLKLTVSWLKDDEPLYIGNRMKKEDDSLTIFGVAERDQGSYTCVASTELDQDLAKAYLTVLADQATPTNRLAALPKGRPDRPRDLELTDLAERSVRLTWIPGDANNSPITDYVVQFEEDQFQPGVWHDHSKYPGSVNSAVLRLSPYVNYQFRVIAINEVGSSHPSLPSERYRTSGAPPESNPGDVKGEGTRKNNMEITWTPMNATSAFGPNLRYIVKWRRRETREAWNNVTVWGSRYVVGQTPVYVPYEIRVQAENDFGKGPEPESVIGYSGEDYPRAAPTEVKVRVMNSTAISLQWNRVYSDTVQGQLREYRAYYWRESSLLKNLWVSQKRQQASFPGDRLRGVVSRLFPYSNYKLEMVVVNGRGDGPRSETKEFTTPEGVPSAPRRFRVRQPNLETINLEWDHPEHPNGIMIGYTLKYVAFNGTKVGKQIVENFSPNQTKFTVQRTDPVSRYRFTLSARTQVGSGEAVTEESPAPPNEATPTAAYTNNQADIATQGWFIGLMCAIALLVLILLIVCFIKRSRGGKYPVREKKDVPLGPEDPKEEDGSFDYSDEDNKPLQGSQTSLDGTIKQQESDDSLVDYGEGGEGQFNEDGSFIGQYTVKKDKEETEGNESSEATSPVNAIYSLA

SEQ ID NO: 9314 - protein, 1169 aa, Homo Sapiens
MARQPPPPWVHAAFLLCLLSLGGAIEIPMDLTQPPTITKQSAKDHIVDPRDNILIECEAKGNPAPSFHWTRNSRFFNIAKDPRVSMRRRSGTLVIDFRSGGRPEEYEGEYQCFARNKFGTALSNRIRLQVSKSPLWPKENLDPVVVQEGAPLTLQCNPPPGLPSPVIFWMSSSMEPITQDKRVSQGHNGDLYFSNVMLQDMQTDYSCNARFHFTHTIQQKNPFTLKVLTNHPYNDSSLRNHPDMYSARGVAERTPSFMYPQGTASSQMVLRGMDLLLECIASGVPTPDIAWYKKGGDLPSDKAKFENFNKALRITNVSEEDSGEYFCLASNKMGSIRHTISVRVKAAPYWLDEPKNLILAPGEDGRLVCRANGNPKPTVQWMVNGEPLQSAPPNPNREVAGDTIIFRDTQISSRAVYQCNTSNEHGYLLANAFVSVLDVPPRMLSPRNQLIRVILYNRTRLDCPFFGSPIPTLRWFKNGQGSNLDGGNYHVYENGSLEIKMIRKEDQGIYTCVATNILGKAENQVRLEVKDPTRIYRMPEDQVARRGTTVQLECRVKHDPSLKLTVSWLKDDEPLYIGNRMKKEDDSLTIFGVAERDQGSYTCVASTELDQDLAKAYLTVLGRPDRPRDLELTDLAERSVRLTWIPGDANNSPITDYVVQFEEDQFQPGVWHDHSKYPGSVNSAVLRLSPYVNYQFRVIAINEVGSSHPSLPSERYRTSGAPPESNPGDVKGEGTRKNNMEITWTPMNATSAFGPNLRYIVKWRRRETREAWNNVTVWGSRYVVGQTPVYVPYEIRVQAENDFGKGPEPESVIGYSGEDYPRAAPTEVKVRVMNSTAISLQWNRVYSDTVQGQLREYRAYYWRESSLLKNLWVSQKRQQASFPGDRLRGVVSRLFPYSNYKLEMVVVNGRGDGPRSETKEFTTPEGVPSAPRRFRVRQPNLETINLEWDHPEHPNGIMIGYTLKYVAFNGTKVGKQIVENFSPNQTKFTVQRTDPVSRYRFTLSARTQVGSGEAVTEESPAPPNEAYTNNQADIATQGWFIGLMCAIALLVLILLIVCFIKRSRGGKYPVREKKDVPLGPEDPKEEDGSFDYSDEDNKPLQGSQTSLDGTIKQQESDDSLVDYGEGGEGQFNEDGSFIGQYTVKKDKEETEGNESSEATSPVNAIYSLA

SEQ ID NO: 9315 - protein, 1174 aa, Homo Sapiens
MARQPPPPWVHAAFLLCLLSLGGAIEIPMDLTQPPTITKQSAKDHIVDPRDNILIECEAKGNPAPSFHWTRNSRFFNIAKDPRVSMRRRSGTLVIDFRSGGRPEEYEGEYQCFARNKFGTALSNRIRLQVSKSPLWPKENLDPVVVQEGAPLTLQCNPPPGLPSPVIFWMSSSMEPITQDKRVSQGHNGDLYFSNVMLQDMQTDYSCNARFHFTHTIQQKNPFTLKVLTNHPYNDSSLRNHPDMYSARGVAERTPSFMYPQGTASSQMVLRGMDLLLECIASGVPTPDIAWYKKGGDLPSDKAKFENFNKALRITNVSEEDSGEYFCLASNKMGSIRHTISVRVKAAPYWLDEPKNLILAPGEDGRLVCRANGNPKPTVQWMVNGEPLQSAPPNPNREVAGDTIIFRDTQISSRAVYQCNTSNEHGYLLANAFVSVLDVPPRMLSPRNQLIRVILYNRTRLDCPFFGSPIPTLRWFKNGQGSNLDGGNYHVYENGSLEIKMIRKEDQGIYTCVATNILGKAENQVRLEVKDPTRIYRMPEDQVARRGTTVQLECRVKHDPSLKLTVSWLKDDEPLYIGNRMKKEDDSLTIFGVAERDQGSYTCVASTELDQDLAKAYLTVLGRPDRPRDLELTDLAERSVRLTWIPGDANNSPITDYVVQFEEDQFQPGVWHDHSKYPGSVNSAVLRLSPYVNYQFRVIAINEVGSSHPSLPSERYRTSGAPPESNPGDVKGEGTRKNNMEITWTPMNATSAFGPNLRYIVKWRRRETREAWNNVTVWGSRYVVGQTPVYVPYEIRVQAENDFGKGPEPESVIGYSGEDYPRAAPTEVKVRVMNSTAISLQWNRVYSDTVQGQLREYRAYYWRESSLLKNLWVSQKRQQASFPGDRLRGVVSRLFPYSNYKLEMVVVNGRGDGPRSETKEFTTPEGVPSAPRRFRVRQPNLETINLEWDHPEHPNGIMIGYTLKYVAFNGTKVGKQIVENFSPNQTKFTVQRTDPVSRYRFTLSARTQVGSGEAVTEESPAPPNEATPTAAYTNNQADIATQGWFIGLMCAIALLVLILLIVCFIKRSRGGKYPVREKKDVPLGPEDPKEEDGSFDYSDEDNKPLQGSQTSLDGTIKQQESDDSLVDYGEGGEGQFNEDGSFIGQYTVKKDKEETEGNESSEATSPVNAIYSLA

SEQ ID NO: 9316 - protein, 1174 aa, Homo Sapiens; identical to SEQ ID NO: 9315

SEQ ID NO: 9317 - protein, 1169 aa, Homo Sapiens; identical to SEQ ID NO: 9314

SEQ ID NO: 9318 - protein, 1157 aa, Homo Sapiens
MARQPPPPWVHAAFLLCLLSLGGAIEIPMDLTQPPTITKQSAKDHIVDPRDNILIECEAKGNPAPSFHWTRNSRFFNIAKDPRVSMRRRSGTLVIDFRSGGRPEEYEGEYQCFARNKFGTALSNRIRLQVSKSPLWPKENLDPVVVQEGAPLTLQCNPPPGLPSPVIFWMSSSMEPITQDKRVSQGHNGDLYFSNVMLQDMQTDYSCNARFHFTHTIQQKNPFTLKVLTTRGVAERTPSFMYPQGTASSQMVLRGMDLLLECIASGVPTPDIAWYKKGGDLPSDKAKFENFNKALRITNVSEEDSGEYFCLASNKMGSIRHTISVRVKAAPYWLDEPKNLILAPGEDGRLVCRANGNPKPTVQWMVNGEPLQSAPPNPNREVAGDTIIFRDTQISSRAVYQCNTSNEHGYLLANAFVSVLDVPPRMLSPRNQLIRVILYNRTRLDCPFFGSPIPTLRWFKNGQGSNLDGGNYHVYENGSLEIKMIRKEDQGIYTCVATNILGKAENQVRLEVKDPTRIYRMPEDQVARRGTTVQLECRVKHDPSLKLTVSWLKDDEPLYIGNRMKKEDDSLTIFGVAERDQGSYTCVASTELDQDLAKAYLTVLGRPDRPRDLELTDLAERSVRLTWIPGDANNSPITDYVVQFEEDQFQPGVWHDHSKYPGSVNSAVLRLSPYVNYQFRVIAINEVGSSHPSLPSERYRTSGAPPESNPGDVKGEGTRKNNMEITWTPMNATSAFGPNLRYIVKWRRRETREAWNNVTVWGSRYVVGQTPVYVPYEIRVQAENDFGKGPEPESVIGYSGEDYPRAAPTEVKVRVMNSTAISLQWNRVYSDTVQGQLREYRAYYWRESSLLKNLWVSQKRQQASFPGDRLRGVVSRLFPYSNYKLEMVVVNGRGDGPRSETKEFTTPEGVPSAPRRFRVRQPNLETINLEWDHPEHPNGIMIGYTLKYVAFNGTKVGKQIVENFSPNQTKFTVQRTDPVSRYRFTLSARTQVGSGEAVTEESPAPPNEATPTAAYTNNQADIATQGWFIGLMCAIALLVLILLIVCFIKRSRGGKYPVREKKDVPLGPEDPKEEDGSFDYSDEDNKPLQGSQTSLDGTIKQQESDDSLVDYGEGGEGQFNEDGSFIGQYTVKKDKEETEGNESSEATSPVNAIYSLA

SEQ ID NO: 9319 - protein, 129 aa, Homo Sapiens
MARQPPPPWVHAAFLLCLLSLGGAIEIPMDPSIQNELTQPPTITKQSAKDHIVDPRDNILIECEAKGNPAPSFHWTRNSRFFNIAKDPRVSMRRRSGTLVIDFRSGGRPEEYEGEYQCFARNKFGTALS

SEQ ID NO: 9320 - protein, 486 aa, Homo Sapiens
MARQPPPPWVHAAFLLCLLSLGGAIEIPMDPSIQNELTQPPTITKQSAKDHIVDPRDNILIECEAKGNPAPSFHWTRNSRFFNIAKDPRVSMRRRSGTLVIDFRSGGRPEEYEGEYQCFARNKFGTALSNRIRLQVSKSPLWPKENLDPVVVQEGAPLTLQCNPPPGLPSPVIFWMSSSMEPITQDKRVSQGHNGDLYFSNVMLQDMQTDYSCNARFHFTHTIQQKNPFTLKVLTNHPYNDSSLRNHPDMYSARGVAERTPSFMYPQGTASSQMVLRGMDLLLECIASGVPTPDIAWYKKGGDLPSDKAKFENFNKALRITNVSEEDSGEYFCLASNKMGSIRHTISVRVKAAPYWLDEPKNLILAPGEDGRLVCRANGNPKPTVQWMVNGEPLQSAPPNPNREVAGDTIIFRDTQISSRAVYQCNTSNEHGYLLANAFVSVLDVPPRMLSPRNQLIRVILYNRTRLDCPFFGSPIPTLRCPHGLS

SEQ ID NO: 9321 - protein, 1240 aa, Homo Sapiens
MARQPPPPWVHAAFLLCLLSLGGAIEIPMDPSIQNELTQPPTITKQSAKDHIVDPRDNILIECEAKGNPAPSFHWTRNSRFFNIAKDPRVSMRRRSGTLVIDFRSGGRPEEYEGEYQCFARNKFGTALSNRIRLQVSKSPLWPKENLDPVVVQEGAPLTLQCNPPPGLPSPVIFWMSSSMEPITQDKRVSQGHNGDLYFSNVMLQDMQTDYSCNARFHFTHTIQQKNPFTLKVLTTRGVAERTPSFMYPQGTASSQMVLRGMDLLLECIASGVPTPDIAWYKKGGDLPSDKAKFENFNKALRITNVSEEDSGEYFCLASNKMGSIRHTISVRVKAAPYWLDEPKNLILAPGEDGRLVCRANGNPKPTVQWMVNGEPLQSAPPNPNREVAGDTIIFRDTQISSRAVYQCNTSNEHGYLLANAFVSVLDVPPRMLSPRNQLIRVILYNRTRLDCPFFGSPIPTLRWFKNGQGSNLDGGNYHVYENGSLEIKMIRKEDQGIYTCVATNILGKAENQVRLEVKDPTRIYRMPEDQVARRGTTVQLECRVKHDPSLKLTVSWLKDDEPLYIGNRMKKEDDSLTIFGVAERDQGSYTCVASTELDQDLAKAYLTVLADQATPTNRLAALPKGRPDRPRDLELTDLAERSVRLTWIPGDANNSPITDYVVQFEEDQFQPGVWHDHSKYPGSVNSAVLRLSPYVNYQFRVIAINEVGSSHPSLPSERYRTSGAPPESNPGDVKGEGTRKNNMEITWTPMNATSAFGPNLRYIVKWRRRETREAWNNVTVWGSRYVVGQTPVYVPYEIRVQAENDFGKGPEPESVIGYSGEDLPSAPRRFRVRQPNLETINLEWDHPEHPNGIMIGYTLKYVAFNGTKVGKQIVENFSPNQTKFTVQRTDPVSRYRFTLSARTQVGSGEAVTEESPAPPNEATPTAAPPTLPPTTVGATGAVSSTDATAIAATTEATTVPIIPTVAPTTIATTTTVATTTTTTAAATTTTESPPTTTSGTKIHESAPDEQSIWNVTVLPNSKWANITWKHNFGPGTDFVVEYIDSNHTKKTVPVKAQAQPIQLTDLYPGMTYTLRVYSRDNEGISSTVITFMTSTAYTNNQADIATQGWFIGLMCAIALLVLILLIVCFIKRSRGGKYPVREKKDVPLGPEDPKEEDGSFDYSDEDNKPLQGSQTSLDGTIKQQESDDSLVDYGEGGEGQFNEDGSFIGQYTVKKDKEETEGNESSEATSPVNAIYSLA

SEQ ID NO: 9322 - protein, 1240 aa, Homo Sapiens; identical to SEQ ID NO: 9321

SEQ ID NO: 9323 - protein, 619 aa, Homo Sapiens
MARQPPPPWVHAAFLLCLLSLGGAIEIPMDPSIQNELTQPPTITKQSAKDHIVDPRDNILIECEAKGNPAPSFHWTRNSRFFNIAKDPRVSMRRRSGTLVIDFRSGGRPEEYEGEYQCFARNKFGTALSNRIRLQVSKSPLWPKENLDPVVVQEGAPLTLQCNPPPGLPSPVIFWMSSSMEPITQDKRVSQGHNGDLYFSNVMLQDMQTDYSCNARFHFTHTIQQKNPFTLKVLTTRGVAERTPSFMYPQGTASSQMVLRGMDLLLECIASGVPTPDIAWYKKGGDLPSDKAKFENFNKALRITNVSEEDSGEYFCLASNKMGSIRHTISVRVKAAPYWLDEPKNLILAPGEDGRLVCRANGNPKPTVQWMVNGEPLQSAPPNPNREVAGDTIIFRDTQISSRAVYQCNTSNEHGYLLANAFVSVLDVPPRMLSPRNQLIRVILYNRTRLDCPFFGSPIPTLRWFKNGQGSNLDGGNYHVYENGSLEIKMIRKEDQGIYTCVATNILGKAENQVRLEVKDPTRIYRMPEDQVARRGTTVQLECRVKHDPSLKLTVSWLKDDEPLYIGNRMKKEDDSLTIFGVAERDQGSYTCVASTELDQDLAKAYLTVLGNCPCSPWH

SEQ ID NO: 9324 - protein, 218 aa, Homo Sapiens
PPTTVGATGAVSSTDATAIAATTEATTVPIIPTVAPTTIATTTTVATTTTTTAAATTTTESPPTTTSGTKIHESAYTNNQADIATQGWFIGLMCAIALLVLILLIVCFIKRSRGGKYPVREKKDVPLGPEDPKEEDGSFDYSDEDNKPLQGSQTSLDGTIKQQESDDSLVDYGEGGEGQFNEDGSFIGQYTVKKDKEETEGNESSEATSPVNAIYSLA

SEQ ID NO: 9325 - protein, 237 aa, Homo Sapiens
  misc_feature (1)..(1): Xaa can be any naturally occurring amino acid
XENFSPNQTKFTVQRTDPVSRYRFTLSARTQVGSGEAVTEESPAPPNEATPTAAPDEQSIWNVTVLPNSKWANITWKHNFGPGTDFVVEYIDSNHTKKTVPVKAQAQPIQLTDLYPGMTYTLRVYSRDNEGISSTVITFMTSTAYTNNQADIATQGWFIGLMCAIALLVLILLIVCFIKRSRGGKYPVREKKDVPLGPEDPKEEDGSFDYSDEDNKPLQGSQTSLDGTIKQQESDDS

SEQ ID NO: 9326 - protein, 298 aa, Homo Sapiens
  misc_feature (1)..(1): Xaa can be any naturally occurring amino acid
XRETREAWNNVTVWGSRYVVGQTPVYVPYEIRVQAENDFGKGPEPESVIGYSGEDLPSAPRRFRVRQPNLETINLEWDHPEHPNGIMIGYTLKYVAFNGTKVGKQIVENFSPNQTKFTVQRTDPVSRYRFTLSARTQVGSGEAVTEESPAPPNEAYTNNQADIATQGWFIGLMCAIALLVLILLIVCFIKRSRGGKYPVREKKDVPLGPEDPKEEDGSFDYSDEDNKPLQGSQTSLDGTIKQQESDDSLVDYGEGGEGQFNEDGSFIGQYTVKKDKEETEGNESSEATSPVNAIYSLA

SEQ ID NO: 9327 - protein, 1041 aa, Homo Sapiens
  misc_feature (1)..(1): Xaa can be any naturally occurring amino acid
XSIQNELTQPPTITKQSAKDHIVDPRDNILIECEAKGNPAPSFHWTRNSRFFNIAKDPRVSMRRRSGTLVIDFRSGGRPEEYEGEYQCFARNKFGTALSNRIRLQVSKSPLWPKENLDPVVVQEGAPLTLQCNPPPGLPSPVIFWMSSSMEPITQDKRVSQGHNGDLYFSNVMLQDMQTDYSCNARFHFTHTIQQKNPFTLKVLTTRGVAERTPSFMYPQGTASSQMVLRGMDLLLECIASGVPTPDIAWYKKGGDLPSDKAKFENFNKALRITNVSEEDSGEYFCLASNKMGSIRHTISVRVKAAPYWLDEPKNLILAPGEDGRLVCRANGNPKPTVQWMVNGEPLQSAPPNPNREVAGDTIIFRDTQISSRAVYQCNTSNEHGYLLANAFVSVLDVPPRMLSPRNQLIRVILYNRTRLDCPFFGSPIPTLRWFKNGQGSNLDGGNYHVYENGSLEIKMIRKEDQGIYTCVATNILGKAENQVRLEVKDPTRIYRMPEDQVARRGTTVQLECRVKHDPSLKLTVSWLKDDEPLYIGNRMKKEDDSLTIFGVAERDQGSYTCVASTELDQDLAKAYLTVLADQATPTNRLAALPKGRPDRPRDLELTDLAERSVRLTWIPGDANNSPITDYVVQFEEDQFQPGVWHDHSKYPGSVNSAVLRLSPYVNYQFRVIAINEVGSSHPSLPSERYRTSGAPPESNPGDVKGEGTRKNNMEITWTPMNATSAFGPNLRYIVKWRRRETREAWNNVTVWGSRYVVGQTPVYVPYEIRVQAENDFGKGPEPESVIGYSGEDLPSAPRRFRVRQPNLETINLEWDHPEHPNGIMIGYTLKYVAFNGTKVGKQIVENFSPNQTKFTVQRTDPVSRYRFTLSARTQVGSGEAVTEESPAPPNEATPTAAYTNNQADIATQGWFIGLMCAIALLVLILLIVCFIKRSRGGKYPVREKKDVPLGPEDPKEEDGSFDYSDEDNKPLQGSQTSLDGTIKQQESDDSLVDYGEGGEGQFNEDGSFIGQYTVKKDKEETEGNESSEATSPVNAIYSLA

SEQ ID NO: 9328 - protein, 573 aa, Homo Sapiens
MGWESHLTAASADIDLGAGREVFDYSHRQKEQDVEKELRDGGEQDTWAGEGAEALARNLLVDGETGESFPAQFPADISSITEAVPSESEPPALQNNLLSPLLTGTESPFDLEQQWQDLMSIMEMQAMEVNTSASEILYSAPPGDPLSTNYSLAPNTPINQNVSLHQASLGGCSQDFLLFSPEVESLPVASSSTLLPLAPSNSTSLNSTFGSTNLTGLFFPPQLNGTANDTAGPELPDPLGGLLDEAMLDEISLMDLAIEEGFNPVQASQLEEEFDSDSGLSLDSSHSPSSLSSSEGSSSSSSSSSSSSSSASSSASSSFSEEGAVGYSSDSETLDLEEAEGAVGYQPEYSKFCRMSYQDPAQLSCLPYLEHVGHNHTYNMAPSALDSADLPPPSALKKGSKEKQADFLDKQMSRDEHRARAMKIPFTNDKIINLPVEEFNELLSKYQLSEAQLSLIRDIRRRGKNKMAAQNCRKRKLDTILNLERDVEDLQRDKARLLREKVEFLRSLRQMKQKVQSLYQEVFGRLRDENGRPYSPSQYALQYAGDGSVLLIPRTMADQQARRQERKPKDRRK

SEQ ID NO: 9329 - protein, 584 aa, Homo Sapiens
MGWESHLTAASADIDLIDILWRQDIDLGAGREVFDYSHRQKEQDVEKELRDGGEQDTWAGEGAEALARNLLVDGETGESFPAQFPADISSITEAVPSESEPPALQNNLLSPLLTGTESPFDLEQQWQDLMSIMEMQAMEVNTSASEILYSAPPGDPLSTNYSLAPNTPINQNVSLHQASLGGCSQDFLLFSPEVESLPVASSSTLLPLAPSNSTSLNSTFGSTNLTGLFFPPQLNGTANDTAGPELPDPLGGLLDEAMLDEISLMDLAIEEGFNPVQASQLEEEFDSDSGLSLDSSHSPSSLSSSEGSSSSSSSSSSSSSSASSSASSSFSEEGAVGYSSDSETLDLEEAEGAVGYQPEYSKFCRMSYQDPAQLSCLPYLEHVGHNHTYNMAPSALDSADLPPPSALKKGSKEKQADFLDKQMSRDEHRARAMKIPFTNDKIINLPVEEFNELLSKYQLSEAQLSLIRDIRRRGKNKMAAQNCRKRKLDTILNLERDVEDLQRDKARLLREKVEFLRSLRQMKQKVQSLYQEVFGRLRDENGRPYSPSQYALQYAGDGSVLLIPRTMADQQARRQERKPKDRRK

SEQ ID NO: 9330 - protein, 4 aa, Homo Sapiens
MLSL

SEQ ID NO: 9331 - protein, 9 aa, Homo Sapiens
MLSLKKYLT

SEQ ID NO: 9332 - protein, 83 aa, Homo Sapiens
MLSLKKYLTEGLLQFTILLSLIGVRVDVDTYLTSQLPPLREIILGPSSAYTQTQFHNLRNTLDGYGIHPKSIDLDNYFTARRL

SEQ ID NO: 9333 - protein, 99 aa, Homo Sapiens
MLSLKKYLTEGLLQFTILLSLIGVRVDVDTYLTSQLPPLREIILGPSSAYTQTQFHNLRNTLDGYGIHPKSIDLDNYFTARRLLSQVRALDRFQVPTTE

SEQ ID NO: 9334 - protein, 761 aa, Homo Sapiens
MLSLKKYLTEGLLQFTILLSLIGVRVDVDTYLTSQLPPLREIILGPSSAYTQTQFHNLRNTLDGYGIHPKSIDLDNYFTARRLLSQVRALDRFQVPTTEVNAWLVHRDPEGSVSGSQPNSGLALESSSGLQDVTGPDNGVRESETEQGFGEDLEDLGAVAPPVSGDLTKEDIDLGAGREVFDYSHRQKEQDVEKELRDGGEQDTWAGEGAEALARNLLVDGETGESFPAQVPSGEDQTALSLEECLRLLEATCPFGENAEFPADISSITEAVPSESEPPALQNNLLSPLLTGTESPFDLEQQWQDLMSIMEMQAMEVNTSASEILYSAPPGDPLSTNYSLAPNTPINQNVSLHQASLGGCSQDFLLFSPEVESLPVASSSTLLPLAPSNSTSLNSTFGSTNLTGLFFPPQLNGTANDTAGPELPDPLGGLLDEAMLDEISLMDLAIEEGFNPVQASQLEEEFDSDSGLSLDSSHSPSSLSSSEGSSSSSSSSSSSSSSASSSASSSFSEEGAVGYSSDSETLDLEEAEGAVGYQPEYSKFCRMSYQDPAQLSCLPYLEHVGHNHTYNMAPSALDSADLPPPSALKKGSKEKQADFLDKQMSRDEHRARAMKIPFTNDKIINLPVEEFNELLSKYQLSEAQLSLIRDIRRRGKNKMAAQNCRKRKLDTILNLERDVEDLQRDKARLLREKVEFLRSLRQMKQKVQSLYQEVFGRLRDENGRPYSPSQYALQYAGDGSVLLIPRTMADQQARRQERKPKDRRK

SEQ ID NO: 9335 - protein, 742 aa, Homo Sapiens
MLSLKKYLTEGLLQFTILLSLIGVRVDVDTYLTSQLPPLREIILGPSSAYTQTQFHNLRNTLDGYGIHPKSIDLDNYFTARRLLSQVRALDRFQVPTTEVNAWLVHRDPEGSVSGSQPNSGLALESSSGLQDVTGPDNGVRESETEQGFGEDLEDLGAVAPPVSGDLTKEDIDLIDILWRQDIDLGAGREVFDYSHRQKEQDVEKELRDGGEQDTWAGEGAEALARNLLVDGETGESFPAQFPADISSITEAVPSESEPPALQNNLLSPLLTGTESPFDLEQQWQDLMSIMEMQAMEVNTSASEILYSAPPGDPLSTNYSLAPNTPINQNVSLHQASLGGCSQDFLLFSPEVESLPVASSSTLLPLAPSNSTSLNSTFGSTNLTGLFFPPQLNGTANDTAGPELPDPLGGLLDEAMLDEISLMDLAIEEGFNPVQASQLEEEFDSDSGLSLDSSHSPSSLSSSEGSSSSSSSSSSSSSSASSSASSSFSEEGAVGYSSDSETLDLEEAEGAVGYQPEYSKFCRMSYQDPAQLSCLPYLEHVGHNHTYNMAPSALDSADLPPPSALKKGSKEKQADFLDKQMSRDEHRARAMKIPFTNDKIINLPVEEFNELLSKYQLSEAQLSLIRDIRRRGKNKMAAQNCRKRKLDTILNLERDVEDLQRDKARLLREKVEFLRSLRQMKQKVQSLYQEVFGRLRDENGRPYSPSQYALQYAGDGSVLLIPRTMADQQARRQERKPKDRRK

SEQ ID NO: 9336 - protein, 742 aa, Homo Sapiens; identical to SEQ ID NO: 9335

SEQ ID NO: 9337 - protein, 772 aa, Homo Sapiens
MLSLKKYLTEGLLQFTILLSLIGVRVDVDTYLTSQLPPLREIILGPSSAYTQTQFHNLRNTLDGYGIHPKSIDLDNYFTARRLLSQVRALDRFQVPTTEVNAWLVHRDPEGSVSGSQPNSGLALESSSGLQDVTGPDNGVRESETEQGFGEDLEDLGAVAPPVSGDLTKEDIDLIDILWRQDIDLGAGREVFDYSHRQKEQDVEKELRDGGEQDTWAGEGAEALARNLLVDGETGESFPAQVPSGEDQTALSLEECLRLLEATCPFGENAEFPADISSITEAVPSESEPPALQNNLLSPLLTGTESPFDLEQQWQDLMSIMEMQAMEVNTSASEILYSAPPGDPLSTNYSLAPNTPINQNVSLHQASLGGCSQDFLLFSPEVESLPVASSSTLLPLAPSNSTSLNSTFGSTNLTGLFFPPQLNGTANDTAGPELPDPLGGLLDEAMLDEISLMDLAIEEGFNPVQASQLEEEFDSDSGLSLDSSHSPSSLSSSEGSSSSSSSSSSSSSSASSSASSSFSEEGAVGYSSDSETLDLEEAEGAVGYQPEYSKFCRMSYQDPAQLSCLPYLEHVGHNHTYNMAPSALDSADLPPPSALKKGSKEKQADFLDKQMSRDEHRARAMKIPFTNDKIINLPVEEFNELLSKYQLSEAQLSLIRDIRRRGKNKMAAQNCRKRKLDTILNLERDVEDLQRDKARLLREKVEFLRSLRQMKQKVQSLYQEVFGRLRDENGRPYSPSQYALQYAGDGSVLLIPRTMADQQARRQERKPKDRRK

SEQ ID NO: 9338 - protein, 19 aa, Homo Sapiens
MSIMEMQAMEVNTSASEIL

SEQ ID NO: 9339 - protein, 23 aa, Homo Sapiens
MSIMEMQAMEVNTSASEILYSAP

SEQ ID NO: 9340 - protein, 47 aa, Homo Sapiens
MSIMEMQAMEVNTSASEILYSAPPGDPLSTNYSLAPNTPINQNVSLH

SEQ ID NO: 9341 - protein, 63 aa, Homo Sapiens
MSIMEMQAMEVNTSASEILYSAPPGDPLSTNYSLAPNTPINQNVSLHQASLGGCSQDFLLFSP

SEQ ID NO: 9342 - protein, 161 aa, Homo Sapiens
MTRLDRSSHSGGGHAKGSRPLNSLLAGHRVAQPASAPGSRASVQDIDLGAGREVFDYSHRQKEQDVEKELRDGGEQDTWAGEGAEALARNLLVDGETGESFPAQFPADISSITEAVPSESEPPALQNNLLSPLLTGTESPFDLEQQWQDLMSIMEMQAMEV

SEQ ID NO: 9343 - protein, 63 aa, Homo Sapiens
MTRLDRSSHSGGGHAKGSRPLNSLLAGHRVAQPASAPGSRASVQDIDLIDILWRQDIDLGAGR

SEQ ID NO: 9344 - protein, 111 aa, Homo Sapiens
MTRLDRSSHSGGGHAKGSRPLNSLLAGHRVAQPASAPGSRASVQDIDLIDILWRQDIDLGAGREVFDYSHRQKEQDVEKELRDGGEQDTWAGEGAEALARNLLVDGETGES

SEQ ID NO: 9345 - protein, 616 aa, Homo Sapiens
MTRLDRSSHSGGGHAKGSRPLNSLLAGHRVAQPASAPGSRASVQDIDLIDILWRQDIDLGAGREVFDYSHRQKEQDVEKELRDGGEQDTWAGEGAEALARNLLVDGETGESFPAQFPADISSITEAVPSESEPPALQNNLLSPLLTGTESPFDLEQQWQDLMSIMEMQAMEVNTSASEILYSAPPGDPLSTNYSLAPNTPINQNVSLHQASLGGCSQDFLLFSPEVESLPVASSSTLLPLAPSNSTSLNSTFGSTNLTGLFFPPQLNGTANDTAGPELPDPLGGLLDEAMLDEISLMDLAIEEGFNPVQASQLEEEFDSDSGLSLDSSHSPSSLSSSEGSSSSSSSSSSSSSSASSSASSSFSEEGAVGYSSDSETLDLEEAEGAVGYQPEYSKFCRMSYQDPAQLSCLPYLEHVGHNHTYNMAPSALDSADLPPPSALKKGSKEKQADFLDKQMSRDEHRARAMKIPFTNDKIINLPVEEFNELLSKYQLSEAQLSLIRDIRRRGKNKMAAQNCRKRKLDTILNLERDVEDLQRDKARLLREKVEFLRSLRQMKQKVQSLYQEVFGRLRDENGRPYSPSQYALQYAGDGSVLLIPRTMADQQARRQERKPKDRRK

SEQ ID NO: 9346 - protein, 133 aa, Homo Sapiens
SEEGAVGYSSDSETLDLEEAEGAVGYQPEYSKFCRMSYQDPAQLSCLPYLEHVGHNHTYNMAPSALDSADLPPPSALKKGSKEKQADFLDKQMSRDEHRARAMKIPFTNDKIINLPVEELCGAKADRGEGMDL

SEQ ID NO: 9347 - protein, 694 aa, Homo Sapiens
MKHLKRWWSAGGGLLHLTLLLSLAGLRVDLDLYLLLPPPTLLQDELLFLGGPASSAYALSPFSASGGWGRAGHLHPKGRELDPAAPPEGQLLREVRALGVPFVPRTSVDAWLVHSVAAGSADEAHGLLGAAAASSTGGAGASVDGGSQAVQGGGGDPRAARSGPLDAGEEEKAPAEPTAQVPDAGGCASEENGVLREKHEAVDHSSQHEENEERVSAQKENSLQQNDDDENKIAEKPDWEAEKTTESRNERHLNGTDTSFSLEDLFQLLSSQPENSLEGISLGDIPLPGSISDGMNSSAHYHVNFSQAISQDVNLHEAILLCPNNTFRRDPTARTSQSQEPFLQLNSHTTNPEQTLPGTNLTGFLSPVDNHMRNLTSQDLLYDLDINIFDEINLMSLATEDNFDPIDVSQLFDEPDSDSGLSLDSSHNNTSVIKSNSSHSVCDEGAIGYCTDHESSSHHDLEGAVGGYYPEPSKLCHLDQSDSDFHGDLTFQHVFHNHTYHLQPTAPESTSEPFPWPGKSQKIRSRYLEDTDRNLSRDEQRAKALHIPFSVDEIVGMPVDSFNSMLSRYYLTDLQVSLIRDIRRRGKNKVAAQNCRKRKLDIILNLEDDVCNLQAKKETLKREQAQCNKAINIMKQKLHDLYHDIFSRLRDDQGRPVNPNHYALQCTHDGSILIVPKELVASGHKKETQKGKRK

SEQ ID NO: 9348 - protein, 83 aa, Homo Sapiens
NEERVSAQKENSLQQNDDDENKIAEKPDWEAEKTTESRNERHLNGTDTSFSLEDLFQLLSSQPENSLEVIGTLAFILAGTYLH

SEQ ID NO: 9349 - protein, 238 aa, Homo Sapiens
MELLAAAFSAACAVDHDSSTSESDARDSAAGHLPGSESSSTPGNGATPEEWPALADSPTTLTEALRMIHPIPADSWRNLIEQIGLLYQEYRDKSTLQEIETRRQQDAEIEDNTNGSPASEDTPEEEEEEEEEEEPASPPERKTLPQICLLSNPHSRFNLWQDLPEIRSSGVLEILQPEEIKLQEAMFELVTSEASYYKSLNLLVSHFMENERIRKILHPSEAHILFSNVLDVLAVSER

SEQ ID NO: 9350 - protein, 618 aa, Homo Sapiens
MELLAAAFSAACAVDHDSSTSESDARDSAAGHLPGSESSSTPGNGATPEEWPALADSPTTLTEALRMIHPIPADSWRNLIEQIGLLYQEYRDKSTLQEIETRRQQDAEIEDNTNGSPASEDTPEEEEEEEEEEEPASPPERKTLPQICLLSNPHSRFNLWQDLPEIRSSGVLEILQPEEIKLQEAMFELVTSEASYYKSLNLLVSHFMENERIRKILHPSEAHILFSNVLDVLAVSERFLLELEHRMEENIVISDVCDIVYRYAADHFSVYITYVSNQTYQERTYKQLLQEKAAFRELIAQLELDPKCRGLPFSSFLILPFQRITRLKLLVQNILKRVEERSERECTALDAHKELEMVVKACNEGVRKMSRTEQMISIQKKMEFKIKSVPIISHSRWLLKQGELQQMSGPKTSRTLRTKKLFHEIYLFLFNDLLVICRQIPGDKYQVFDSAPRGLLRVEELEDQGQTLANVFILRLLENADDREATYMLKASSQSEMKRWMTSLAPNRRTKFVSFTSRLLDCPQVQCVHPYVAQQPDELTLELADILNILDKTDDGWIFGERLHDQERGWFPSSMTEEILNPKIRSQNLKECFRVHKMDDPQRSQNKDRRKLGSRNRQ

SEQ ID NO: 9351 - protein, 710 aa, Homo Sapiens
METRESEDLEKTRRKSASDQWNTDNEPAKVKPELLPEKEETSQADQDIQDKEPHCHIPIKRNSIFNRSIRRKSKAKARDNPERNASCLADSQDNGKSVNEPLTLNIPWSRMPPCRTAMQTDPGAQEMSESSSTPGNGATPEEWPALADSPTTLTEALRMIHPIPADSWRNLIEQIGLLYQEYRDKSTLQEIETRRQQDAEIEDNTNGSPASEDTPEEEEEEEEEEEPASPPERKTLPQICLLSNPHSRFNLWQDLPEIRSSGVLEILQPEEIKLQEAMFELVTSEASYYKSLNLLVSHFMENERIRKILHPSEAHILFSNVLDVLAVSERFLLELEHRMEENIVISDVCDIVYRYAADHFSVYITYVSNQTYQERTYKQLLQEKAAFRELIAQLELDPKCRGLPFSSFLILPFQRITRLKLLVQNILKRVEERSERECTALDAHKELEMVVKACNEGVRKMSRTEQMISIQKKMEFKIKSVPIISHSRWLLKQGELQQMSGPKTSRTLRTKKLFHEIYLFLFNDLLVICRQIPGDKYQVFDSAPRGLLRVEELEDQGQTLANVFILRLLENADDREATYMLKASSQSEMKRWMTSLAPNRRTKFVSFTSRLLDCPQVQCVHPYVAQQPDELTLELADILNILDKTDDGWIFGERLHDQERGWFPSSMTEEILNPKIRSQNLKECFRVHKMDDPQRSQNKDRRKLGSRNRQ

SEQ ID NO: 9352 - protein, 187 aa, Homo Sapiens
MFELVTSEASYYKSLNLLVSHFMENERIRKILHPSEAHILFSNVLDVLAVSERFLLELEHRMEENIVISDVCDIVYRYAADHFSVYITYVSNQTYQERTYKQLLQEKAAFRELIAQLELDPKCRGLPFSSFLILPFQRITRLKLLVQNILKRVEERSERECTALDAHKELEMVVKACNEGVRKMSRT

SEQ ID NO: 9353 - protein, 150 aa, Homo Sapiens
MVVKACNEGVRKMSRTEQMISIQKKMEFKIKSVPIISHSRWLLKQGELQQMSGPKTSRTLRTKKLFHEIYLFLFNDLLVICRQIPGDKYQVFDSAPRGLLRVEELEDQGQTLANVFILRLLENADDREATYMLKASSQSEMKRWMTSLAP

SEQ ID NO: 9354 - protein, 97 aa, Homo Sapiens
  misc_feature (1)..(1): Xaa can be any naturally occurring amino acid
XELLPEKEETSQADQDIQDKEPHCHIPIKRNSIFNRSIRRKSKAKARDNPERNASCLADSQDNGKSVNEPLTLNIPWSRMPPCRTAMQTDPGAQEMR

SEQ ID NO: 9355 - protein, 241 aa, Homo Sapiens
MSMLFYTLITAFLIGIQAEPHSESNVPAGHTIPQAHWTKLQHSLDTALRRARSAPAAAIAARVAGQTRNITVDPRLFKKRRLRSPRVLFSTQPPREAADTQDLDFEVGGAAPFNRTHRSKRSSSHPIFHRGEFSVCDSVSVWVGDKTTATDIKGKEVMVLGEVNINNSVFKQYFFETKCRDPNPVDSGCRGIDSKHWNSYCTTTHTFVKALTMDGKQAAWRFIRIDTACVCVLSRKAVRRA

SEQ ID NO: 9356 - protein, 633 aa, Homo Sapiens
AALGSSSGSASPAVAELCQNTPETFLEASKLLLTYADNILRNPNDEKYRSIRIGNTAFSTRLLPVRGAVECLFEMGFEEGETHLIFPKKASVEQLQKIRDLIAIERSSRLDGSNKSHKVKSSQQPAASTQLPTTPSSNPSGLNQHTRNRQGQSSDPPSASTVAADSAILEVLQSNIQHVLVYENPALQEKALACIPVQELKRKSQEKLSRARKLDKGINISDEDFLLLELLHWFKEEFFHWVNNVLCSKCGGQTRSRDRSLLPSDDELKWGAKEVEDHYCDACQFSNRFPRYNNPEKLLETRCGRCGEWANCFTLCCRAVGFEARYVWDYTELQRTLSLKLTTLKEIGKTFLRISKRQKLIQVVDVTWRYSCKHEEVIARRTKVKEALLRDTINGLNKQRQLFLSENRRKELLQRIIVELVEFISPKTPKPGELGGRISGSVAWRVARGEMGLQRKETLFIPCENEKISKQLHLCYNIVKDRYVRVSNNNQTISGWENGVWKMESIFRKVETDWHMVYLARKEGSSFAYISWKFECGSVGLKVDSISIRTSSQTFQTGTVEWKLRSDTAQVELTGDNSLHSYADFSGATEVILEAELSRGDGDVAWQHTQLFRQSLNDHEENCLEIIIKFSDL

SEQ ID NO: 9357 - protein, 654 aa, Homo Sapiens [sequence omitted]

SEQ ID NO: 9358 - protein, 558 aa, Homo Sapiens
MAAAALGSSSGSASPAVAELCQNTPETFLEASKLLLTYADNILRNPNDEKYRSIRIGNTAFSTRLLPVRGAVECLFEMGFEEGETHLIFPKKASVEQLQKIRDLIAIERSSRLDGSNKSHKVKSSQQPAASTQLPTTPSSNPSGLNQHTRNRQGQSSDPPSASTVAADSAILEVLQSNIQHVLVYENPALQEKALACIPVQELKRKSQEKLSRARKLDKGINISDEDFLLLELLHWFKEEFFHWVNNVLCSKCGGQTRSRDRSLLPSDDELKWGAKEVEDHYCDACQFSNRFPRYNNPEKLLETRCGRCGEWANCFTLCCRAVGFEARYVWDYTDHVWTEVYSPSQQRWLHCDACEDVCDKPLLYEIGWGKKLSYVIAFSKDEVVDVTWRYSCKHEEVIARRTKVKEALLRDTINGLNKQRQLFLSENRRKELLQRIIVELVEFISPKTPKPGELGGRISGSVAWRVARGEMGLQRKETLFIPCENEKISKQLHLCYNIVKDRYVRVSNNNQTISGWENGVWKMESIFRKVETDWHMITVFTPMLIFLVPLKLFWKQN

SEQ ID NO: 9359 - protein, 636 aa, Homo Sapiens
MAAAALGSSSGSASPAVAELCQNTPETFLEASKLLLTYADNILRNPNDEKYRSIRIGNTAFSTRLLPVRGAVECLFEMGFEEGETHLIFPKKASVEQLQKIRDLIAIERSSRLDGSNKSHKVKSSQQPAASTQLPTTPSSNPSGLNQHTRNRQGQSSDPPSASTVAADSAILEVLQSNIQHVLVYENPALQEKALACIPVQELKRKSQEKLSRARKLDKGINISDEDFLLLELLHWFKEEFFHWVNNVLCSKCGGQTRSRDRSLLPSDDELKWGAKEVEDHYCDACQFSNRFPRYNNPEKLLETRCGRCGEWANCFTLCCRAVGFEARYVWDYTELQRTLSLKLTTLKEIGKTFLRISKRQKLIQVVDVTWRYSCKHEEVIARRTKVKEALLRDTINGLNKQRQLFLSENRRKELLQRIIVELVEFISPKTPKPGELGGRISGSVAWRVARGEMGLQRKETLFIPCENEKISKQLHLCYNIVKDRYVRVSNNNQTISGWENGVWKMESIFRKVETDWHMVYLARKEGSSFAYISWKFECGSVGLKVDSISIRTSSQTFQTGTVEWKLRSDTAQVELTGDNSLHSYADFSGATEVILEAELSRGDGDVAWQHTQLFRQSLNDHEENCLEIIIKFSDL

SEQ ID NO: 9360 - protein, 114 aa, Homo Sapiens
MGFEEGETHLIFPKKASVEQLQKIRDLIAIERSSRLDGSNKSHKVKSSQQPAASTQLPTTPSSNPSGLNQHTRNRQGQSSDPPSASTVAADSAILEVLQSNIQHVLVYENPALQ

SEQ ID NO: 9361 - protein, 612 aa, Homo Sapiens
MRNPNDEKYRSIRIGNTAFSTRLLPVRGAVECLFEMGFEEGETHLIFPKKASVEQLQKIRDLIAIERSSRLDGSNKSHKVKSSQQPAASTQLPTTPSSNPSGLNQHTRNRQGQSSDPPSASTVAADSAILEVLQSNIQHVLVYENPALQEKALACIPVQELKRKSQEKLSRARKLDKGINISDEDFLLLELLHWFKEEFFHWVNNVLCSKCGGQTRSRDRSLLPSDDELKWGAKEVEDHYCDACQFSNRFPRYNNPEKLLETRCGRCGEWANCFTLCCRAVGFEARYVWDYTDHVWTEVYSPSQQRWLHCDACEDVCDKPLLYEIGWGKKLSYVIAFSKDEVVDVTWRYSCKHEEVIARRTKVKEALLRDTINGLNKQRQLFLSENRRKELLQRIIVELVEFISPKTPKPGELGGRISGSVAWRVARGEMGLQRKETLFIPCENEKISKQLHLCYNIVKDRYVRVSNNNQTISGWENGVWKMESIFRKVETDWHMVYLARKEGSSFAYISWKFECGSVGLKVDSISIRTSSQTFQTGTVEWKLRSDTAQVELTGDNSLHSYADFSGATEVILEAELSRGDGDVAWQHTQLFRQSLNDHEENCLEIIIKFSDL

SEQ ID NO: 9362 - protein, 240 aa, Homo Sapiens
  misc_feature (1)..(1): Xaa can be any naturally occurring amino acid
XSGSASPAVAELCQNTPETFLEASKLLLTYADNILRNPNDEKYRSIRIGNTAFSTRLLPVRGAVECLFEMGFEEGETHLIFPKKASVEQLQKIRDLIAIERSSRLDGSNKSHKVKSSQQPAASTQLPTTPSSNPSGLNQHTRNRQGQSSDPPSASTVAADSAILEVLQSNIQHVLVYENPALQEKALACIPVQELKRKSQEKLSRARKLDKDIITLRNFWKQDVDGVASGPIVLHCAAEL

SEQ ID NO: 9363 - protein, 23 aa, Homo Sapiens
EAPGAPPRTLTWEAMEQIRYLSS

SEQ ID NO: 9364 - protein, 291 aa, Homo Sapiens
MAVTLSLLLGGRVCAAVTRCGFATRGVAGPGPIGREPDPDSDWEPEERELQEVESTLKRQKQAIRFQKIRRQMEAPGAPPRTLTWEAMEQIRYLHEEFPESWSVPRLAEGFDVSTDVIRRVLKSKFLPTLEQKLKQDQKVLKKAGLAHSLQHLRGSGNTSKLLPAGHSVSGSLLMPGHEASSKDPNHSTALKVIESDTHRTNTPRRRKGRNKEIQDLEESFVPVAAPLGHPRELQKYSSDSESPRGTGSGALPSGQKLEELKAEEPDNFSSKVVQRGREFFDSNGNFLYRI

SEQ ID NO: 9365 - protein, 280 aa, Homo Sapiens
MARFWVCVAGAGFFLAFLVLHSRFCGSPVLRNFTFAVSWRTEKILYRLDVGWPKHPEYFTGTTFCVAVDSLNGLVYIGQRGDNIPKILVFTEDGYFLRAWNYTVDTPHGIFAASTLYEQSVWITDVGSDFMILWLHGENGTGPAKFNIPHSVTLDSAGRVWVADRGNKRIQVFDKDTGEWLGAWNNCFTEEGPSSVRFTPDGKYLIVAQLNLSRLSVVAAPPVGSIGECSVISTIQLADQVLPHLLEVDRKTGAVYVAEIGAKQVQKYVPLNSYVPSFGS

SEQ ID NO: 9366 - protein, 347 aa, Homo Sapiens
MARFWVCVAGAGFFLAFLVLHSRFCGSPVLRNFTFAVSWRTEKILYRLDVGWPKHPEYFTGTTFCVAVDSLNGLVYIGQRGDNIPKILVFTEDGYFLRAWNYTVDTPHGIFAASTLYEQSVWITDVGSGFFGHTVKKYSSFGDLVQVLGTPGKKGTSLNPLQFDNPAELYVEDTGDIYIVDGDGGLNNRLIKLSQDFMILWLHGENGTGPAKFNIPHSVTLDSAGRVWVADRGNKRIQVFDKDTGEWLGAWNNCFTEEGPSSVRFTPDGKYLIVAQLNLSRLSVVAAPPVGSIGECSVISTIQLADQVLPHLLEVDRKTGAVYVAEIGAKQVQKYVPLNSYVPSFGS

SEQ ID NO: 9367 - protein, 150 aa, Homo Sapiens
MILWLHGENGTGPAKFNIPHSVTLDSAGRVWVADRGNKRIQVFDKDTGEWLGAWNNCFTEEGPSSVRFTPDGKYLIVAQLNLSRLSVVAAPPVGSIGECSVISTIQLADQVLPHLLEVDRKTGAVYVAEIGAKQVQKYVPLNSYVPSFGS

SEQ ID NO: 9368 - protein, 1247 aa, Homo Sapiens
MLASSSRIRAAWTRALLLPLLLAGPVGCLSRQELFPFGPGQGDLELEDGDDFVSPALELSGALRFYDRSDIDAVYVTTNGIIATSEPPAKESHPGLFPPTFGAVAPFLADLDTTDGLGKVYYREDLSPSITQRAAECVHRGFPEISFQPSSAVVVTWESVAPYQGPSRDPDQKGKRNTFQAVLASSDSSSYAIFLYPEDGLQFHTTFSKKENNQVPAVVAFSQGSVGFLWKSNGAYNIFANDRESVENLAKSSNSGQQGVWVFEIGSPATTNGVVPADVILGTEDGAEYDDEDEDYDLATTRLGLEDVGTTPFSYKALRRGGADTYSVPSVLSPRRAATERPLGPPTERTRSFQLAVETFHQQHPQVIDVDEVEETGVVFSYNTDSRQTCANNRHQCSVHAECRDYATGFCCSCVAGYTGNGRQCVAEGSPQRVNGKVKGRIFVGSSQVPIVFENTDLHSYVVMNHGRSYTAISTIPETVGYSLLPLAPVGGIIGWMFAVEQDGFKNGFSITGGEFTRQAEVTFVGHPGNLVIKQRFSGIDEHGHLTIDTELEGRVPQIPFGSSVHIEPYTELYHYSTSVITSSSTREYTVTEPERDGASPSRIYTYQWRQTITFQECVHDDSRPALPSTQQLSVDSVFVLYNQEEKILRYALSNSIGPVREGSPDALQNPCYIGTHGCDTNAACRPGPRTQFTCECSIGFRGDGRTCYDIDECSEQPSVCGSHTICNNHPGTFRCECVEGYQFSDEGTCVAVVDQRPINYCETGLHNCDIPQRAQCIYTGGSSYTCSCLPGFSGDGQACQDVDECQPSRCHPDAFCYNTPGSFTCQCKPGYQGDGFRCVPGEVEKTRCQHEREHILGAAGATDPQRPIPPGLFVPECDAHGHYAPTQCHGSTGYCWCVDRDGREVEGTRTRPGMTPPCLSTVAPPIHQGPAVPTAVIPLPPGTHLLFAQTGKIERLPLEGNTMRKTEAKAFLHVPAKVIIGLAFDCVDKMVYWTDITEPSIGRASLHGGEPTTIIRQDLGSPEGIAVDHLGRNIFWTDSNLDRIEVAKLDGTQRRVLFETDLVNPRGIVTDSVRGNLYWTDWNRDNPKIETSYMDGTNRRILVQDDLGLPNGLTFDAFSSQLCWVDAGTNRAECLNPSQPSRRKALEGLQYPFAVTSYGKNLYFTDWKMNSVVALDLAISKETDAFQPHKQTRLYGITTALSQCPQGHNYCSVNNGGCTHLCLATPGSRTCRCPDNTLGVDCIEQK

SEQ ID NO: 9369 - protein, 1114 aa, Homo Sapiens
MLASSSRIRAAWTRALLLPLLLAGPVGCLSRQELFPFGPGQGDLELEDGDDFVSPALELSGALRFYDRSDIDAVYVTTNGIIATSEPPAKESHPGLFPPTFGAVAPFLADLDTTDGLGKVYYREDLSPSITQRAAECVHRGFPEISFQPSSAVVVTWESVAPYQGPSRDPDQKGKRNTFQAVLASSDSSSYAIFLYPEDGLQFHTTFSKKENNQVPAVVAFSQGSVGFLWKSNGAYNIFANDRESVENLAKSSNSGQQGVWVFEIGSPATTNGVVPADVILGTEDGAEYDDEDEDYDLATTRLGLEDVGTTPFSYKALRRGGADTYSVPSVLSPRRAATERPLGPPTERTRSFQLAVETFHQQHPQVIDVDEVEETGVVFSYNTDSRQTCANNRHQCSVHAECRDYATGFCCSCVAGYTGNGRQCVAEGSPQRVNGKVKGRIFVGSSQVPIVFENTDLHSYVVMNHGRSYTAISTIPETVGYSLLPLAPVGGIIGWMFAVEQDGFKNGFSITGGEFTRQAEVTFVGHPGNLVIKQRFSGIDEHGHLTIDTELEGRVPQIPFGSSVHIEPYTELYHYSTSVITSSSTREYTVTEPERDGASPSRIYTYQWRQTITFQECVHDDSRPALPSTQQLSVDSVFVLYNQEEKILRYALSNSIGPVREGSPDALQNPCYIGTHGCDTNAACRPGPRTQFTCECSIGFRGDGRTCYEVEKTRCQHEREHILGAAGATDPQRPIPPGLFVPECDAHGHYAPTQCHGSTGYCWCVDRDGREVEGTRTRPGMTPPCLSTVAPPIHQGPAVPTAVIPLPPGTHLLFAQTGKIERLPLEGNTMRKTEAKAFLHVPAKVIIGLAFDCVDKMVYWTDITEPSIGRASLHGGEPTTIIRQDLGSPEGIAVDHLGRNIFWTDSNLDRIEVAKLDGTQRRVLFETDLVNPRGIVTDSVRGNLYWTDWNRDNPKIETSYMDGTNRRILVQDDLGLPNGLTFDAFSSQLCWVDAGTNRAECLNPSQPSRRKALEGLQYPFAVTSYGKNLYFTDWKMNSVVALDLAISKETDAFQPHKQTRLYGITTALSQCPQGHNYCSVNNGGCTHLCLATPGSRTCRCPDNTLGVDCIEQK

SEQ ID NO: 9370 - protein, 1375 aa, Homo Sapiens
MEGDRVAGRPVLSSLPVLLLLPLLMLRAAALHPDELFPHGESWGDQLLQEGDDESSAVVKLANPLHFYEARFSNLYVGTNGIISTQDFPRETQYVDYDFPTDFPAIAPFLADIDTSHGRGRVLYREDTSPAVLGLAARYVRAGFPRSARFTPTHAFLATWEQVGAYEEVKRGALPSGELNTFQAVLASDGSDSYALFLYPANGLQFLGTRPKESYNVQLQLPARVGFCRGEADDLKSEGPYFSLTSTEQSVKNLYQLSNLGIPGVWAFHIGSTSPLDNVRPAAVGDLSAAHSSVPLGRSFSHATALESDYNEDNLDYYDVNEEEAEYLPGEPEEALNGHSSIDVSFQSKVDTKPLEESSTLDPHTKEGTSLGEVGGPDLKGQVEPWDERETRSPAPPEVDRDSLAPSWETPPPYPENGSIQPYPDGGPVPSEMDVPPAHPEEEIVLRSYPASGHTTPLSRGTYEVGLEDNIGSNTEVFTYNAANKETCEHNHRQCSRHAFCTDYATGFCCHCQSKFYGNGKHCLPEGAPHRVNGKVSGHLHVGHTPVHFTDVDLHAYIVGNDGRAYTAISHIPQPAAQALLPLTPIGGLFGWLFALEKPGSENGFSLAGAAFTHDMEVTFYPGEETVRITQTAEGLDPENYLSIKTNIQGQVPYVSANFTAHISPYKELYHYSDSTVTSTSSRDYSLTFGAINQTWSYRIHQNITYQVCRHAPRHPSFPTTQQLNVDRVFALYNDEERVLRFAVTNQIGPVKEDSDPTPGNPCYDGSHMCDTTARCHPGTGVDYTCECASGYQGDGRNCVDENECATGFHRCGPNSVCINLPGSYRCECRSGYEFADDRHTCILITPPANPCEDGSHTCAPAGQARCVHHGGSTFSCACLPGYAGDGHQCTDVDECSENRCHPAATCYNTPGSFSCRCQPGYYGDGFQCIPDSTSSLTPCEQQQRHAQAQYAYPGARFHIPQCDEQGNFLPLQCHGSTGFCWCVDPDGHEVPGTQTPPGSTPPHCGPSPEPTQRPPTICERWRENLLEHYGGTPRDDQYVPQCDDLGHFIPLQCHGKSDFCWCVDKDGREVQGTRSQPGTTPACIPTVAPPMVRPTPRPDVTPPSVGTFLLYTQGQQIGYLPLNGTRLQKDAAKTLLSLHGSIIVGIDYDCRERMVYWTDVAGRTISRAGLELGAEPETIVNSGLISPEGLAIDHIRRTMYWTDSVLDKIESALLDGSERKVLFYTDLVNPRAIAVDPIRGNLYWTDWNREAPKIETSSLDGENRRILINTDIGLPNGLTFDPFSKLLCWADAGTKKLECTLPDGTGRRVIQNNLKYPFSIVSYADHFYHTDWRRDGVVSVNKHSGQFTDEYLPEQRSHLYGITAVYPYCPTGRK

SEQ ID NO: 9371 - protein, 969 aa, Homo Sapiens
MEGDRVAGRPVLSSLPVLLLLPLLMLRAAALHPDELFPHGESWGDQLLQEGDDESSAVVKLANPLHFYEARFSNLYVGTNGIISTQDFPRETQYVDYDFPTDFPAIAPFLADIDTSHGRGRVLYRVNGKVSGHLHVGHTPVHFTDVDLHAYIVGNDGRAYTAISHIPQPAAQALLPLTPIGGLFGWLFALEKPGSENGFSLAGAAFTHDMEVTFYPGEETVRITQTAEGLDPENYLSIKTNIQGQVPYVSANFTAHISPYKELYHYSDSTVTSTSSRDYSLTFGAINQTWSYRIHQNITYQVCRHAPRHPSFPTTQQLNVDRVFALYNDEERVLRFAVTNQIGPVKEDSDPTPGNPCYDGSHMCDTTARCHPGTGVDYTCECASGYQGDGRNCVDENECATGFHRCGPNSVCINLPGSYRCECRSGYEFADDRHTCILITPPANPCEDGSHTCAPAGQARCVHHGGSTFSCACLPGYAGDGHQCTDVDECSENRCHPAATCYNTPGSFSCRCQPGYYGDGFQCIPDSTSSLTPCEQQQRHAQAQYAYPGARFHIPQCDEQGNFLPLQCHGSTGFCWCVDPDGHEVPGTQTPPGSTPPHCGPSPEPTQRPPTICERWRENLLEHYGGTPRDDQYVPQCDDLGHFIPLQCHGKSDFCWCVDKDGREVQGTRSQPGTTPACIPTVAPPMVRPTPRPDVTPPSVGTFLLYTQGQQIGYLPLNGTRLQKDAAKTLLSLHGSIIVGIDYDCRERMVYWTDVAGRTISRAGLELGAEPETIVNSGLISPEGLAIDHIRRTMYWTDSVLDKIESALLDGSERKVLFYTDLVNPRAIAVDPIRGNLYWTDWNREAPKIETSSLDGENRRILINTDIGLPNGLTFDPFSKLLCWADAGTKKLECTLPDGTGRRVIQNNLKYPFSIVSYADHFYHTDWRRDGVVSVNKHSGQFTDEYLPEQRSHLYGITAVYPYCPTGRK

SEQ ID NO: 9372 - protein, 644 aa, Homo Sapiens
  misc_feature (1)..(1): Xaa can be any naturally occurring amino acid
XYSLTFGAINQTWSYRIHQNITYQVCRHAPRHPSFPTTQQLNVDRVFALYNDEERVLRFAVTNQIGPVKEDSDPTPGNPCYDGSHMCDTTARCHPGTGVDYTCECASGYQGDGRNCVDENECATGFHRCGPNSVCINLPGSYRCECRSGYEFADDRHTCIYVDECSENRCHPAATCYNTPGSFSCRCQPGYYGDGFQCIPDSTSSLTPCEQQQRHAQAQYAYPGARFHIPQCDEQGNFLPLQCHGSTGFCWCVDPDGHEVPGTQTPPGSTPPHCGPSPEPTQRPPTICERWRENLLEHYGGTPRDDQYVPQCDDLGHFIPLQCHGKSDFCWCVDKDGREVQGTRSQPGTTPACIPTVAPPMVRPTPRPDVTPPSVGTFLLYTQGQQIGYLPLNGTRLQKDAAKTLLSLHGSIIVGIDYDCRERMVYWTDVAGRTISRAGLELGAEPETIVNSGLISPEGLAIDHIRRTMYWTDSVLDKIESALLDGSERKVLFYTDLVNPRAIAVDPIRGNLYWTDWNREAPKIETSSLDGENRRILINTDIGLPNGLTFDPFSKLLCWADAGTKKLECTLPDGTGRRVIQNNLKYPFSIVSYADHFYHTDWRRDGVVSVNKHSGQFTDEYLPEQRSHLYGITAVYPYCPTGRK

SEQ ID NO: 9373 - protein, 85 aa, Homo Sapiens
MELCRSLALLGGSLGLMFCLIALSTDFWFEAVGPTHSAHSGLWPTGHGDIISGHGPLVSTTAAFAAGALSLGAHCGGPRPGYETL

SEQ ID NO: 9374 - protein, 142 aa, Homo Sapiens
MELCRSLALLGGSLGLMFCLIALSTDFWFEAVGPTHSAHSGLWPTGHGDIISGHGPLVSTTAAFAAGKDSGLDWGIASQRIPAEELSHLSCPCPQPSPWWWPWRCTPASGGTSLHTPRSRPSSPGPSTWAGSQLSSCSVQVP

SEQ ID NO: 9375 - protein, 165 aa, Homo Sapiens
MELCRSLALLGGSLGLMFCLIALSTDFWFEAVGPTHSAHSGLWPTGHGDIISGYIHVTQTFSIMAVLWALVSVSFLVLSCFPSLFPPGHGPLVSTTAAFAAAISMVVAMAVYTSERWDQPPHPQIQTFFSWSFYLGWVSAILLLCTGALSLGAHCGGPRPGYETL

SEQ ID NO: 9376 - protein, 72 aa, Homo Sapiens
TGHGDIISAISMVVAMAVYTSERWDQPPHPQIQTFFSWSFYLGWVSAILLLCTGALSLGAHCGGPRPGYETL

SEQ ID NO: 9377 - protein, 89 aa, Homo Sapiens
  misc_feature (1)..(1): Xaa can be any naturally occurring amino acid
XWPTGHGDIISGHGPLVSTTAAFAAAISMVVAMAVYTSERWDQPPHPQIQTFFSWSFYLGWVSAILLLCTGALSLGAHCGGPRPGYETL

SEQ ID NO: 9378 - protein, 351 aa, Homo Sapiens
MLPVWFTANLDIVATYIQEPNEDCLYLNVYVPTEDGSGAKKQGEDLADNDGDEDEDIRDSGAKPVMVYIHGGSYMEGTGNMIDGSILASYGNVIVITLNYRVGVLGFLSTGDQAAKGNYGLLDQIQALRWVSENIAFFGGDPRRITVFGSGIGASCVSLLTLSHHSEGLFQRAIIQSGSALSSWAVNYQPVKYTSLLADKVGCNVLDTVDMVDCLRQKSAKELVEQDIQPARYHVAFGPVIDGDVIPDDPEILMEQGEFLNYDIMLGVNQGEGLKFVEGVVDPEDGVSGTDFDYSVSILWTICMAILRVRTPCERPSSSCIQTGQTVTTLRPAVKHWWHSSLTTSGWSPQW

SEQ ID NO: 9379 - protein, 513 aa, Homo Sapiens
MWLRLGPPSLSLSPKPTVGRSLCLTLWFLSLALRASTQAPAPTVNTHFGKLRGARVPLPSEILGPVDQYLGVPYAAPPIGEKRFLPPEPPPSWSGIRNATHFPPVCPQNIHTAVPEVMLPVWFTANLDIVATYIQEPNEDCLYLNVYVPTEDDIRDSGAKPVMVYIHGGSYMEGTGNMIDGSILASYGNVIVITLNYRVGVLGFLSTGDQAAKGNYGLLDQIQALRWVSENIAFFGGDPRRITVFGSGIGASCVSLLTLSHHSEGLFQRAIIQSGSALSSWAVNYQPVKYTSLLADKVGCNVLDTVDMVDCLRQKSAKELVEQDIQPARYHVAFGPVIDGDVIPDDPEILMEQGEFLNYDIMLGVNQGEGLKFVEGVVDPEDGVSGTDFDYSVSNFVDNLYGYPEGKDTLRETIKFMYTDWADRDNPETRRKTLVALFTDHQWVEPSVVTADLHARYGSPTYFYAFYHHCQSLMKPAWSDAAHGDEVPYVFGVPMVGPTDLFPCNFSKNDVML

SEQ ID NO: 9380 - protein, 808 aa, Homo Sapiens
MWLRLGPPSLSLSPKPTVGRSLCLTLWFLSLALRASTQAPAPTVNTHFGKLRGARVPLPSEILGPVDQYLGVPYAAPPIGEKRFLPPEPPPSWSGIRNATHFPPVCPQNIHTAVPEVMLPVWFTANLDIVATYIQEPNEDCLYLNVYVPTEDDIRDSGAKPVMVYIHGGSYMEGTGNMIDGSILASYGNVIVITLNYRVGVLGFLSTGDQAAKGNYGLLDQIQALRWVSENIAFFGGDPRRITVFGSGIGASCVSLLTLSHHSEGLFQRAIIQSGSALSSWAVNYQPVKYTSLLADKVGCNVLDTVDMVDCLRQKSAKELVEQDIQPARYHVAFGPVIDGDVIPDDPEILMEQGEFLNYDIMLGVNQGEGLKFVEGVVDPEDGVSGTDFDYSVSNFVDNLYGYPEGKDTLRETIKFMYTDWADRDNPETRRKTLVALFTDHQWVEPSVVTADLHARYGSPTYFYAFYHHCQSLMKPAWSDAAHGDEVPYVFGVPMVGPTDLFPCNFSKNDVMLSAVVMTYWTNFAKTGDPNKPVPQDTKFIHTKANRFEEVAWSKYNPRDQLYLHIGLKPRVRDHYRATKVAFWKHLVPHLYNLHDMFHYTSTTTKVPPPDTTHSSHITRRPNGKTWSTKRPAISPAYSNENAQGSWNGDQDAGPLLVENPRDYSTELSVTIAVGASLLFLNVLAFAALYYRKDKRRQEPLRQPSPQRGAGAPELGAAPEEELAALQLGPTHHECEAGPPHDTLRLTALPDYTLTLRRSPDDIPLMTPNTITMIPNSLVGLQTLHPYNTFAAGFNSTGLPHSHSTTRV

SEQ ID NO: 9381 - protein, 828 aa, Homo Sapiens
MWLRLGPPSLSLSPKPTVGRSLCLTLWFLSLALRASTQAPAPTVNTHFGKLRGARVPLPSEILGPVDQYLGVPYAAPPIGEKRFLPPEPPPSWSGIRNATHFPPVCPQNIHTAVPEVMLPVWFTANLDIVATYIQEPNEDCLYLNVYVPTEDGSGAKKQGEDLADNDGDEDEDIRDSGAKPVMVYIHGGSYMEGTGNMIDGSILASYGNVIVITLNYRVGVLGFLSTGDQAAKGNYGLLDQIQALRWVSENIAFFGGDPRRITVFGSGIGASCVSLLTLSHHSEGLFQRAIIQSGSALSSWAVNYQPVKYTSLLADKVGCNVLDTVDMVDCLRQKSAKELVEQDIQPARYHVAFGPVIDGDVIPDDPEILMEQGEFLNYDIMLGVNQGEGLKFVEGVVDPEDGVSGTDFDYSVSNFVDNLYGYPEGKDTLRETIKFMYTDWADRDNPETRRKTLVALFTDHQWVEPSVVTADLHARYGSPTYFYAFYHHCQSLMKPAWSDAAHGDEVPYVFGVPMVGPTDLFPCNFSKNDVMLSAVVMTYWTNFAKTGDPNKPVPQDTKFIHTKANRFEEVAWSKYNPRDQLYLHIGLKPRVRDHYRATKVAFWKHLVPHLYNLHDMFHYTSTTTKVPPPDTTHSSHITRRPNGKTWSTKRPAISPAYSNENAQGSWNGDQDAGPLLVENPRDYSTELSVTIAVGASLLFLNVLAFAALYYRKDKRRQEPLRQPSPQRGAGAPELGAAPEEELAALQLGPTHHECEAGPPHDTLRLTALPDYTLTLRRSPDDIPLMTPNTITMIPNSLVGLQTLHPYNTFAAGFNSTGLPHSHSTTRV

SEQ ID NO: 9382 - protein, 848 aa, Homo Sapiens
MWLRLGPPSLSLSPKPTVGRSLCLTLWFLSLALRASTQAPAPTVNTHFGKLRGARVPLPSEILGPVDQYLGVPYAAPPIGEKRFLPPEPPPSWSGIRNATHFPPVCPQNIHTAVPEVMLPVWFTANLDIVATYIQEPNEDCLYLNVYVPTEDVKRISKECARKPNKKICRKGGSGAKKQGEDLADNDGDEDEDIRDSGAKPVMVYIHGGSYMEGTGNMIDGSILASYGNVIVITLNYRVGVLGFLSTGDQAAKGNYGLLDQIQALRWVSENIAFFGGDPRRITVFGSGIGASCVSLLTLSHHSEGLFQRAIIQSGSALSSWAVNYQPVKYTSLLADKVGCNVLDTVDMVDCLRQKSAKELVEQDIQPARYHVAFGPVIDGDVIPDDPEILMEQGEFLNYDIMLGVNQGEGLKFVEGVVDPEDGVSGTDFDYSVSNFVDNLYGYPEGKDTLRETIKFMYTDWADRDNPETRRKTLVALFTDHQWVEPSVVTADLHARYGSPTYFYAFYHHCQSLMKPAWSDAAHGDEVPYVFGVPMVGPTDLFPCNFSKNDVMLSAVVMTYWTNFAKTGDPNKPVPQDTKFIHTKANRFEEVAWSKYNPRDQLYLHIGLKPRVRDHYRATKVAFWKHLVPHLYNLHDMFHYTSTTTKVPPPDTTHSSHITRRPNGKTWSTKRPAISPAYSNENAQGSWNGDQDAGPLLVENPRDYSTELSVTIAVGASLLFLNVLAFAALYYRKDKRRQEPLRQPSPQRGAGAPELGAAPEEELAALQLGPTHHECEAGPPHDTLRLTALPDYTLTLRRSPDDIPLMTPNTITMIPNSLVGLQTLHPYNTFAAGFNSTGLPHSHSTTRV

SEQ ID NO: 9383 - protein, 33 aa, Homo Sapiens
MLRPQGLLWLPLLFTSVCVMLNSNVLLWITALA

SEQ ID NO: 9384 - protein, 816 aa, Homo Sapiens
MLRPQGLLWLPLLFTSVCVMLNSNVLLWITALAIKFTLIDSQAQYPVVNTNYGKIQGLRTPLPSEILGPVEQYLGVPYASPPTGERRFQPPESPSSWTGIRNATQFSAVCPQHLDERFLLHDMLPIWFTTSLDTLMTYVQDQNEDCLYLNIYVPMEDDIHEQNSKKPVMVYIHGGSYMEGTGNMIDGSILASYGNVIVITINYRLGILGFLSTGDQAAKGNYGLLDQIQALRWIEENVGAFGGDPKRVTIFGSGAGASCVSLLTLSHYSEGLFQKAIIQSGTALSSWAVNYQPAKYTRILADKVGCNMLDTTDMVECLKNKNYKELIQQTITPATYHIAFGPVIDGDVIPDDPQILMEQGEFLNYDIMLGVNQGEGLKFVDGIVDNEDGVTPNDFDFSVSNFVDNLYGYPEGKDTLRETIKFMYTDWADKENPETRRKTLVALFTDHQWVAPAVATADLHAQYGSPTYFYAFYHHCQSEMKPSWADSAHGDEVPYVFGIPMIGPTELFSCNFSKNDVMLSAVVMTYWTNFAKTGDPNQPVPQDTKFIHTKPNRFEEVAWSKYNPKDQLYLHIGLKPRVRDHYRATKVAFWLELVPHLHNLNEIFQYVSTTTKVPPPDMTSFPYGTRRSPAKIWPTTKRPAITPANNPKHSKDPHKTGPEDTTVLIETKRDYSTELSVTIAVGASLLFLNILAFAALYYKKDKRRHETHRHPSPQRNTTNDITHIQNEEIMSLQMKQLEHDHECESLQAHDTLRLTCPPDYTLTLRRSPDDIPFMTPNTITMIPNTLMGMQPLHTFKTFSGGQNSTNLPHGHSTTRV

SEQ ID NO: 9385 - protein, 816 aa, Homo Sapiens; identical to SEQ ID NO: 9384

SEQ ID NO: 9386 - protein, 873 aa, Homo Sapiens
MLRPQGLLWLPLLFTSVCVMLNSNVLLWITALAIKFTLIDSQAQYPVVNTNYGKIQGLRTPLPSEILGPVEQYLGVPYASPPTGERRFQPPESPSSWTGIRNATQFSAVCPQHLDERFLLHDMLPIWFTTSLDTLMTYVQDQNEDCLYLNIYVPMEDGTNIKRNADDITSNDHGEDKDIHEQNSKKPVMVYIHGGSYMEGTGNMIDGSILASYGNVIVITINYRLGILAQNTLAHGNCKHRCQLHLQAPRDCKSAYPFRNEDEIRGFLSTGDQAAKGNYGLLDQIQALRWIEENVGAFGGDPKRVTIFGSGAGASCVSLLTLSHYSEGLFQKAIIQSGTALSSWAVNYQPAKYTRILADKVGCNMLDTTDMVECLKNKNYKELIQQTITPATYHIAFGPVIDGDVIPDDPQILMEQGEFLNYDIMLGVNQGEGLKFVDGIVDNEDGVTPNDFDFSVSNFVDNLYGYPEGKDTLRETIKFMYTDWADKENPETRRKTLVALFTDHQWVAPAVATADLHAQYGSPTYFYAFYHHCQSEMKPSWADSAHGDEVPYVFGIPMIGPTELFSCNFSKNDVMLSAVVMTYWTNFAKTGDPNQPVPQDTKFIHTKPNRFEEVAWSKYNPKDQLYLHIGLKPRVRDHYRATKVAFWLELVPHLHNLNEIFQYVSTTTKVPPPDMTSFPYGTRRSPAKIWPTTKRPAITPANNPKHSKDPHKTGPEDTTVLIETKRDYSTELSVTIAVGASLLFLNILAFAALYYKKDKRRHETHRHPSPQRNTTNDITHIQNEEIMSLQMKQLEHDHECESLQAHDTLRLTCPPDYTLTLRRSPDDIPFMTPNTITMIPNTLMGMQPLHTFKTFSGGQNSTNLPHGHSTTRV

SEQ ID NO: 9387 - protein, 836 aa, Homo Sapiens
MLRPQGLLWLPLLFTSVCVMLNSNVLLWITALAIKFTLIDSQAQYPVVNTNYGKIQGLRTPLPSEILGPVEQYLGVPYASPPTGERRFQPPESPSSWTGIRNATQFSAVCPQHLDERFLLHDMLPIWFTTSLDTLMTYVQDQNEDCLYLNIYVPMEDGTNIKRNADDITSNDHGEDKDIHEQNSKKPVMVYIHGGSYMEGTGNMIDGSILASYGNVIVITINYRLGILGFLSTGDQAAKGNYGLLDQIQALRWIEENVGAFGGDPKRVTIFGSGAGASCVSLLTLSHYSEGLFQKAIIQSGTALSSWAVNYQPAKYTRILADKVGCNMLDTTDMVECLKNKNYKELIQQTITPATYHIAFGPVIDGDVIPDDPQILMEQGEFLNYDIMLGVNQGEGLKFVDGIVDNEDGVTPNDFDFSVSNFVDNLYGYPEGKDTLRETIKFMYTDWADKENPETRRKTLVALFTDHQWVAPAVATADLHAQYGSPTYFYAFYHHCQSEMKPSWADSAHGDEVPYVFGIPMIGPTELFSCNFSKNDVMLSAVVMTYWTNFAKTGDPNQPVPQDTKFIHTKPNRFEEVAWSKYNPKDQLYLHIGLKPRVRDHYRATKVAFWLELVPHLHNLNEIFQYVSTTTKVPPPDMTSFPYGTRRSPAKIWPTTKRPAITPANNPKHSKDPHKTGPEDTTVLIETKRDYSTELSVTIAVGASLLFLNILAFAALYYKKDKRRHETHRHPSPQRNTTNDITHIQNEEIMSLQMKQLEHDHECESLQAHDTLRLTCPPDYTLTLRRSPDDIPFMTPNTITMIPNTLMGMQPLHTFKTFSGGQNSTNLPHGHSTTRV

SEQ ID NO: 9388 - protein, 648 aa, Homo Sapiens
MVYIHGGSYMEGTGNMIDGSILASYGNVIVITINYRLGILGFLSTGDQAAKGNYGLLDQIQALRWIEENVGAFGGDPKRVTIFGSGAGASCVSLLTLSHYSEGLFQKAIIQSGTALSSWAVNYQPAKYTRILADKVGCNMLDTTDMVECLKNKNYKELIQQTITPATYHIAFGPVIDGDVIPDDPQILMEQGEFLNYDIMLGVNQGEGLKFVDGIVDNEDGVTPNDFDFSVSNFVDNLYGYPEGKDTLRETIKFMYTDWADKENPETRRKTLVALFTDHQWVAPAVATADLHAQYGSPTYFYAFYHHCQSEMKPSWADSAHGDEVPYVFGIPMIGPTELFSCNFSKNDVMLSAVVMTYWTNFAKTGDPNQPVPQDTKFIHTKPNRFEEVAWSKYNPKDQLYLHIGLKPRVRDHYRATKVAFWLELVPHLHNLNEIFQYVSTTTKVPPPDMTSFPYGTRRSPAKIWPTTKRPAITPANNPKHSKDPHKTGPEDTTVLIETKRDYSTELSVTIAVGASLLFLNILAFAALYYKKDKRRHETHRHPSPQRNTTNDITHIQNEEIMSLQMKQLEHDHECESLQAHDTLRLTCPPDYTLTLRRSPDDIPFMTPNTITMIPNTLMGMQPLHTFKTFSGGQNSTNLPHGHSTTRV

SEQ ID NO: 9389 - protein, 236 aa, Homo Sapiens
  misc_feature (1)..(1): Xaa can be any naturally occurring amino acid
XNSNVLLWITALAIKFTLIDSQAQYPVVNTNYGKIQGLRTPLPSEILGPVEQYLGVPYASPPTGERRFQPPESPSSWTGIRNATQFSAVCPQHLDERFLLHDMLPIWFTTSLDTLMTYVQDQNEDCLYLNIYVPMEDGTNIKRNADDITSNDHGEDKDIHEQNSKKPVMVYIHGGSYMEGTGNMIDGSILASYGNVIVITINYRLGILGMQEARLCGSSKMFNYFKSPFTNLINFF

SEQ ID NO: 9390 - protein, 178 aa, Homo Sapiens
GPTCSILPKNPLFPQNLSSQPCIKMEGDKSLTFSSYGLQWCLYELDKEEFQTFKELLKKKSSESTTCSIPQFEIENANVECLALLLHEYYGASLAWATSISIFENMNLRTLSEKARDDMKRHSPEDPEATMTDQGPSKEKVPGISQAVQQDSATAAETKEQESFAVLLRLQCSGYPQA

SEQ ID NO: 9391 - protein, 1200 aa, Homo Sapiens
MKVAGGLELGAAALLSASPRALVTLSTGPTCSILPKNPLFPQNLSSQPCIKMEGDKSLTFSSYGLQWCLYELDKEEFQTFKELLKKKSSESTTCSIPQFEIENANVECLALLLHEYYGASLAWATSISIFENMNLRTLSEKARDDMKRHSPEDPEATMTDQGPSKEKVPDISDSNNKHKYVGIHSSFAEISQAMEQEGATAAETEEQEISQAMEQEGATAAETEEQGHGGDTWDYKSHVMTKFAEEEDVRRSFENTAADWPEMQTLAGAFDSDRWGFRPRTVVLHGKSGIGKSALARRIVLCWAQGGLYQGMFSYVFFLPVREMQRKKESSVTEFISREWPDSQAPVTEIMSRPERLLFIIDGFDDLGSVLNNDTKLCKDWAEKQPPFTLIRSLLRKVLLPESFLIVTVRDVGTEKLKSEVVSPRYLLVRGISGEQRIHLLLERGIGEHQKTQGLRAIMNNRELLDQCQVPAVGSLICVALQLQDVVGESVAPFNQTLTGLHAAFVFHQLTPRGVVRRCLNLEERVVLKRFCRMAVEGVWNRKSVFDGDDLMVQGLGESELRALFHMNILLPDSHCEEYYTFFHLSLQDFCAALYYVLEGLEIEPALCPLYVEKTKRSMELKQAGFHIHSLWMKRFLFGLVSEDVRRPLEVLLGCPVPLGVKQKLLHWVSLLGQQPNATTPGDTLDAFHCLFETQDKEFVRLALNSFQEVWLPINQNLDLIASSFCLQHCPYLRKIRVDVKGIFPRDESAEACPVVPLWMRDKTLIEEQWEDFCSMLGTHPHLRQLDLGSSILTERAMKTLCAKLRHPTCKIQTLMFRNAQITPGVQHLWRIVMANRNLRSLNLGGTHLKEEDVRMACEALKHPKCLLESLRLDCCGLTHACYLKISQILTTSPSLKSLSLAGNKVTDQGVMPLSDALRVSQCALQKLILEDCGITATGCQSLASALVSNRSLTHLCLSNNSLGNEGVNLLCRSMRLPHCSLQRLMLNQCHLDTAGCGFLALALMGNSWLTHLSLSMNPVEDNGVKLLCEVMREPSCHLQDLELVKCHLTAACCESLSCVISRSRHLKSLDLTDNALGDGGVAALCEGLKQKNSVLARLGLKACGLTSDCCEALSLALSCNRHLTSLNLVQNNFSPKGMMKLCSAFACPTSNLQIIGLWKWQYPVQIRKLLEEVQLLKPRVVIDGSWHSFDEDDRYWWKN

SEQ ID NO: 9392 - protein, 1200 aa, Homo Sapiens
MKVAGGLELGAAALLSASPRALVTLSTGPTCSILPKNPLFPQNLSSQPCIKMEGDKSLTFSSYGLQWCLYELDKEEFQTFKELLKKKSSESTTCSIPQFEIENANVECLALLLHEYYGASLAWATSISIFENMNLRTLSEKARDDMKRHSPEDPEATMTDQGPSKEKVPGISQAVQQDSATAAETKEQEISQAMEQEGATAAETEEQEISQAMEQEGATAAETEEQGHGGDTWDYKSHVMTKFAEEEDVRRSFENTAADWPEMQTLAGAFDSDRWGFRPRTVVLHGKSGIGKSALARRIVLCWAQGGLYQGMFSYVFFLPVREMQRKKESSVTEFISREWPDSQAPVTEIMSRPERLLFIIDGFDDLGSVLNNDTKLCKDWAEKQPPFTLIRSLLRKVLLPESFLIVTVRDVGTEKLKSEVVSPRYLLVRGISGEQRIHLLLERGIGEHQKTQGLRAIMNNRELLDQCQVPAVGSLICVALQLQDVVGESVAPFNQTLTGLHAAFVFHQLTPRGVVRRCLNLEERVVLKRFCRMAVEGVWNRKSVFDGDDLMVQGLGESELRALFHMNILLPDSHCEEYYTFFHLSLQDFCAALYYVLEGLEIEPALCPLYVEKTKRSMELKQAGFHIHSLWMKRFLFGLVSEDVRRPLEVLLGCPVPLGVKQKLLHWVSLLGQQPNATTPGDTLDAFHCLFETQDKEFVRLALNSFQEVWLPINQNLDLIASSFCLQHCPYLRKIRVDVKGIFPRDESAEACPVVPLWMRDKTLIEEQWEDFCSMLGTHPHLRQLDLGSSILTERAMKTLCAKLRHPTCKIQTLMFRNAQITPGVQHLWRIVMANRNLRSLNLGGTHLKEEDVRMACEALKHPKCLLESLRLDCCGLTHACYLKISQILTTSPSLKSLSLAGNKVTDQGVMPLSDALRVSQCALQKLILEDCGITATGCQSLASALVSNRSLTHLCLSNNSLGNEGVNLLCRSMRLPHCSLQRLMLNQCHLDTAGCGFLALALMGNSWLTHLSLSMNPVEDNGVKLLCEVMREPSCHLQDLELVKCHLTAACCESLSCVISRSRHLKSLDLTDNALGDGGVAALCEGLKQKNSVLARLGLKACGLTSDCCEALSLALSCNRHLTSLNLVQNNFSPKGMMKLCSAFACPTSNLQIIGLWKWQYPVQIRKLLEEVQLLKPRVVIDGSWHSFDEDDRYWWKN

SEQ ID NO: 9393 - protein, 154 aa, Homo Sapiens
MARRAGGARMFGSLLLFALLAAGVAPLSWDLPEPRSRASKIRVHSRGNLWATGHFMGKKSLEPSSPSPLGTAPHTSLRDQRLQLSHDLLGILLLKKALGVSLSRPAPQIQEAAGTNTAEMTPIMGQTQQRGLDCAHPGKVLNGTLLMAPSGCKS

SEQ ID NO: 9394 - protein, 121 aa, Homo Sapiens
MARRAGGARMFGSLLLFALLAAGVAPLSWDLPEPRSRASKIRVHSRGNLWATGHFMGKKSLEPSSPSPLGTAPHTSLRDQRLQLSHDLLGILLLKKALGVSLSRPAPQIQYRRLLVQILQK

SEQ ID NO: 9395 - protein, 82 aa, Homo Sapiens
MANCERTFIAIKPDGVQRGLVGEIIKRFEQKGFRLVGLKFMQASEDLLKEHYVDLKDRPFFAGLVKYMHSGPVVAMLPDFLL

SEQ ID NO: 9396 - protein, 82 aa, Homo Sapiens; identical to SEQ ID NO: 9395

SEQ ID NO: 9397 - protein, 152 aa, Homo Sapiens
MANCERTFIAIKPDGVQRGLVGEIIKRFEQKGFRLVGLKFMQASEDLLKEHYVDLKDRPFFAGLVKYMHSGPVVAMVWEGLNVVKTGRVMLGETNPADSKPGTIRGDFCIQVGRNIIHGSDSVESAEKEIGLWFHPEELVDYTSCAQNWIYE

SEQ ID NO: 9398 - protein, 60 aa, Homo Sapiens
MVLLSTLGIVFQGEGPPISSCDTGTMANCERTFIAIKPDGVQRGLVGEIIKRFEQKGFRL

SEQ ID NO: 9399 - protein, 139 aa, Homo Sapiens
MVLLSTLGIVFQGEGPPISSCDTGTMANCERTFIAIKPDGVQRGLVGEIIKRFEQKGFRLVGLKFMQASEDLLKEHYVDLKDRPFFAGLVKYMHSGPVVAMVWEGLNVVKTGRVMLGETNPADSKPGTIRGDFCIQVGR

SEQ ID NO: 9400 - protein, 177 aa, Homo Sapiens
MVLLSTLGIVFQGEGPPISSCDTGTMANCERTFIAIKPDGVQRGLVGEIIKRFEQKGFRLVGLKFMQASEDLLKEHYVDLKDRPFFAGLVKYMHSGPVVAMVWEGLNVVKTGRVMLGETNPADSKPGTIRGDFCIQVGRNIIHGSDSVESAEKEIGLWFHPEELVDYTSCAQNWIYE

SEQ ID NO: 9401 - protein, 177 aa, Homo Sapiens; identical to SEQ ID NO: 9400

SEQ ID NO: 9402 - protein, 197 aa, Homo Sapiens
MANCERTFIAIKPDGVQRGLVGEIIKRFEQKGFRLVGLKFMQASEDLLKEHYVDLKDRPFFAGLVKYMHSGPVVAMVWEGLNVVKTGRVMLGETNPADSKPGTIRGDFCIQVGRTMANLERTFIAIKPDGVQRGLVGEIIKRFEQKGFRLVAMKFLRASEEHLKQHYIDLKDRPFFPGLVKYMNSGPVVAMEHHSWQ

SEQ ID NO: 9403 - protein, 267 aa, Homo Sapiens
MANCERTFIAIKPDGVQRGLVGEIIKRFEQKGFRLVGLKFMQASEDLLKEHYVDLKDRPFFAGLVKYMHSGPVVAMVWEGLNVVKTGRVMLGETNPADSKPGTIRGDFCIQVGRTMANLERTFIAIKPDGVQRGLVGEIIKRFEQKGFRLVAMKFLRASEEHLKQHYIDLKDRPFFPGLVKYMNSGPVVAMVWEGLNVVKTGRVMLGETNPADSKPGTIRGDFCIQVGRNIIHGSDSVKSAEKEISLWFKPEELVDYKSCAHDWVYE

SEQ ID NO: 9404 - protein, 292 aa, Homo Sapiens
MVLLSTLGIVFQGEGPPISSCDTGTMANCERTFIAIKPDGVQRGLVGEIIKRFEQKGFRLVGLKFMQASEDLLKEHYVDLKDRPFFAGLVKYMHSGPVVAMVWEGLNVVKTGRVMLGETNPADSKPGTIRGDFCIQVGRTMANLERTFIAIKPDGVQRGLVGEIIKRFEQKGFRLVAMKFLRASEEHLKQHYIDLKDRPFFPGLVKYMNSGPVVAMVWEGLNVVKTGRVMLGETNPADSKPGTIRGDFCIQVGRNIIHGSDSVKSAEKEISLWFKPEELVDYKSCAHDWVYE

SEQ ID NO: 9405 - protein, 53 aa, Homo Sapiens
FANLFPAACTGAHERTFLAVKPDGVQRRLVGEIVRRFERKGFKLVALKLVQAA

SEQ ID NO: 9406 - protein, 57 aa, Homo Sapiens
IFANLFPAACTGAHERTFLAVKPDGVQRRLVGEIVRRFERKGFKRPDPSAGLRGAAA

SEQ ID NO: 9407 - protein, 85 aa, Homo Sapiens
MASGPVVAMVWQGLDVVRTSRALIGATNPADAPPGTIRGDFCIEVGKNLIHGSDSVESARREIALWFRADELLCWEDSAGHWLYE

SEQ ID NO: 9408 - protein, 169 aa, Homo Sapiens
MICLVLTIFANLFPAACTGAHERTFLAVKPDGVQRRLVGEIVRRFERKGFKLVALKLVQASEELLREHYAELRERPFYGRLVKYMASGPVVAMVWQGLDVVRTSRALIGATNPADAPPGTIRGDFCIEVGKNLIHGSDSVESARREIALWFRADELLCWEDSAGHWLYE

SEQ ID NO: 9409 - protein, 123 aa, Homo Sapiens
PAACTGAHERTFLAVKPDGVQRRLVGEIVRRFERKGFKLVALKLVQVGARPPRSCCVSTTPSCVNARSTAALSSIWPPGRWWPWYGRGWTWCAPRGRSSEPRTRPTPRPAPSAGISASRLART

SEQ ID NO: 9410 - protein, 153 aa, Homo Sapiens
MKHLRPQFPLILAIYCFCMLQIPSSGFPQPLADPSDGLDIVQLEQLAYCLSQWAPLSRQPKDNQDIYKRFLFHYSRTQEATHPVKTGFPPVHPLMHLAAKLANRRMKRILQRGSGTAAVDFTKKDHTATWGRPFFLFRPRNGRNIEDEAQIQW

SEQ ID NO: 9411 - protein, 158 aa, Homo Sapiens
MLRTESCRPRSPAGQVAAASPLLLLLLLLAWCAGACRGAPILPQGLQPEQQLQLWNEASNALEELCFMIMGMLPKPQEQDEKDNTKRFLFHYSKTQKLGKSNVVSSVVHPLLQLVPHLHERRMKRFRVDEEFQSPFASQSRGYFLFRPRNGRRSAGFI

SEQ ID NO: 9412 - protein, 149 aa, Homo Sapiens
MLRTESCRPRSPAGQVAAASPLLLLLLLLAWCAGACRGAPILPQGLQPEQQLQLWNEIDDTCSSFLSIDSQPQASNALEELCFMIMGMLPKPQEQDEKDNTKRFLFHYSKTQKLGKSNVVEEFQSPFASQSRGYFLFRPRNGRRSAGFI

SEQ ID NO: 9413 - protein, 174 aa, Homo Sapiens
MLRTESCRPRSPAGQVAAASPLLLLLLLLAWCAGACRGAPILPQGLQPEQQLQLWNEIDDTCSSFLSIDSQPQASNALEELCFMIMGMLPKPQEQDEKDNTKRFLFHYSKTQKLGKSNVVSSVVHPLLQLVPHLHERRMKRFRVDEEFQSPFASQSRGYFLFRPRNGRRSAGFI

SEQ ID NO: 9414 - protein, 147 aa, Homo Sapiens
MLRTESCRPRSPAGQVAAASPLLLLLLLLAWCAGACRGAPILPQGLQPEQQLQLWNEIDDTCSSFLSIDSQPQASNALEELCFMIMGMLPKPQSSVVHPLLQLVPHLHERRMKRFRVDEEFQSPFASQSRGYFLFRPRNGRRSAGFI

SEQ ID NO: 9415 - protein, 698 aa, Homo Sapiens
MLPARLPFRLLSLFLRGSAPTAARHGLREPLLERRCAAASSFQHSSSLGRELPYDPVDTEGFGEGGDMQERFLFPEYILDPEPQPTREKQLQELQQQQEEEERQRQQRREERRQQNLRARSREHPVVGHPDPALPPSGVNCSGCGAELHCQDAGVPGYLPREKFLRTAEADGGLARTVCQRCWLLSHHRRALRLQVSREQYLELVSAALRRPGPSLVLYMVDLLDLPDALLPDLPALVGPKQLIVLGNKVDLLPQDAPGYRQRLRERLWEDCARAGLLLAPGHQGPQRPVKDEPQDGENPNPPNWSRTVVRDVRLISAKTGYGVEELISALQRSWRYRGDVYLVGATNAGKSTLFNTLLESDYCTAKGSEAIDRATISPWPGTTLNLLKFPICNPTPYRMFKRHQRLKKDSTQAEEDLSEQEQNQLNVLKKHGYVVGRVGRTFLYSEEQKDNIPFEFDADSLAFDMENDPVMGTHKSTKQVELTAQDVKDAHWFYDTPGITKENCILNLLTEKEVNIVLPTQSIVPRTFVLKPGMVLFLGAIGRIDFLQGNQSAWFTVVASNILPVHITSLDRADALYQKHAGHTLLQIPMGGKERMAGFPPLVAEDIMLKEGLGASEAVADIKFSSAGWVSVTPNFKDRLHLRGYTPEGTVLTVRPPLLPYIVNIKGQRIKKSVAYKTKKPPSLMYNVRKKKGKINV

SEQ ID NO: 9416 - protein, 292 aa, Homo Sapiens
DQQLGIQTKDVAVDGQNWTFAFDFSFLSQQEDLAWAELRLQLSSPVDLPTEGSLAIEIFHQPKPDTEQASDSCLERFQMDLFTVTLSQVTFSLGSMVLEVTRPLSKWLKHPGALEKQMSRVAGECWPRPPTPPATNVLLMLYSNLSQEQRQLGGSTLLWEAESSWRAQEGQLSWEWGKRHRRHHLPDRSQLCRKVKFQVDFNLIGWGSWIIYPKQYNAYRCEGECPNPVGEEFHPTNHAYIQSLLKRYQPHRVPSTCCAPVKTKPLSMLYVDNGRVLLDHHKDMIVEECGCL

SEQ ID NO: 9417 - protein, 347 aa, Homo Sapiens
MHAHCLPFLLHAWWALLQAGAATVATALLRTRGQPSSPSPLAYMLSLYRDPLPRADIIRSLQAEDVAVDGQNWTFAFDFSFLSQQEDLAWAELRLQLSSPVDLPTEGSLAIEIFHQPKPDTEQASDSCLERFQMDLFTVTLSQVTFSLGSMVLEVTRPLSKWLKHPGALEKQMSRVAGECWPRPPTPPATNVLLMLYSNLSQEQRQLGGSTLLWEAESSWRAQEGQLSWEWGKRHRRHHLPDRSQLCRKVKFQVDFNLIGWGSWIIYPKQYNAYRCEGECPNPVGEEFHPTNHAYIQSLLKRYQPHRVPSTCCAPVKTKPLSMLYVDNGRVLLDHHKDMIVEECGCL

SEQ ID NO: 9418 - protein, 232 aa, Homo Sapiens
MERCPSLGVTLYALVVVLGLRATPAGGQHYLHIRPAPSDNLPLVDLIEHPDPIFDPKEKDLNETLLRSLLGGHYDPGFMATSPPEDRPGGGGGAAGGAEDLAELDQLLRQRPSGAMPSEIKGLEFSEGLAQGKKQRLSKKLRRKLQMWLWSQTFCPVLYAWNDLGSRFWPRYVKVGSCFSKRSCSVPEGMVCKPSKSVHLTVLRWRCQRRGGQRCGWIPIQYPIISECKCSC

SEQ ID NO: 9419 - protein, 138 aa, Homo Sapiens
MLVGQGAGPLGPAVVTAAVVLLLSGVGPAHGSEDIVVGCGGFVKSDVEINYSLIEIKLYTKHGTLKYQTDCAPNNGYFMIPLYDKGDFILKIEPPLGWSFEPTTVELHVDGVSDICTKGGDINFVFTGFSVNGKVCIF

SEQ ID NO: 9420 - protein, 1267 aa, Homo Sapiens
MLVGQGAGPLGPAVVTAAVVLLLSGVGPAHGSEDIVVGCGGFVKSDVEINYSLIEIKLYTKHGTLKYQTDCAPNNGYFMIPLYDKGDFILKIEPPLGWSFEPTTVELHVDGVSDICTKGGDINFVFTGFSVNGKVLSKGQPLGPAGVQVSLRNTGTEAKIQSTVTQPGGKFAFFKVLPGDYEILATHPTWALKEASTTVRVTNSNANAASPLIVAGYNVSGSVRSDGEPMKGVKFLLFSSLVTKEDVLGCNVSPVPGFQPQDESLVYLCYTVSREDGSFSFYSLPSGGYTVIPFYRGERITFDVAPSRLDFTVEHDSLKIEPVFHVMGFSVTGRVLNGPEGDGVPEAVVTLNNQIKVKTKADGSFRLENITTGTYTIHAQKEHLYFETVTIKIAPNTPQLADIVATGFSVCGQISIIRFPDTVKQMNKYKVVLSSQDKDKSLVTVETDAHGSFCFKANPGTYKVQVMVPEAETRAGLTLKPQTFPLTVTDRPVMDVAFVQFLASVSGKVSCLDTCGDLLVTLQSLSRQGEKRSLQLSGKVNAMTFTFDNVLPGKYKISIMHEDWCWKNKSLEVEVLEDDVSAVEFRQTGYMLRCSLSHAITLEFYQDGNGRENVGIYNLSKGVNRFCLSKPGVYKVTPRSCHRFEQAFYTYDTSSPSILTLTAIRHHVLGTITTDKMMDVTVTIKSSIDSEPALVLGPLKSVQELRREQQLAEIEARRQEREKNGNEEGEERMTKPPVQEMVDELQGPFSYDFSYWARSGEKITVTPSSKELLFYPPSMEAVVSGESCPGKLIEIHGKAGLFLEGQIHPELEGVEIVISEKGASSPLITVFTDDKGAYSVGPLHSDLEYTVTSQKEGYVLTAVEGTIGDFKAYALAGVSFEIKAEDDQPLPGVLLSLSGGLFRSNLLTQDNGILTFSNLSPGQYYFKPMMKEFRFEPSSQMIEVQEGQNLKITITGYRTAYSCYGTVSSLNGEPEQGVAMEAVGQNDCSIYGEDTVTDEEGKFRLRGLLPGCVYHVQLKAEGNDHIERALPHHRVIEVGNNDIDDVNIIVFRQINQFDLSGNVITSSEYLPTLWVKLYKSENLDNPIQTVSLGQSLFFHFPPLLRDGENYVVLLDSTLPRSQYDYILPQVSFTAVGYHKHITLIFNPTRKLPEQDIAQGSYIALPLTLLVLLAGYNHDKLIPLLLQLTSRLQGVGALGQAASDNSGPEDAKRQAKKQKTRRTLRLQEEFQLMWCLVPWRGTLGIHLFSSLPFASEILLETTATCIHY

SEQ ID NO: 9421 - protein, 1222 aa, Homo Sapiens
MLVGQGAGPLGPAVVTAAVVLLLSGVGPAHGSEDIVVGCGGFVKSDVEINYSLIEIKLYTKHGTLKYQTDCAPNNGYFMIPLYDKGDFILKIEPPLGWSFEPTTVELHVDGVSDICTKGGDINFVFTGFSVNGKVLSKGQPLGPAGVQVSLRNTGTEAKIQSTVTQPGGKFAFFKVLPGDYEILATHPTWALKEASTTVRVTNSNANAASPLIVAGYNVSGSVRSDGEPMKGVKFLLFSSLVTKEDVLGCNVSPVPGFQPQDESLVYLCYTVSREDGSFSFYSLPSGGYTVIPFYRGERITFDVAPSRLDFTVEHDSLKIEPVFHVMGFSVTGRVLNGPEGDGVPEAVVTLNNQIKVKTKADGSFRLENITTGTYTIHAQKEHLYFETVTIKIAPNTPQLADIVATGFSVCGQISIIRFPDTVKQMNKYKVVLSSQDKDKSLVTVETDAHGSFCFKANPGTYKVQVMVPEAETRAGLTLKPQTFPLTVTDRPVMDVAFVQFLASVSGKVSCLDTCGDLLVTLQSLSRQGEKRSLQLSGKVNAMTFTFDNVLPGKYKISIMHEDWCWKNKSLEVEVLEDDVSAVEFRQTGYMLRCSLSHAITLEFYQDGNGRENVGIYNLSKGVNRFCLSKPGVYKVTPRSCHRFEQAFYTYDTSSPSILTLTAIRHHVLGTITTDKMMDVTVTIKSSIDSEPALVLGPLKSVQELRREQQLAEIEARRQEREKNGNEEGEERMTKPPVQEMVDELQGPFSYDFSYWARSGEKITVTPSSKELLFYPPSMEAVVSGESCPGKLIEIHGKAGLFLEGQIHPELEGVEIVISEKGASSPLITVFTDDKGAYSVGPLHSDLEYTVTSQKEGYVLTAVEGTIGDFKAYALAGVSFEIKAEDDQPLPGVLLSLSGGLFRSNLLTQDNGILTFSNLSPGQYYFKPMMKEFRFEPSSQMIEVQEGQNLKITITGYRTAYSCYGTVSSLNGEPEQGVAMEAVGQNDCSIYGEDTVTDEEGKFRLRGLLPGCVYHVQLKAEGNDHIERALPHHRVIEVGNNDIDDVNIIVFRQINQFDLSGNVITSSEYLPTLWVKLYKSENLDNPIQTVSLGQSLFFHFPPLLRDGENYVVLLDSTLPRSQYDYILPQVSFTAVGYHKHITLIFNPTRKLPEQDIAQGSYIALPLTLLVLLAGYNHDKLIPLLLQLTSRLQGVGALGQAASDNSGPEDAKRQAKKQKTRRT

SEQ ID NO: 9422 - protein, 61 aa, Homo Sapiens
MLVGQGAGPLGPAVVTAAVVLLLSGVGPAHGSEDIVVGCGGFVKSDVEINYSLIEQVLNMH

SEQ ID NO: 9423 - protein, 95 aa, Homo Sapiens
  misc_feature (1)..(1): Xaa can be any naturally occurring amino acid
XEDWCWKNKSLEVEVLEDDVSAVEFRQTGYMLRCSLSHAITLVQPYCSGEMCPGTSELKTPRNFIRMEMGVRMWGFITSPKESTDSACPSLVCTK

SEQ ID NO: 9424 - protein, 50 aa, Homo Sapiens
  misc_feature (1)..(1): Xaa can be any naturally occurring amino acid
XSYIALPLTLLVLLAGYNHDKGHIRPGERPAHPWGLISKRPASFELKPTH

SEQ ID NO: 9425 - protein, 80 aa, Homo Sapiens
  misc_feature (1)..(1): Xaa can be any naturally occurring amino acid
XTGYMLRCSLSHAITLVCTAYGVSYLEKRLPCGCQERLTSQEYCKRRNFIRMEMGVRMWGFITSPKESTDSACPSLVCTK

SEQ ID NO: 9426 - protein, 81 aa, Homo Sapiens
MLQHISLLVKQVQELELKLSGQNAMGSQDSLLEITFRSGALPVLCDPTTPKPEDLHSPPLGAGLADFAHPAGSPLGRRDCL

SEQ ID NO: 9427 - protein, 349 aa, Homo Sapiens
MPSKTKYNLVDDGHDLRIPLHNEDAFQHGICFEAKYVGSLDVPRPNSRVEIVAAMRRIRYEFKAKNIKKKKVSIMVSVDGVKVILKKKKKKKEWTWDESKMLVMQDPIYRIFYVSHDSQDLKIFSYIARDGASNIFRCNVFKSKKKSQAMRIVRTVGQAFEVCHKLSLQHTQQNADGQEDGESERNSNSSGDPGRQLTGAERASTATAEETDIDAVEVPLPGNDVLEFSRGVTDLDAVGKEGGSHTGSKVSHPQEPMLTASPRMLLPSSSSKPPGLGTETPLSTHHQMQLLQQLLQQQQQQTQVAVAQCVVGQIALVLSTAISMCLLLPNFSLALPSLLMEELESRYTC

SEQ ID NO: 9428 - protein, 501 aa, Homo Sapiens
MPSKTKYNLVDDGHDLRIPLHNEDAFQHGICFEAKYVGSLDVPRPNSRVEIVAAMRRIRYEFKAKNIKKKKVSIMVSVDGVKVILKKKKKKKEWTWDESKMLVMQDPIYRIFYVSHDSQDLKIFSYIARDGASNIFRCNVFKSKKKSQAMRIVRTVGQAFEVCHKLSLQHTQQNADGQEDGESERNSNSSGDPGRQLTGAERASTATAEETDIDAVEVPLPGNDVLEFSRGVTDLDAVGKEGGSHTGSKVSHPQEPMLTASPRMLLPSSSSKPPGLGTETPLSTHHQMQLLQQLLQQQQQQTQVAVAQVHLLKDQLAAEAAARLEAQARVHQLLLQNKDMLQHISLLVKQVQELELKLSGQNAMGSQDSLLEITFRSGALPVLCDPTTPKPEDLHSPPLGAGLADFAHPAGSPLGRRDCLVKLECFRFLPPEDTPPPAQGEALLGGLELIKFRESGIASEYESNTDESEERDSWSQEELPRLLNVLQRQELGDGLDDEIAV

SEQ ID NO: 9429 - protein, 506 aa, Homo Sapiens
MPSKTKYNLVDDGHDLRIPLHNEDAFQHGICFEAKYVGSLDVPRPNSRVEIVAAMRRIRYEFKAKNIKKKKVSIMVSVDGVKVILKKKKKLLLLQKKEWTWDESKMLVMQDPIYRIFYVSHDSQDLKIFSYIARDGASNIFRCNVFKSKKKSQAMRIVRTVGQAFEVCHKLSLQHTQQNADGQEDGESERNSNSSGDPGRQLTGAERASTATAEETDIDAVEVPLPGNDVLEFSRGVTDLDAVGKEGGSHTGSKVSHPQEPMLTASPRMLLPSSSSKPPGLGTETPLSTHHQMQLLQQLLQQQQQQTQVAVAQVHLLKDQLAAEAAARLEAQARVHQLLLQNKDMLQHISLLVKQVQELELKLSGQNAMGSQDSLLEITFRSGALPVLCDPTTPKPEDLHSPPLGAGLADFAHPAGSPLGRRDCLVKLECFRFLPPEDTPPPAQGEALLGGLELIKFRESGIASEYESNTDESEERDSWSQEELPRLLNVLQRQELGDGLDDEIAV

SEQ ID NO: 9430 - protein, 211 aa, Homo Sapiens
MSLSSLCPVFSAAASSLQVHLLKDQLAAEAAARLEAQARVHQLLLQNKDMLQHISLLVKQVQELELKLSGQNAMGSQDSLLEITFRSGALPVLCDPTTPKPEDLHSPPLGAGLADFAHPAGSPLGRRDCLVKLECFRFLPPEDTPPPAQGEALLGGLELIKFRESGIASEYESNTDESEERDSWSQEELPRLLNVLQRQELGDGLDDEIAV

SEQ ID NO: 9431 - protein, 1286 aa, Homo Sapiens
GPGARGRRRRRRPMSPPPPPPPVRALPLLLLLAGPGAAAPPCLDGSPCANGGRCTQLPSREAACLCPPGWVGERCQLEDPCHSGPCAGRGVCQSSVVAGTARFSCRCPRGFRGPDCSLPDPCLSSPCAHGARCSVGPDGRFLCSCPPGYQGRSCRSDVDECRVGEPCRHGGTCLNTPGSFRCQCPAGYTGPLCENPAVPCAPSPCRNGGTCRQSGDLTYDCACLPGFEGQNCEVNVDDCPGHRCLNGGTCVDGVNTYNCQCPPEWTGQFCTEDVDECQLQPNACHNGGTCFNTLGGHSCVCVNGWTGESCSQNIDDCATAVCFHGATCHDRVASFYCACPMGKTGLLCHLDDACVSNPCHEDAICDTNPVNGRAICTCPPGFTGGACDQDVDECSIGANPCEHLGRCVNTQGSFLCQCGRGYTGPRCETDVNECLSGPCRNQATCLDRIGQFTCICMAGFTGTYCEVDIDECQSSPCVNGGVCKDRVNGFSCTCPSGFSGSTCQLDVDECASTPCRNGAKCVDQPDGYECRCAEGFEGTLCDRNVDDCSPDPCHHGRCVDGIASFSCACAPGYTGTRCESQVDECRSQPCRHGGKCLDLVDKYLCRCPSGTTGVNCEVNIDDCASNPCTFGVCRDGINRYDCVCQPGFTGPLCNVEINECASSPCGEGGSCVDGENGFRCLCPPGSLPPLCLPPSHPCAHEPCSHGICYDAPGGFRCVCEPGWSGPRCSQSLARDACESQPCRAGGTCSSDGMGFHCTCPPGVQGRQCELLSPCTPNPCEHGGRCESAPGQLPVCSCPQGWQDPCLNGGSCQDGVGSFSCSCLPGFAGPRCARDVDECLSNPCGPGTCTDHVASFTCTCPPGYGGFHCEQDLPDCSPSSCFNGGTCVDGVNSFSCLCRPGYTGAHCQHEADPCLSRPCLHGGVCSAAHPGFRCTCLESFTGPQCQTLVDWCSRQPCQNGGRCVQTGAYCLCPPGWSGRLCDIRSLPCREAAAQIGVRLEQLCQAGGQCVDEDSSHYCVCPEGRTGSHCEQEVDPCLAQPCQHGGTCRGYMGGYMCECLPGYNGDNCEDDVDECASQPCQHGGSCIDLVARYLCSCPPGTLGVLCEINEDDCGPGPPLDSGPRCLHNGTCVDLVGGFRCTCPPGYTGLRCEADINECRSGACHAAHTRDCLQDPGGGFRCLCHAGFSGPRCQTVLSPCESQPCQHGGQCRPSPGPGGGLTFTCHCAQPFWGPRCERVARSCRELQCPVGVPCQQTPRGPRCACPPGLSGPSCRSFPGSPPGASNASC

SEQ ID NO: 9432 - protein, 2321 aa, Homo Sapiens
MGPGARGRRRRRRPMSPPPPPPPVRALPLLLLLAGPGAAAPPCLDGSPCANGGRCTQLPSREAACLCPPGWVGERCQLEDPCHSGPCAGRGVCQSSVVAGTARFSCRCPRGFRGPDCSLPDPCLSSPCAHGARCSVGPDGRFLCSCPPGYQGRSCRSDVDECRVGEPCRHGGTCLNTPGSFRCQCPAGYTGPLCENPAVPCAPSPCRNGGTCRQSGDLTYDCACLPGFEGQNCEVNVDDCPGHRCLNGGTCVDGVNTYNCQCPPEWTGQFCTEDVDECQLQPNACHNGGTCFNTLGGHSCVCVNGWTGESCSQNIDDCATAVCFHGATCHDRVASFYCACPMGKTGLLCHLDDACVSNPCHEDAICDTNPVNGRAICTCPPGFTGGACDQDVDECSIGANPCEHLGRCVNTQGSFLCQCGRGYTGPRCETDVNECLSGPCRNQATCLDRIGQFTCICMAGFTGTYCEVDIDECQSSPCVNGGVCKDRVNGFSCTCPSGFSGSTCQLDVDECASTPCRNGAKCVDQPDGYECRCAEGFEGTLCDRNVDDCSPDPCHHGRCVDGIASFSCACAPGYTGTRCESQVDECRSQPCRHGGKCLDLVDKYLCRCPSGTTGVNCEVNIDDCASNPCTFGVCRDGINRYDCVCQPGFTGPLCNVEINECASSPCGEGGSCVDGENGFRCLCPPGSLPPLCLPPSHPCAHEPCSHGICYDAPGGFRCVCEPGWSGPRCSQSLARDACESQPCRAGGTCSSDGMGFHCTCPPGVQGRQCELLSPCTPNPCEHGGRCESAPGQLPVCSCPQGWQGPRCQQDVDECAGPAPCGPHGICTNLAGSFSCTCHGGYTGPSCDQDINDCDPNPCLNGGSCQDGVGSFSCSCLPGFAGPRCARDVDECLSNPCGPGTCTDHVASFTCTCPPGYGGFHCEQDLPDCSPSSCFNGGTCVDGVNSFSCLCRPGYTGAHCQHEADPCLSRPCLHGGVCSAAHPGFRCTCLESFTGPQCQTLVDWCSRQPCQNGGRCVQTGAYCLCPPGWSGRLCDIRSLPCREAAAQIGVRLEQLCQAGGQCVDEDSSHYCVCPEGRTGSHCEQEVDPCLAQPCQHGGTCRGYMGGYMCECLPGYNGDNCEDDVDECASQPCQHGGSCIDLVARYLCSCPPGTLGVLCEINEDDCGPGPPLDSGPRCLHNGTCVDLVGGFRCTCPPGYTGLRCEADINECRSGACHAAHTRDCLQDPGGGFRCLCHAGFSGPRCQTVLSPCESQPCQHGGQCRPSPGPGGGLTFTCHCAQPFWGPRCERVARSCRELQCPVGVPCQQTPRGPRCACPPGLSGPSCRSFPGSPPGASNASCAAAPCLHGGSCRPAPLAPFFRCACAQGWTGPRCEAPAAAPEVSEEPRCPRAACQAKRGDQRCDRECNSPGCGWDGGDCSLSVGDPWRQCEALQCWRLFNNSRCDPACSSPACLYDNFDCHAGGRERTCNPVYEKYCADHFADGRCDQGCNTEECGWDGLDCASEVPALLARGVLVLTVLLPPEELLRSSADFLQRLSAILRTSLRFRLDAHGQAMVFPYHRPSPGSEPRARRELAPEVIGSVVMLEIDNRLCLQSPENDHCFPDAQSAADYLGALSAVERLDFPYPLRDVRGEPLEPPEPSVPLLPLLVAGAVLLLVILVLGVMVARRKREHSTLWFPEGFSLHKDVASGHKGRREPVGQDALGMKNMAKGESLMGEVATDWMDTECPEAKRLKVEEPGMGAEEAVDCRQWTQHHLVAADIRVAPAMALTPPQGDADADGMDVNVRGPDGFTPLMLASFCGGALEPMPTEEDEADDTSASIISDLICQGAQLGARTDRTGETALHLAARYARADAAKRLLDAGADTNAQDHSGRTPLHTAVTADAQGVFQILIRNRSTDLDARMADGSTALILAARLAVEGMVEELIASHADVNAVDELGKSALHWAAAVNNVEATLALLKNGANKDMQDSKEETPLFLAAREGSYEAAKLLLDHFANREITDHLDRLPRDVAQERLHQDIVRLLDQPSGPRSPPGPHGLGPLLCPPGAFLPGLKAAQSGSKKSRRPPGKAGLGPQGPRGRGKKLTLACPGPLADSSVTLSPVDSLDSPRPFGGPPASPGGFPLEGPYAAATATAVSLAQLGGPGRAGLGRQPPGGCVLSLGLLNPVAVPLDWARLPPPAPPGPSFLLPLAPGPQLLNPGTPVSPQERPPPYLAVPGHGEEYPAAGAHSSPPKARFLRVPSEHPYLTPSPESPEHWASPSPPSLSDWSESTPSPATATGAMATTTGALPAQPLPLSVPSSLAQAQTQLGPQPEVTPKRQVLA

SEQ ID NO: 9433 - protein, 117 aa, Homo Sapiens
  misc_feature (1)..(1): Xaa can be any naturally occurring amino acid
XLMGEVATDWMDTECPEAKRLKVEEPGMGAEEAVDCRQWTQHHLVAADIRVAPAMALTPPQGDADADGMDVNVRGPDSHPKPLYRLGCPHGRWLNGTDPGGPPGSRGHGGRAHRQPC

SEQ ID NO: 9434 - protein, 177 aa, Homo Sapiens
  misc_feature (1)..(1): Xaa can be any naturally occurring amino acid
XQLGARTDRTGETALHLAARYARADAAKRLLDAGADTNAQDHSGRTPLHTAVTADAQGVFQILIRNRSTDLDARMADGSTALILAARLAVEGMVEELIASHADVNAVDELGKSALHWAAAVNNVEATLALLKNGANKDMQDSKVSPSPWSTGCQQWHSAIAIQPGQQSETLSKNKTK

SEQ ID NO: 9435 - protein, 295 aa, Homo Sapiens
MGRGVRVLLLLSLLHCAGGSEGRKTWRRRGQQPPPPPRTEAAPAAGQPVESFPLDFTAVEGNMDSFMAQVKSLAQSLYPCSAQQLNEDLRLHLLLNTSVTCNDGSPAGYYLKESRGSRRWLLFLEGGWYCFNRENCDSRYDTMRRLMSSRDWPRTRTGTGILSSQPEENPYWWNANMVFIPYCSSDVWSGASSKSEKNEYAFMGALIIQEVVRELLGRGLSGAKVLLLAGSSAGGTGVLLNVDRVAEQLEKLGYPAIQVRGLADSGWFLDNKQYRHTDCVDTITCAPTEAIRRGI

SEQ ID NO: 9436 - protein, 496 aa, Homo Sapiens
MGRGVRVLLLLSLLHCAGGSEGRKTWRRRGQQPPPPPRTEAAPAAGQPVESFPLDFTAVEGNMDSFMAQVKSLAQSLYPCSAQQLNEDLRLHLLLNTSVTCNDGSPAGYYLKESRGSRRWLLFLEGGWYCFNRENCDSRYDTMRRLMSSRDWPRTRTGTGILSSQPEENPYWWNANMVFIPYCSSDVWSGASSKSEKNEYAFMGALIIQEVVRELLGRGLSGAKVLLLAGSSAGGTGVLLNVDRVAEQLEKLGYPAIQVRGLADSGWFLDNKQYRHTDCVDTITCAPTEAIRRGIRYWNGVVPERCRRQFQEGEEWNCFFGYKVYPTLRCPVFVVQWLFDEAQLTVDNVHLTGQPVQEGLRLYIQNLGRELRHTLKDVPASFAPACLSHEIIIRSHWTDVQVKGTSLPRALHCWDRSLHDSHKASKTPLKGCPVHLVDSCPWPHCNPSCPTVRDQFTGQEMNVAQFLMHMGFDMQTVAQPQGLEPSELLGMLSNGS

SEQ ID NO: 9437 - protein, 197 aa, Homo Sapiens
MRRLMSSRDWPRTRTGTGILSSQPEENPYWWNANMVFIPYCSSDVWSGASSKSEKNEYAFMGALIIQEVVRELLGRGLSGAKVLLLAGSSAGGTGVLLNVDRVAEQLEKLGYPAIQVRGLADSGWFLDNKQYRHTDCVDTITCAPTEAIRRGIRYWNGVVPERCRRQFQEGEEWNCFFGYKVYPTLRCPVFVVQWLF

SEQ ID NO: 9438 - protein, 357 aa, Homo Sapiens
MQSVQSTSFCLRKQCLCLTFLLLHLLGQVAATQRCPPQCPGRCPATPPTCAPGVRAVLDGCSCCLVCARQRGESCSDLEPCDESSGLYCDRSADPSNQTGICTAVEGDNCVFDGVIYRSGEKFQPSCKFQCTCRDGQIGCVPRCQLDVLLPEPNCPAPRKVEVPGECCEKWICGPDEEDSLGGLTLAAYRPEATLGVEVSDSSVNCIEQTTEWTACSKSCGMGFSTRVTNRNRQCEMLKQTRLCMVRPCEQEPEQPTDKKGKKCLRTKKSLKAIHLQFKNCTSLHTYKPRFCGVCSDGRCCTPHNTKTIQAEFQCSPGQIVKKPVMVIGTCTCHTNCPKNNEAFLQELELKTTRGKM

SEQ ID NO: 9439 - protein, 125 aa, Homo Sapiens
MARSATLAAAALALCLLLAPPGLAWYKPAAGHSSYSVGRAAGLLSGLRRSPYARRSQPYRGAEPPGGAGASPELQLHPRLRSLAVCVQDVAPNLQRCERLPDGRGTYQCKANVFLSLRAADCLAA

SEQ ID NO: 9440 - protein, 156 aa, Homo Sapiens
MARSATLAAAALALCLLLAPPGLAWYKPAAGHSSYSVGRAAGLLSGLRRSPYARRSQPYRGAEPPGGAGASPELQLHPRLRSLVSPACRGLMGGGGRTWVGVRRPLSLCLPAPQAVCVQDVAPNLQRCERLPDGRGTYQCKANVFLSLRAADCLAA

SEQ ID NO: 9441 - protein, 53 aa, Homo Sapiens
GAQHRCPGRTGAVQGLRFCGWSYKGSECEPMPHPTLPAEQRTVLQRQCHLHQQ

SEQ ID NO: 9442 - protein, 201 aa, Homo Sapiens
MRFLAATFLLLALSTAAQAEPVQFKDCGSVDGVIKEVNVSPCPTQPCQLSKGQSYSVNVTFTSNIQSKSSKAVVHGILMGVPVPFPIPEPDGCKSGINCPIQKDKTYSYLNKLPVKSEYPSIKLVVEWQLQDDKNQSLFCWEIPVQIMFPCLFSAHCPMLATEHRCLQLQMETKSLRFWSRRGMSVWLPSPAGAWRRTAPF

SEQ ID NO: 9443 - protein, 151 aa, Homo Sapiens
MRFLAATFLLLALSTAAQAEPVQFKDCGSVDGVIKEVNVSPCPTQPCQLSKGQSYSVNVTFTSNIQSKSSKAVVHGILMGVPVPFPIPEPDGCKSGINCPIQKDKTYSYLNKLPVKSEYPSIKLVVEWQLQDDKNQSLFCWEIPVQIVSHL

SEQ ID NO: 9444 - protein, 174 aa, Homo Sapiens
MRFLAATFLLLALSTAAQAEPVQFKDCGSVDGVIKEVNVSPCPTQPCQLSKGQSYSVNVTFTSNIQSKSSKAVVHGILMGVPVPFPIPEPDGCKSGINCPIQKDKTYSYLNKLPVKSEYPSIKLVVEWQLQDDKNQSLFCWEIPVQIVSLSGGERAWVEGRKWRRNQTETKSVP

SEQ ID NO: 9445 - protein, 221 aa, Homo Sapiens
MRFLAATFLLLALSTAAQAEPVQFKDCGSVDGVIKEVNVSPCPTQPCQLSKGQSYSVNVTFTSNIQSKSSKAVVHGILMGVPVPFPIPEPDGCKSGINCPIQKDKTYSYLNKLPVKSEYPSIKLVVEWQLQDDKNQSLFCWEIPVQIVSLSGGFSSLSASLSSVHLANESAETLDSTSSSAASTTVTCSPMVSSDSLKRRCSVAETELRVAGSQWLSHVSF

SEQ ID NO: 9446 - protein, 148 aa, Homo Sapiens
MRFLAATFLLLALSTAAQAEPVQFKDCGSVDGVIKEVNVSPCPTQPCQLSKGQSYSVNVTFTSNIQSKSSKAVVHGILMGVPVPFPIPEPDGCKSGINCPIQKDKTYSYLNKLPVKSEYPSIKLVVEWQLQDDKNQSLFCWEIPVSHL

SEQ ID NO: 9447 - protein, 122 aa, Homo Sapiens
MRFLAATFLLLALSTAAQAEPVQFKDCGSVDGVIKEVNVSPCPTQPCQLSKGQSYSVNVTFTSNIQSKSSKAVVHGILMGVPVPFPIPEPDGCKSGINCPIQKDKTYSYLNKLPVKSEYPSV

SEQ ID NO: 9448 - protein, 125 aa, Homo Sapiens
MRFLAATFLLLALSTAAQAEPVQFKDCGSVDGVIKEVNVSPCPTQPCQLSKGQSYSVNVTFTSNIQSKSSKAVVHGILMGVPVPFPIPEPDGCKSGINCPIQKDKTYSYLNKLPVKSEYPSVSHL

SEQ ID NO: 9449 - protein, 173 aa, Homo Sapiens
  misc_feature (1)..(1): Xaa can be any naturally occurring amino acid
XPLRVRPPTWTQLSVRRICPSPASGLEDDASRRAWGPREAVRSLRAREEGSVDGVIKEVNVSPCPTQPCQLSKGQSYSVNVTFTSNIQSKSSKAVVHGILMGVPVPFPIPEPDGCKSGINCPIQKDKTYSYLNKLPVKSEYPSIKLVVEWQLQDDKNQSLFCWEIPVQIVSHL

SEQ ID NO: 9450 - protein, 113 aa, Homo Sapiens
MDSRQAAALLVLLLLIDGGCAEGPGGQQEDQLSAEEDSEPLPPQDAQTSGSLLHYLLQAMERPGRSQAFLFQPQRFGRNTQGSWRNEWLSPRAGEGLNSQFWSLAAPQRFGKK

SEQ ID NO: 9451 - protein, 423 aa, Homo Sapiens
MFIMNEKWDTNSSENWHPIWNVNDTKHHLYSDINITYVNYYLHQPQVAAIFIISYFLIFFLCMMGNTVVCFIVMRNKHMHTVTNLFILNLAISDLLVGIFCMPITLLDNIIAGWPFGNTMCKISGLVQGISVAASVFTLVAIAVDRFQCVVYPFKPKLTIKTAFVIIMIIWVLAITIMSPSAVMLHVQEEKYYRVRLNSQNKTSPVYWCREDWPNQEMRKIYTTVLFANIYLAPLSLIVIMYGRIGISLFRAAVPHTGRKNQEQWHVVSRKKQKIIKMLLIVALLFILSWLPLWTLMMLSDYADLSPNELQIINIYIYPFAHWLAFGNSSVNPIIYGFFNENFRRGFQEAFQLQLCQKRAKPMEAYALKAKSHVLINTSNQLVQESTFQNPHGETLLYRKSAEKPQQELVMEELKETTNSSEI

SEQ ID NO: 9452 - protein, 420 aa, Homo Sapiens
MNEKWDTNSSENWHPIWNVNDTKHHLYSDINITYVNYYLHQPQVAAIFIISYFLIFFLCMMGNTVVCFIVMRNKHMHTVTNLFILNLAISDLLVGIFCMPITLLDNIIAGWPFGNTMCKISGLVQGISVAASVFTLVAIAVDRFQCVVYPFKPKLTIKTAFVIIMIIWVLAITIMSPSAVMLHVQEEKYYRVRLNSQNKTSPVYWCREDWPNQEMRKIYTTVLFANIYLAPLSLIVIMYGRIGISLFRAAVPHTGRKNQEQWHVVSRKKQKIIKMLLIVALLFILSWLPLWTLMMLSDYADLSPNELQIINIYIYPFAHWLAFGNSSVNPIIYGFFNENFRRGFQEAFQLQLCQKRAKPMEAYALKAKSHVLINTSNQLVQESTFQNPHGETLLYRKSAEKPQQELVMEELKETTNSSEI

SEQ ID NO: 9453 - protein, 522 aa, Homo Sapiens
MNSFFGTPAASWCLLESDVSSAPDKEAGRERRALSVQQRGGPAWSGSLEWSRQSAGDRRRLGLSRQTAKSSWSRSRDRTCCCRRAWWILVPAADRARRERFIMNEKWDTNSSENWHPIWNVNDTKHHLYSDINITYVNYYLHQPQVAAIFIISYFLIFFLCMMGNTVVCFIVMRNKHMHTVTNLFILNLAISDLLVGIFCMPITLLDNIIAGWPFGNTMCKISGLVQGISVAASVFTLVAIAVDRFQCVVYPFKPKLTIKTAFVIIMIIWVLAITIMSPSAVMLHVQEEKYYRVRLNSQNKTSPVYWCREDWPNQEMRKIYTTVLFANIYLAPLSLIVIMYGRIGISLFRAAVPHTGRKNQEQWHVVSRKKQKIIKMLLIVALLFILSWLPLWTLMMLSDYADLSPNELQIINIYIYPFAHWLAFGNSSVNPIIYGFFNENFRRGFQEAFQLQLCQKRAKPMEAYALKAKSHVLINTSNQLVQESTFQNPHGETLLYRKSAEKPQQELVMEELKETTNSSEI

SEQ ID NO: 9454 - protein, 132 aa, Homo Sapiens
MNSFFGTPAASWCLLESDVSSAPDKEAGRERRALSVQQRGGPAWSGSLEWSRQSAGDRRRLGLSRQTAKSSWSRSRDRTCCCRRAWWILVPAADRARRERMAIWKHDVQDQWIGPGNICRSFSLYVSCNCCR

SEQ ID NO: 9455 - protein, 1201 aa, Homo Sapiens
MALGTTLRASLLLLGLLTEGLAQLAIPASVPRGFWALPENLTVVEGASVELRCGVSTPGSAVQWAKDGLLLGPDPRIPGFPRYRLEGDPARGEFHLHIEACDLSDDAEYECQVGRSEMGPELVSPRVILSILVPPKLLLLTPEAGTMVTWVAGQEYVVNCVSGDAKPAPDITILLSGQTISDISANVNEGSQQKLFTVEATARVTPRSSDNRQLLVCEASSPALEAPIKASFTVNVLFPPGPPVIEWPGLDEGHVRAGQSLELPCVARGGNPLATLQWLKNGQPVSTAWGTEHTQAVARSVLVMTVRPEDHGAQLSCEAHNSVSAGTQEHGITLQVTFPPSAIIILGSASQTENKNVTLSCVSKSSRPRVLLRWWLGWRQLLPMEETVMDGLHGGHISMSNLTFLARREDNGLTLTCEAFSEAFTKETFKKSLILNVKYPAQKLWIEGPPEGQKLRAGTRVRLVCLAIGGNPEPSLMWYKDSRTVTESRLPQESRRVHLGSVEKSGSTFSRELVLVTGPSDNQAKFTCKAGQLSASTQLAVQFPPTNVTILANASALRPGDALNLTCVSVSSNPPVNLSWDKEGERLEGVAAPPRRAPFKGSAAARSVLLQVSSRDHGQRVTCRAHSAELRETVSSFYRLNVLYRPEFLGEQVLVVTAVEQGEALLPVSVSANPAPEAFNWTFRGYRLSPAGGPRHRILSSGALHLWNVTRADDGLYQLHCQNSEGTAEARLRLDVHYAPTIRALQDPTEVNVGGSVDIVCTVDANPILPGMFNWERLGEDEEDQSLDDMEKISRGPTGRLRIHHAKLAQAGAYQCIVDNGVAPPARRLLRLVVRFAPQVEHPTPLTKVAAAGDSTSSATLHCRARGVPNIVFTWTKNGVPLDLQDPRYTEHTYHQGGVHSSLLTIANVSAAQDYALFTCTATNALGSDQTNIQLVSISRPDPPSGLKVVSLTPHSVGLEWKPGFDGGLPQRFCIRYEALGTPGFHYVDVVPPQATTFTLTGLQPSTRYRVWLLASNALGDSGLADKGTQLPITTPGLHQPSGEPEDQLPTEPPSGISEKTEAGSEEDRVRNEYEESQWTGERDTQSSTVSTTEAEPYYRSLRDFSPQLPPTQEEVSYSRGFTGEDEDMAFPGHLYDEVERTYPPSGAWGPLYDEVQMGPWDLHWPEDTYQDPRGIYDQVAGDLDTLEPDSLPFELRGHLV

SEQ ID NO: 9456 - protein, 1241 aa, Homo Sapiens
MALGTTLRASLLLLGLLTEGLAQLAIPASVPRGFWALPENLTVVEGASVELRCGVSTPGSAVQWAKDGLLLGPDPRIPGFPRYRLEGDPARGEFHLHIEACDLSDDAEYECQVGRSEMGPELVSPRVILSILVPPKLLLLTPEAGTMVTWVAGQEYVVNCVSGDAKPAPDITILLSGQTISDISANVNEGSQQKLFTVEATARVTPRSSDNRQLLVCEASSPALEAPIKASFTVNVLFPPGPPVIEWPGLDEGHVRAGQSLELPCVARGGNPLATLQWLKNGQPVSTAWGTEHTQAVARSVLVMTVRPEDHGAQLSCEAHNSVSAGTQEHGITLQVTFPPSAIIILGSASQTENKNVTLSCVSKSSRPRVLLRWWLGWRQLLPMEETVMDGLHGGHISMSNLTFLARREDNGLTLTCEAFSEAFTKETFKKSLILNVKYPAQKLWIEGPPEGQKLRAGTRVRLVCLAIGGNPEPSLMWYKDSRTVTESRLPQESRRVHLGSVEKSGSTFSRELVLVTGPSDNQAKFTCKAGQLSASTQLAVQFPPTNVTILANASALRPGDALNLTCVSVSSNPPVNLSWDKEGERLEGVAAPPRRAPFKGSAAARSVLLQVSSRDHGQRVTCRAHSAELRETVSSFYRLNVLYRPEFLGEQVLVVTAVEQGEALLPVSVSANPAPEAFNWTFRGYRLSPAGGPRHRILSSGALHLWNVTRADDGLYQLHCQNSEGTAEARLRLDVHYAPTIRALQDPTEVNVGGSVDIVCTVDANPILPGMFNWERLGEDEEDQSLDDMEKISRGPTGRLRIHHAKLAQAGAYQCIVDNGVAPPARRLLRLVVRFAPQVEHPTPLTKVAAAGDSTSSATLHCRARGVPNIVFTWTKNGVPLDLQDPRYTEHTYHQGGVHSSLLTIANVSAAQDYALFTCTATNALGSDQTNIQLVSISRPDPPSGLKVVSLTPHSVGLEWKPGFDGGLPQRFCIRYEALGTPGFHYVDVVPPQATTFTLTGLQPSTRYRVWLLASNALGDSGLADKGTQLPITTPGLHQPSGEPEDQLPTEPPSGPSGLPLLPVLFALGGLLLLSNASCVGGVLWQRRLRRLAEGISEKTEAGSEEDRVRNEYEESQWTGERDTQSSTVSTTEAEPYYRSLRDFSPQLPPTQEEVSYSRGFTGEDEDMAFPGHLYDEVERTYPPSGAWGPLYDEVQMGPWDLHWPEDTYQDPRGIYDQVAGDLDTLEPDSLPFELRGHLV

SEQ ID NO: 9457 - protein, 609 aa, Homo Sapiens
MDFLLALVLVSSLYLQAAAEFDGRWPRQIVSSIGLCRYGGRIDCCWGWARQSWGQCQPFYVLRQRIARIRCQLKAVCQPRCKHGECIGPNKCKCHPGYAGKTCNQDEHIPAPLDQGSEQPLFQPLDHQATSLPSRDLNECGLKPRPCKHRCMNTYGSYKCYCLNGYMLMPDGSCSSALTCSMANCQYGCDVVKGQIRCQCPSPGLQLAPDGRTCVDVDECATGRASCPRFRQCVNTFGSYICKCHKGFDLMYIGGKYQCHDIDECSLGQYQCSSFARCYNIRGSYKCKCKEGYQGDGLTCVYIPKVMIEPSGPIHVPKGNGTILKGDTGNNNWIPDVGSTWWPPKTPYIPPIITNRPTSKPTTRPTPKPTPIPTPPPPPPLPTELRTPLPPTTPERPTTGLTTIAPAASTPPGGITVDNRVQTDPQKPRGDVFIPRQPSNDLFEIFEIERGVSADDEAKDDPGVLVHSCNFDHGLCGWIREKDNDLHWEPIRDPAGGQYLTVSAAKAPGGKAARLVLPLGRLMHSGDLCLSFRHKVTGLHSGTLQVFVRKHGAHGAALWGRNGGHGWRQTQITLRGADIKSVVFKGEKRRGHTGEIGLDDVSLKKGHCS

SEQ ID NO: 9458 - protein, 582 aa, Homo Sapiens
MDFLLALVLVSSLYLQAAAEFDGRWPRQIVSSIGLCRYGGRIDCCWGWARQSWGQCQPFYVLRQRIARIRCQLKAVCQPRCKHGECIGPNKCKCHPGYAGKTCNQDLNECGLKPRPCKHRCMNTYGSYKCYCLNGYMLMPDGSCSSALTCSMANCQYGCDVVKGQIRCQCPSPGLQLAPDGRTCVDVDECATGRASCPRFRQCVNTFGSYICKCHKGFDLMYIGGKYQCHDIDECSLGQYQCSSFARCYNIRGSYKCKCKEGYQGDGLTCVYIPKVMIEPSGPIHVPKGNGTILKGDTGNNNWIPDVGSTWWPPKTPYIPPIITNRPTSKPTTRPTPKPTPIPTPPPPPPLPTELRTPLPPTTPERPTTGLTTIAPAASTPPGGITVDNRVQTDPQKPRGDVFIPRQPSNDLFEIFEIERGVSADDEAKDDPGVLVHSCNFDHGLCGWIREKDNDLHWEPIRDPAGGQYLTVSAAKAPGGKAARLVLPLGRLMHSGDLCLSFRHKVTGLHSGTLQVFVRKHGAHGAALWGRNGGHGWRQTQITLRGADIKSVVFKGEKRRGHTGEIGLDDVSLKKGHCSEER

SEQ ID NO: 9459 - protein, 595 aa, Homo Sapiens
MDFLLALVLVSSLYLQAAAEFDGRWPRQIVSSIGLCRYGGRIDCCWGWARQSWGQCQPVCQPRCKHGECIGPNKCKCHPGYAGKTCNQDEHIPAPLDQGSEQPLFQPLDHQATSLPSRDLNECGLKPRPCKHRCMNTYGSYKCYCLNGYMLMPDGSCSSALTCSMANCQYGCDVVKGQIRCQCPSPGLQLAPDGRTCVDVDECATGRASCPRFRQCVNTFGSYICKCHKGFDLMYIGGKYQCHDIDECSLGQYQCSSFARCYNIRGSYKCKCKEGYQGDGLTCVYIPKVMIEPSGPIHVPKGNGTILKGDTGNNNWIPDVGSTWWPPKTPYIPPIITNRPTSKPTTRPTPKPTPIPTPPPPPPLPTELRTPLPPTTPERPTTGLTTIAPAASTPPGGITVDNRVQTDPQKPRGDVFIPRQPSNDLFEIFEIERGVSADDEAKDDPGVLVHSCNFDHGLCGWIREKDNDLHWEPIRDPAGGQYLTVSAAKAPGGKAARLVLPLGRLMHSGDLCLSFRHKVTGLHSGTLQVFVRKHGAHGAALWGRNGGHGWRQTQITLRGADIKSVVFKGEKRRGHTGEIGLDDVSLKKGHCSEER

SEQ ID NO: 9460 - protein, 566 aa, Homo Sapiens
MDFLLALVLVSSLYLQAAAEFDGRWPRQIVSSIGLCRYGGRIDCCWGWARQSWGQCQPVCQPRCKHGECIGPNKCKCHPGYAGKTCNQDEHIPAPLDQGSEQPLFQPLDHQATSLPSRDLNECGLKPRPCKHRCMNTYGSYKCYCLNGYMLMPDGSCSSALTCSMANCQYGCDVVKGQIRCQCPSPGLQLAPDGRTCVDVDECATGRASCPRFRQCVNTFGSYICKCHKGFDLMYIGGKYQCHDIDECSLGQYQCSSFARCYNIRGSYKCKCKEGYQGDGLTCVYIPKVMIEPSGPIHVPKGNGTILKGDTGNNNWIPDVGSTWWPPKTPYIPPIITNRPTSKPTTRPTPKPTPIPTPPPPPPLPTELRTPLPPTTPERPTTGLTTIAPAASTPPGGITVDNRVQTDPQKPRGDVFSVLVHSCNFDHGLCGWIREKDNDLHWEPIRDPAGGQYLTVSAAKAPGGKAARLVLPLGRLMHSGDLCLSFRHKVTGLHSGTLQVFVRKHGAHGAALWGRNGGHGWRQTQITLRGADIKSVVFKGEKRRGHTGEIGLDDVSLKKGHCSEER

SEQ ID NO: 9461 - protein, 509 aa, Homo Sapiens
MDFLLALVLVSSLYLQAAAEFDGRWPRQIVSSIGLCRYGGRIDCCWGWARQSWGQCQPVCQPRCKHGECIGPNKCKCHPGYAGKTCNQDLNECGLKPRPCKHRCMNTYGSYKCYCLNGYMLMPDGSCSSALTCSMANCQYGCDVVKGQIRCQCPSPGLQLAPDGRTCVDVDECATGRASCPRFRQCVNTFGSYICKCHKGFDLMYIGGKYQCHDIDECSLGQYQCSSFARCYNIRGSYKCKCKEGYQGDGLTCVYIPKVMIEPSGPIHVPKGNGTILKGDTGNNNWIPDVGSTWWPPKTPYIPPIITNRPTSKPTTRPTPKPTPIPTPPPPPPLPTELRTPLPPTTPERPTTGLTTIAPAASTPPGGITVDNRVQTDPQKPRGDVFSVLVHSCNFDHGLCGWIREKDNDLHWEPIRDPAGGQYLTVSAAKAPGGKAARLVLPLGRLMHSGDLCLSFRHKVTGLHSGTLQVFVRKHGAHGAALWGRNGGHGWRQTQITLRGADIKSESQR

SEQ ID NO: 9462 - protein, 565 aa, Homo Sapiens
MDFLLALVLVSSLYLQAAAEFDGRWPRQIVSSIGLCRYGGRIDCCWGWARQSWGQCQPVCQPRCKHGECIGPNKCKCHPGYAGKTCNQDLNECGLKPRPCKHRCMNTYGSYKCYCLNGYMLMPDGSCSSALTCSMANCQYGCDVVKGQIRCQCPSPGLQLAPDGRTCVDVDECATGRASCPRFRQCVNTFGSYICKCHKGFDLMYIGGKYQCHDIDECSLGQYQCSSFARCYNIRGSYKCKCKEGYQGDGLTCVYIPKVMIEPSGPIHVPKGNGTILKGDTGNNNWIPDVGSTWWPPKTPYIPPIITNRPTSKPTTRPTPKPTPIPTPPPPPPLPTELRTPLPPTTPERPTTGLTTIAPAASTPPGGITVDNRVQTDPQKPRGDVFIPRQPSNDLFEIFEIERGVSADDEAKDDPGVLVHSCNFDHGLCGWIREKDNDLHWEPIRDPAGGQYLTVSAAKAPGGKAARLVLPLGRLMHSGDLCLSFRHKVTGLHSGTLQVFVRKHGAHGAALWGRNGGHGWRQTQITLRGADIKSVVFKGEKRRGHTGEIGLDDVSLKKGHCSEER

SEQ ID NO: 9463 - protein, 536 aa, Homo Sapiens
MDFLLALVLVSSLYLQAAAEFDGRWPRQIVSSIGLCRYGGRIDCCWGWARQSWGQCQPVCQPRCKHGECIGPNKCKCHPGYAGKTCNQDLNECGLKPRPCKHRCMNTYGSYKCYCLNGYMLMPDGSCSSALTCSMANCQYGCDVVKGQIRCQCPSPGLQLAPDGRTCVDVDECATGRASCPRFRQCVNTFGSYICKCHKGFDLMYIGGKYQCHDIDECSLGQYQCSSFARCYNIRGSYKCKCKEGYQGDGLTCVYIPKVMIEPSGPIHVPKGNGTILKGDTGNNNWIPDVGSTWWPPKTPYIPPIITNRPTSKPTTRPTPKPTPIPTPPPPPPLPTELRTPLPPTTPERPTTGLTTIAPAASTPPGGITVDNRVQTDPQKPRGDVFSVLVHSCNFDHGLCGWIREKDNDLHWEPIRDPAGGQYLTVSAAKAPGGKAARLVLPLGRLMHSGDLCLSFRHKVTGLHSGTLQVFVRKHGAHGAALWGRNGGHGWRQTQITLRGADIKSVVFKGEKRRGHTGEIGLDDVSLKKGHCSEER

SEQ ID NO: 9464 - protein, 61 aa, Homo Sapiens
MNTYGSYKCYCLNGYMLMPDGSCSSALTCSMANCQYGCDVVKGQIRCQCPSPGLQLAPDGR

SEQ ID NO: 9465 - protein, 104 aa, Homo Sapiens
  misc_feature (1)..(1): Xaa can be any naturally occurring amino acid
XGLCGWIREKDNDLHWEPIRDPAGITKMIKGLEKKIYDGKLKELGLLSLEKRRLRGKPLMVFKYMKGWHREGGDQLFSICTKNRTRGNWLRLEYKGAFLGRGHC

SEQ ID NO: 9466 - protein, 26 aa, Homo Sapiens
  misc_feature (1)..(1): Xaa can be any naturally occurring amino acid
XNDLHWEPIRDPADNCSCLHAGGLDL

SEQ ID NO: 9467 - protein, 453 aa, Homo Sapiens
  misc_feature (1)..(1): Xaa can be any naturally occurring amino acid
XWPRQIVSSIGLCRYGGRIDCCWGWARQSWGQCQPVCQPRCKHGECIGPNKCKCHPGYAGKTCNQDLNECGLKPRPCKHRCMNTYGSYKCYCLNGYMLMPDGSCSSALTCSMANCQYGCDVVKGQIRCQCPSPGLQLAPDGRTCVDVDECATGRASCPRFRQCVNTFGSYICKCHKGFDLMYIGGKYQCHDIDECSLGQYQCSSFARCYNIRGSYKCKCKEGYQGDGLTCVYIPKVMIEPSGPIHVPKGNGTILKGDTGNNNWIPDVGSTWWPPKTPYIPPIITNRPTSKPTTRPTPKPTPIPTPPPPPPLPTELRTPLPPTTPERPTTGLTTIAPAASTPPGGITVDNRVQTDPQKPRGDVFIPRQPSNDLFEIFEIERGVSADDEAKDDPGVLVHSCNFDHGLCGWIREKDNDLHWEPIRDPAEILQGTQFREIFIGCILSASCVTSYLGC

SEQ ID NO: 9468 - protein, 101 aa, Homo Sapiens
MPLEDEVVPPQVLSEPNEEAGAALSPLPEVPPWTGEVSPAQRDGGALGRGPWDSSDRSALLKSKLRALLTAPRSLRRSSCFGGRMDRIGAQSGLGCNSFRY

SEQ ID NO: 9469 - protein, 151 aa, Homo Sapiens
MSSFSTTTVSFLLLLAFQLLGQTRANPMYNAVSNADLMDFKNLLDHLEEKMPLEDEVVPPQVLSEPNEEAGAALSPLPEVPPWTGEVSPAQRDGGALGRGPWDSSDRSALLKSKLRALLTAPRSLRRSSCFGGRMDRIGAQSGLGCNSFRY

SEQ ID NO: 9470 - protein, 152 aa, Homo Sapiens [sequence omitted]

SEQ ID NO: 9471 - protein, 134 aa, Homo Sapiens
MDPQTAPSRALLLLLFLHLAFLGGRSHPLGSPGSASDLETSGLQEQRNHLQGKLSELQVEQTSLEPLQESPRPTGVWKSREVATEGIRGHRKMVLYTLRAPRSPKMVQGSGCFGRKMDRISSSSGLGCKVLRRH

SEQ ID NO: 9472 - protein, 126 aa, Homo Sapiens
MHLSQLLACALLLTLLSLRPSEAKPGAPPKVPRTPPAEELAEPQAAGGGQKKGDKAPGGGGANLKGDRSRLLRDLRVDTKSRAAWARLLQEHPNARKYKGANKKGLSKGCFGLKLDRIGSMSGLGC

SEQ ID NO: 9473 - protein, 126 aa, Homo Sapiens; identical to SEQ ID NO: 9472

SEQ ID NO: 9474 - protein, 89 aa, Homo Sapiens
MISSVKLNLILVLSLSTMHVFWCYPVPSSKVSGKSDYFLILLNSCPTRLDRSKELAFLKPILEKMFVKRSFRNGVGTGMKKTSFQRAKS

SEQ ID NO: 9475 - protein, 432 aa, Homo Sapiens
MPAGRAARTCALLALCLLGAGAQDFGPTRFICTSVPVDADMCAASVAAGGAEELRSSVLQLRETVLQQKETILSQKETIRELTAKLGRCESQSTLDPGAGEARAGGGRKQPGSGKNTMGDLSRTPAAETLSQLGQTLQSLKTRLENLEQYSRLNSSSQTNSLKDLLQSKIDELERQVLSRVNTLEEGKGGPRNDTEERVKIETALTSLHQRISELEKGQKDNRPGDKFQLTFPLRTNYMYAKVKKSLPEMYAFTVCMWLKSSATPGVGTPFSYAVPGQANELVLIEWGNNPMEILINDKVAKLPFVINDGKWHHICVTWTTRDGVWEAYQDGTQGGSGENLAPYHPIKPQGVLVLGQEQDTLGGGFDATQAFVGELAHFNIWDRKLTPGEVYNLATCSTKALSGNVIAWAESHIEIYGGATKWTFEACRQIN

SEQ ID NO: 9476 - protein, 431 aa, Homo Sapiens
MLALLAASVALAVAAGAQDSPAPGSRFVCTALPPEAVHAGCPLPAMPMQGGAQSPEEELRAAVLQLRETVVQQKETLGAQREAIRELTGKLARCEGLAGGKARGAGATGKDTMGDLPRDPGHVVEQLSRSLQTLKDRLESLEHQLRANVSNAGLPGDFREVLQQRLGELERQLLRKVAELEDEKSLLHNETSAHRQKTESTLNALLQRVTELERGNSAFKSPDAFKVSLPLRTNYLYGKIKKTLPELYAFTICLWLRSSASPGIGTPFSYAVPGQANEIVLIEWGNNPIELLINDKVAQLPLFVSDGKWHHICVTWTTRDGMWEAFQDGEKLGTGENLAPWHPIKPGGVLILGQEQDTVGGRFDATQAFVGELSQFNIWDRVLRAQEIVNIANCSTNMPGNIIPWVDNNVDVFGGASKWPVETCEERLLDL

SEQ ID NO: 9477 - protein, 500 aa, Homo Sapiens
LKFLAVLLAAGMLAFLGAVICIIASVPLAASPARALPGGADNASVASGAAASPGPQRSLSALHGAGGSAGPPALPGAPAASAHPLPPGPLFSRFLCTPLAAACPSGAQQGDAAGAAPGEREELLLLQSTAEQLRQTALQQEARIRADQDTIRELTGKLGRCESGLPRGLQGAGPRRDTMADGPWDSPALILELEDAVRALRDRIDRLEQELPARVNLSAAPAPVSAVPTGLHSKMDQLEGQLLAQVLALEKERVALSHSSRRQRQEVEKELDVLQGRVAELEHGSSAYSPPDAFKISIPIRNNYMYARVRKALPELYAFTACMWLRSRSSGTGQGTPFSYSVPGQANEIVLLEAGHEPMELLINDKVAQLPLSLKDNGWHHICIAWTTRDGLWSAYQDGELQGSGENLAAWHPIKPHGILILGQEQDTLGGRFDATQAFVGDIAQFNLWDHALTPAQVLGIANCTAPLLGNVLPWEDKLVEAFGGATKAAFDVCKGRAKA

SEQ ID NO: 9478 - protein, 500 aa, Homo Sapiens; identical to SEQ ID NO: 9477

SEQ ID NO: 9479 - protein, 196 aa, Homo Sapiens
MEIISSKLFILLTLATSSLLTSNIFCADELVMSNLHSKENYDKYSEPRGYPKGERSLNFEELKDWGPKNVIKMSTPAVNKMPHSFANLPLRFGRNVQEERSAGATANLPLRSGRNMEVSLVRRVPNLPQRFGRTTTAKSVCRMLSDLCQGSMHSPCANDLFYSMTCQHQEIQNPDQKQSRRLLFKKIDDAELKQEK

SEQ ID NO: 9480 - protein, 165 aa, Homo Sapiens
LAWRPGERGAPASRPRLALLLLLLLLPLPSGAWYKHVASPRYHTVGRAAGLLMGLRRSPYLWRRALRAAAGPLARDTLSPEPAAREAPLLLPSWVQELWETRRRSSQAGIPVRAPRSPRAPEPALEPESLDFSGAGQRLRRDVSRPAVDPAANRLGLPCLAPGPF

SEQ ID NO: 9481 - protein, 113 aa, Homo Sapiens
MGLRRSPYLWRRALRAAAGPLARDTLSPEPAAREAPLLLPSWVQELWETRRRSSQAGIPVRAPRSPRAPEPALEPESLDFSGAGQRLRRDVSRPAVDPAANRLGLPCLAPGPF

SEQ ID NO: 9482 - protein, 128 aa, Homo Sapiens
MSRPLEGPRGHAASPGLLWATRVTSTLAGLHELALSDETRHNWFASQMNKGSCLSPARLLSCCPRGFRSCGRRDAGAPRQGSPSVRPGARAPQSLRWNRSPWTSAELARDFGETSPAQRWTPQQTALA

SEQ ID NO: 9483 - protein, 97 aa, Homo Sapiens
MLGNKRLGLSGLTLALSLLVCLGALAEAYPSKPDNPGEDAPAEDMARYYSALRHYINLITRQRYGKRSSPETLISDLLMRESTENVPRTRLEDPAMW

SEQ ID NO: 9484 - protein, 97 aa, Homo Sapiens; identical to SEQ ID NO: 9483

SEQ ID NO: 9485 - protein, 97 aa, Homo Sapiens; identical to SEQ ID NO: 9483

SEQ ID NO: 9486 - protein, 35 aa, Homo Sapiens
MAEFRFLKSGALPILSLLCLQALKFSLGCSRGSSE

SEQ ID NO: 9487 - protein, 63 aa, Homo Sapiens
MAGKKVLIVYAHQEPKSFNGSLKNVAVDELSRQGCTVTVSDLYAMNLEPRATDKDITGTLSNP

SEQ ID NO: 9488 - protein, 139 aa, Homo Sapiens
MAGKKVLIVYAHQEPKSFNGSLKNVAVDELSRQGCTVTVSDLYAMNLEPRATDKDITGTLSNPEVFNYGVETHEAYKQRSLASDITDEQKKVREADLVIFQFPLYWFSVPAILKGWMDRVLCQGFAFDIPGFYDSGLLQ

SEQ ID NO: 9489 - protein, 139 aa, Homo Sapiens; identical to SEQ ID NO: 9488

SEQ ID NO: 9490 - protein, 231 aa, Homo Sapiens
MAGKKVLIVYAHQEPKSFNGSLKNVAVDELSRQGCTVTVSDLYAMNLEPRATDKDITGTLSNPEVFNYGVETHEAYKQRSLASDITDEQKKVREADLVIFQFPLYWFSVPAILKGWMDRVLCQGFAFDIPGFYDSGLLQGKLALLSVTTGGTAEMYTKTGVNGDSRYFLWPLQHGTLHFCGFKVLAPQISFAPEIASEEERKGMVAAWSQRLQTIWKEEPIPCTAHWHFGQ

SEQ ID NO: 9491 - protein, 231 aa, Homo Sapiens; identical to SEQ ID NO: 9490

SEQ ID NO: 9492 - protein, 231 aa, Homo Sapiens; identical to SEQ ID NO: 9490

SEQ ID NO: 9493 - protein, 193 aa, Homo Sapiens
MAGKKVLIVYAHQEPKSFNGSLKNVAVDELSRQGCTVTVSDLYAMNLEPRATDKDITGTLSNPEVFNYGVETHEAYKQRSLASDITDEQKKVREADLVIFQGKLALLSVTTGGTAEMYTKTGVNGDSRYFLWPLQHGTLHFCGFKVLAPQISFAPEIASEEERKGMVAAWSQRLQTIWKEEPIPCTAHWHFGQ

SEQ ID NO: 9494 - protein, 193 aa, Homo Sapiens; identical to SEQ ID NO: 9493

SEQ ID NO: 9495 - protein, 1299 aa, Homo Sapiens
MPKKKRLSAGRVPLILFLCQMISALEVPLDPKLLEDLVQPPTITQQSPKDYIIDPRENIVIQCEAKGKPPPSFSWTRNGTHFDIDKDPLVTMKPGTGTLIINIMSEGKAETYEGVYQCTARNERGAAVSNNIVVRPSRSPLWTKEKLEPITLQSGQSLVLPCRPPIGLPPPIIFWMDNSFQRLPQSERVSQGLNGDLYFSNVLPEDTREDYICYARFNHTQTIQQKQPISVKVISVDELNDTIAANLSDTEFYGAKSSRERPPTFLTPEGNASNKEELRGNVLSLECIAEGLPTPIIYWAKEDGMLPKNRTVYKNFEKTLQIIHVSEADSGNYQCIAKNALGAIHHTISVRVKAAPYWITAPQNLVLSPGEDGTLICRANGNPKPRISWLTNGVPIEIAPDDPSRKIDGDTIIFSNVQERSSAVYQCNASNEYGYLLANAFVNVLAEPPRILTPANTLYQVIANRPALLDCAFFGSPLPTIEWFKGAKGSALHEDIYVLHENGTLEIPVAQKDSTGTYTCVARNKLGMAKNEVHLEIKDPTWIVKQPEYAVVQRGSMVSFECKVKHDHTLSLTVLWLKDNRELPSDERFTVDKDHLVVADVSDDDSGTYTCVANTTLDSVSASAVLSVVAPTPTPAPVYDVPNPPFDLELTDQLDKSVQLSWTPGDDNNSPITRIHHEYEDAMHKPGLWHHQTEVSGTQTTAQLKLSPYVNYSFRVMAVNSIGKSLPSEASEQYLTKASEPDKNPTAVEGLGSEPDNLVITWKPLNGFESNGPGLQYKVSWRQKDGDDEWTSVVVANVSKYIVSGTPTFVPYLIKVQALNDMGFAPEPAVVMGHSGEDLPMVAPGNVRVNVVNSTLAEVHWDPVPLKSIRGHLQGYRIYYWKTQSSSKRNRRHIEKKILTFQGSKTHGMLPGLEPFSHYTLNVRVVNGKGEGPASPDRVFNTPEGVPSAPSSLKIVNPTLDSLTLEWDPPSHPNGILTEYTLKYQPINSTHELGPLVDLKIPANKTRWTLKNLNFSTRYKFYFYAQTSAGSGSQITEEAVTTVDEAGILPPDVGAGKVQAVNPRISNLTAAAAETYANISWEYEGPEHVNFYVEYGVAGSKEEWRKEIVNGSRSFFGLKGLMPGTAYKVRVGAVGDSGFVSSEDVFETGPAMASRQVDIATQGWFIGLMCAVALLILILLIVCFIRRNKGGKYPVKEKEDAHADPEIQPMKEDDGTFGEYSDAEDHKPLKKGSRTPSDRTVKKEDSDDSLVDYGEGVNGQFNEDGSFIGQYSGKKEKEPAEGNESSEAPSPVNAMNSFV

SEQ ID NO: 9496 - protein, 106 aa, Homo Sapiens
MQLKIMPKKKRLSAGRVPLILFLCQMISALEVPLDLVQPPTITQQSPKDYIIDPRENIVIQCEAKGKPPPSFSWTRNGTHFDIDKDPLVTMKPGTGTLIINIMSEG

SEQ ID NO: 9497 - protein, 106 aa, Homo Sapiens; identical to SEQ ID NO: 9496

SEQ ID NO: 9498 - protein, 1183 aa, Homo Sapiens
MQLKIMPKKKRLSAGRVPLILFLCQMISALEVPLDLVQPPTITQQSPKDYIIDPRENIVIQCEAKGKPPPSFSWTRNGTHFDIDKDPLVTMKPGTGTLIINIMSEGKAETYEGVYQCTARNERGAAVSNNIVVRPSRSPLWTKEKLEPITLQSGQSLVLPCRPPIGLPPPIIFWMDNSFQRLPQSERVSQGLNGDLYFSNVLPEDTREDYICYARFNHTQTIQQKQPISVKVISVDELNDTIAANLSDTEFYGAKSSRERPPTFLTPEGNASNKEELRGNVLSLECIAEGLPTPIIYWAKEDGMLPKNRTVYKNFEKTLQIIHVSEADSGNYQCIAKNALGAIHHTISVRVKAAPYWITAPQNLVLSPGEDGTLICRANGNPKPRISWLTNGVPIEIAPDDPSRKIDGDTIIFSNVQERSSAVYQCNASNEYGYLLANAFVNVLAEPPRILTPANTLYQVIANRPALLDCAFFGSPLPTIEWFKGAKGSALHEDIYVLHENGTLEIPVAQKDSTGTYTCVARNKLGMAKNEVHLEIKDPTWIVKQPEYAVVQRGSMVSFECKVKHDHTLSLTVLWLKDNRELPSDERFTVDKDHLVVADVSDDDSGTYTCVANTTLDSVSASAVLSVVDVPNPPFDLELTDQLDKSVQLSWTPGDDNNSPITKFIIEYEDAMHKPGLWHHQTEVSGTQTTAQLKLSPYVNYSFRVMAVNSIGKSLPSEASEQYLTKASEPDKNPTAVEGLGSEPDNLVITWKPLNGFESNGPGLQYKVSWRQKDGDDEWTSVVVANVSKYIVSGTPTFVPYLIKVQALNDMGFAPEPAVVMGHSGEDLPMVAPGNVRVNVVNSTLAEVHWDPVPLKSIRGHLQGYRIYYWKTQSSSKRNRRHIEKKILTFQGSKTHGMLPGLEPFSHYTLNVRVVNGKGEGPASPDRVFNTPEGVPSAPSSLKIVNPTLDSLTLEWDPPSHPNGILTEYTLKYQPINSTHELGPLVDLKIPANKTRWTLKNLNFSTRYKFYFYAQTSAGSGSQITEEAVTTVDEAMASRQVDIATQGWFIGLMCAVALLILILLIVCFIRRNKGGKYPVKEKEDAHADPEIQPMKEDDGTFGEYSDAEDHKPLKKGSRTPSDRTVKKEDSDDSLVDYGEGVNGQFNEDGSFIGQYSGKKEKEPAEGNESSEAPSPVNAMNSFV

SEQ ID NO: 9499 - protein, 431 aa, Homo Sapiens
MQLKIMPKKKRLSAGRVPLILFLCQMISALEVPLDLVQPPTITQQSPKDYIIDPRENIVIQCEAKGKPPPSFSWTRNGTHFDIDKDPLVTMKPGTGTLIINIMSEGKAETYEGVYQCTARNERGAAVSNNIVVRPSRSPLWTKEKLEPITLQSGQSLVLPCRPPIGLPPPIIFWMDNSFQRLPQSERVSQGLNGDLYFSNVLPEDTREDYICYARFNHTQTIQQKQPISVKVISVDELNDTIAANLSDTEFYGAKSSRERPPTFLTPEGNASNKEELRGNVLSLECIAEGLPTPIIYWAKEDGMLPKNRTVYKNFEKTLQIIHVSEADSGNYQCIAKNALGAIHHTISVRVKAAPYWITAPQNLVLSPGEDGTLICRANGNPKPRISWLTNGVPIEIAPDDPSRKIDGDTIIFSNVQERSSAVYQCNASNE

SEQ ID NO: 9500 - protein, 771 aa, Homo Sapiens [sequence omitted]

SEQ ID NO: 9501 - protein, 61 aa, Homo Sapiens
MQLKIMPKKKRLSAGRVPLILFLCQMISALEVPLDPKLLEDLVQPPTITQQSPKDYIIDPR

SEQ ID NO: 9502 - protein, 118 aa, Homo Sapiens
MQLKIMPKKKRLSAGRVPLILFLCQMISALEVPLDPKLLEDLVQPPTITQQSPKDYIIDPRENIVIQCEAKGKPPPSFSWTRNGTHFDIDKDPLVTMKPGTGTLIINIMSEGKAETYE

SEQ ID NO: 9503 - protein, 1192 aa, Homo Sapiens
MQLKIMPKKKRLSAGRVPLILFLCQMISALEVPLDPKLLEDLVQPPTITQQSPKDYIIDPRENIVIQCEAKGKPPPSFSWTRNGTHFDIDKDPLVTMKPGTGTLIINIMSEGKAETYEGVYQCTARNERGAAVSNNIVVRPSRSPLWTKEKLEPITLQSGQSLVLPCRPPIGLPPPIIFWMDNSFQRLPQSERVSQGLNGDLYFSNVLPEDTREDYICYARFNHTQTIQQKQPISVKVISAKSSRERPPTFLTPEGNASNKEELRGNVLSLECIAEGLPTPIIYWAKEDGMLPKNRTVYKNFEKTLQIIHVSEADSGNYQCIAKNALGAIHHTISVRVKAAPYWITAPQNLVLSPGEDGTLICRANGNPKPRISWLTNGVPIEIAPDDPSRKIDGDTIIFSNVQERSSAVYQCNASNEYGYLLANAFVNVLAEPPRILTPANTLYQVIANRPALLDCAFFGSPLPTIEWFKGAKGSALHEDIYVLHENGTLEIPVAQKDSTGTYTCVARNKLGMAKNEVHLEIKDPTWIVKQPEYAVVQRGSMVSFECKVKHDHTLSLTVLWLKDNRELPSDERFTVDKDHLVVADVSDDDSGTYTCVANTTLDSVSASAVLSVVAPTPTPAPVYDVPNPPFDLELTDQLDKSVQLSWTPGDDNNSPITKFIIEYEDAMHKPGLWHHQTEVSGTQTTAQLKLSPYVNYSFRVMAVNSIGKSLPSEASEQYLTKASEPDKNPTAVEGLGSEPDNLVITWKPLNGFESNGPGLQYKVSWRQKDGDDEWTSVVVANVSKYIVSGTPTFVPYLIKVQALNDMGFAPEPAVVMGHSGEDLPMVAPGNVRVNVVNSTLAEVHWDPVPLKSIRGHLQGYRIYYWKTQSSSKRNRRHIEKKILTFQGSKTHGMLPGLEPFSHYTLNVRVVNGKGEGPASPDRVFNTPEGVPSAPSSLKIVNPTLDSLTLEWDPPSHPNGILTEYTLKYQPINSTHELGPLVDLKIPANKTRWTLKNLNFSTRYKFYFYAQTSAGSGSQITEEAVTTVDEAGILPPDVGAGKAMASRQVDIATQGWFIGLMCAVALLILILLIVCFIRRNKGGKYPVKEKEDAHADPEIQPMKEDDGTFGEYSDAEDHKPLKKGSRTPSDRTVKKEDSDDSLVDYGEGVNGQFNEDGSFIGQYSGKKEKEPAEGNESSEAPSPVNAMNSFV

SEQ ID NO: 9504 - protein, 1304 aa, Homo Sapiens
MQLKIMPKKKRLSAGRVPLILFLCQMISALEVPLDPKLLEDLVQPPTITQQSPKDYIIDPRENIVIQCEAKGKPPPSFSWTRNGTHFDIDKDPLVTMKPGTGTLIINIMSEGKAETYEGVYQCTARNERGAAVSNNIVVRPSRSPLWTKEKLEPITLQSGQSLVLPCRPPIGLPPPIIFWMDNSFQRLPQSERVSQGLNGDLYFSNVLPEDTREDYICYARFNHTQTIQQKQPISVKVISVDELNDTIAANLSDTEFYGAKSSRERPPTFLTPEGNASNKEELRGNVLSLECIAEGLPTPIIYWAKEDGMLPKNRTVYKNFEKTLQIIHVSEADSGNYQCIAKNALGAIHHTISVRVKAAPYWITAPQNLVLSPGEDGTLICRANGNPKPRISWLTNGVPIEIAPDDPSRKIDGDTIIFSNVQERSSAVYQCNASNEYGYLLANAFVNVLAEPPRILTPANTLYQVIANRPALLDCAFFGSPLPTIEWFKGAKGSALHEDIYVLHENGTLEIPVAQKDSTGTYTCVARNKLGMAKNEVHLEIKDPTWIVKQPEYAVVQRGSMVSFECKVKHDHTLSLTVLWLKDNRELPSDERFTVDKDHLVVADVSDDDSGTYTCVANTTLDSVSASAVLSVVAPTPTPAPVYDVPNPPFDLELTDQLDKSVQLSWTPGDDNNSPITKFIIEYEDAMHKPGLWHHQTEVSGTQTTAQLKLSPYVNYSFRVMAVNSIGKSLPSEASEQYLTKASEPDKNPTAVEGLGSEPDNLVITWKPLNGFESNGPGLQYKVSWRQKDGDDEWTSVVVANVSKYIVSGTPTFVPYLIKVQALNDMGFAPEPAVVMGHSGEDLPMVAPGNVRVNVVNSTLAEVHWDPVPLKSIRGHLQGYRIYYWKTQSSSKRNRRHIEKKILTFQGSKTHGMLPGLEPFSHYTLNVRVVNGKGEGPASPDRVFNTPEGVPSAPSSLKIVNPTLDSLTLEWDPPSHPNGILTEYTLKYQPINSTHELGPLVDLKIPANKTRWTLKNLNFSTRYKFYFYAQTSAGSGSQITEEAVTTVDEAGILPPDVGAGKVQAVNPRISNLTAAAAETYANISWEYEGPEHVNFYVEYGVAGSKEEWRKEIVNGSRSFFGLKGLMPGTAYKVRVGAVGDSGFVSSEDVFETGPAMASRQVDIATQGWFIGLMCAVALLILILLIVCFIRRNKGGKYPVKEKEDAHADPEIQPMKEDDGTFGEYSDAEDHKPLKKGSRTPSDRTVKKEDSDDSLVDYGEGVNGQFNEDGSFIGQYSGKKEKEPAEGNESSEAPSPVNAMNSFV

SEQ ID NO: 9505 - protein, 1211 aa, Homo Sapiens
MQLKIMPKKKRLSAGRVPLILFLCQMISALEVPLDPKLLEDLVQPPTITQQSPKDYIIDPRENIVIQCEAKGKPPPSFSWTRNGTHFDIDKDPLVTMKPGTGTLIINIMSEGKAETYEGVYQCTARNERGAAVSNNIVVRPSRSPLWTKEKLEPITLQSGQSLVLPCRPPIGLPPPIIFWMDNSFQRLPQSERVSQGLNGDLYFSNVLPEDTREDYICYARFNHTQTIQQKQPISVKVISVDELNDTIAANLSDTEFYGAKSSRERPPTFLTPEGNASNKEELRGNVLSLECIAEGLPTPIIYWAKEDGMLPKNRTVYKNFEKTLQIIHVSEADSGNYQCIAKNALGAIHHTISVRVKAAPYWITAPQNLVLSPGEDGTLICRANGNPKPRISWLTNGVPIEIAPDDPSRKIDGDTIIFSNVQERSSAVYQCNASNEYGYLLANAFVNVLAEPPRILTPANTLYQVIANRPALLDCAFFGSPLPTIEWFKGAKGSALHEDIYVLHENGTLEIPVAQKDSTGTYTCVARNKLGMAKNEVHLEIKDPTWIVKQPEYAVVQRGSMVSFECKVKHDHTLSLTVLWLKDNRELPSDERFTVDKDHLVVADVSDDDSGTYTCVANTTLDSVSASAVLSVVAPTPTPAPVYDVPNPPFDLELTDQLDKSVQLSWTPGDDNNSPITKFIIEYEDAMHKPGLWHHQTEVSGTQTTAQLKLSPYVNYSFRVMAVNSIGKSLPSEASEQYLTKASEPDKNPTAVEGLGSEPDNLVITWKPLNGFESNGPGLQYKVSWRQKDGDDEWTSVVVANVSKYIVSGTPTFVPYLIKVQALNDMGFAPEPAVVMGHSGEDLPMVAPGNVRVNVVNSTLAEVHWDPVPLKSIRGHLQGYRIYYWKTQSSSKRNRRHIEKKILTFQGSKTHGMLPGLEPFSHYTLNVRVVNGKGEGPASPDRVFNTPEGVPSAPSSLKIVNPTLDSLTLEWDPPSHPNGILTEYTLKYQPINSTHELGPLVDLKIPANKTRWTLKNLNFSTRYKFYFYAQTSAGSGSQITEEAVTTVDEAGILPPDVGAGKAMASRQVDIATQGWFIGLMCAVALLILILLIVCFIRRNKGGKYPVKEKEDAHADPEIQPMKEDDGTFGEYSDAEDHKPLKKGSRTPSDRTVKKEDSDDSLVDYGEGVNGQFNEDGSFIGQYSGKKEKEPAEGNESSEAPSPVNAMNSFV

SEQ ID NO: 9506 - protein, 1304 aa, Homo Sapiens; identical to SEQ ID NO: 9504

SEQ ID NO: 9507 - protein, 190 aa, Homo Sapiens
  misc_feature (1)..(1): Xaa can be any naturally occurring amino acid
XGILPPDVGAGKVQAVNPRISNLTAAAAETYANISWEYEGPEHVNFYVEYGVAGTMASRQVDIATQGWFIGLMCAVALLILILLIVCFIRRNKGGKYPVKEKEDAHADPEIQPMKEDDGTFGEYSDAEDHKPLKKGSRTPSDRTVKKEDSDDSLVDYGEGVNGQFNEDGSFIGQYSGKKEKEPAEGNESS

SEQ ID NO: 9508 - protein, 296 aa, Homo Sapiens
MEIYSPDMSEVAAERSSSPSTQLSADPSLDGLPAAEDMPEPQTEDGRTPGLVGLAVPCCACLEAERLRGCLNSEKICIVPILACLVSLCLCIAGLKWVFVDKIFEYDSPTHLDPGGLGQDPIISLDATAASAVWVSSEAYTSPVSRAQSESEVQVTVQGDKAVVSFEPSAAPTPKNRIFAFSFLPSTAPSFPSPTRNPEVRTPKSATQPQTTETNLQTAPKLSTSTSTTGTSHLVKCAEKEKTFCVNGGECFMVKDLSNPSRYLCKCPNEFTGDRCQNYVMASFYSTSTPFLSLPE

SEQ ID NO: 9509 - protein, 590 aa, Homo Sapiens
MGKGRAGRVGTTALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYKHLGIEFMEAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 9510 - protein, 481 aa, Homo Sapiens
MGKGRAGRVGTTALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSATSTSTTGTSHLVKCAEKEKTFCVNGGECFMVKDLSNPSRYLCKCPNEFTGDRCQNYVMASFYKHLGIEFMEAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPA

SEQ ID NO: 9511 - protein, 193 aa, Homo Sapiens
MKKRNEMIFLATLKNKALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLC

SEQ ID NO: 9512 - protein, 135 aa, Homo Sapiens
MQIPKHISIEDITATSTSTTGTSHLVKCAEKEKTFCVNGGECFMVKDLSNPSRYLCKCPNEFTGDRCQNYVMASFYKAEELYQKRVLTITGICIALLVVGIMCVVAYCKTKKQRKKLHDRLRQSLRSERNNMMNI

SEQ ID NO: 9513 - protein, 101 aa, Homo Sapiens
MQIPKHISIEDITATSTSTTGTSHLVKCAEKEKTFCVNGGECFMVKDLSNPSRYLCKCPNEFTGDRCQNYVMASFYKHLGIEFMEAEELYQKRVLTITGIC

SEQ ID NO: 9514 - protein, 129 aa, Homo Sapiens
MQIPKHISIEDITATSTSTTGTSHLVKCAEKEKTFCVNGGECFMVKDLSNPSRYLCKCQPGFTGARCTENVPMKVQNQEKAEELYQKRVLTITGICIALLVVGIMCVVAYCKTKKQRKKLHDRLRQSLR

SEQ ID NO: 9515 - protein, 308 aa, Homo Sapiens
MQIPKHISIEDITATSTSTTGTSHLVKCAEKEKTFCVNGGECFMVKDLSNPSRYLCKCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRSSSIPHLGFIL

SEQ ID NO: 9516 - protein, 254 aa, Homo Sapiens [sequence omitted]

SEQ ID NO: 9517 - protein, 422 aa, Homo Sapiens
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYSTSTPFLSLPE

SEQ ID NO: 9518 - protein, 637 aa, Homo Sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 9519 - protein, 420 aa, Homo Sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSER

SEQ ID NO: 9520 - protein, 645 aa, Homo Sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKHLGIEFMEAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 9521 - protein, 640 aa, Homo Sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 9522 - protein, 462 aa, Homo Sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRSSSIPHLGFIL

SEQ ID NO: 9523 - protein, 196 aa, Homo Sapiens
PQTEDGRTPGLVGLAVPCCACLEAERLRGCLNSEKICIVPILACLVSLCLCIAGLKWVFVDKIFEYDSPTHLDPGGLGQDPIISLDATAASAVWVSSEAYTSPVSRAQSESEVQVTVQGDKAVVSFEPSAAPTPKNRIFAFSFLPSTAPSFPSPTRNPEVRTPKSATQPQTTETNLQTAPKLCAQMSLLVIAAKTT

SEQ ID NO: 9524 - protein, 713 aa, Homo Sapiens
VPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKHLGIEFMEAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 9525 - protein, 126 aa, Homo Sapiens
  misc_feature (1)..(1): Xaa can be any naturally occurring amino acid
XASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQESAQMSLLVIAAKTT

SEQ ID NO: 9526 - protein, 165 aa, Homo Sapiens
MMRCCRRRCCCRQPPHALRPLLLLPLVLLPPLAAAAAGPNRCDTIYQGFAECLIRLGDSMGRGGELETICRSWNDFHACASQVLSGCPEEAAAVWESLQQEARQAPRPNNLHTLCGAPVHVRERGTGSETNQETLRATAPALPMAPAPPLLAAALALAYLLRPLA

SEQ ID NO: 9527 - protein, 87 aa, Homo Sapiens
MTSMPVPLRSCQAVRRRQLQCGNHYSKKLARPPVRITCTLCAVPRCMFGSAAQAPKPTRRRCGLQRLHSPWPLRPHCWRLLWLWPTS

SEQ ID NO: 9528 - protein, 88 aa, Homo Sapiens
  misc_feature (1)..(1): Xaa can be any naturally occurring amino acid
XRCCRRRCCCRQPPHALRPLLLLPLVLLPPLAAAAAGPNRCDTIYQGFAECLIRLGDSMGRGGELETICSTVDKEYLIVLREPGGWMS

SEQ ID NO: 9529 - protein, 923 aa, Homo Sapiens
MERGLPLLCAVLALVLAPAGAFRNDKCGDTIKIESPGYLTSPGYPHSYHPSEKCEWLIQAPDPYQRIMINFNPHFDLEDRDCKYDYVEVFDGENENGHFRGKFCGKIAPPPVVSSGPFLFIKFVSDYETHGAGFSIRYEIFKRGPECSQNYTTPSGVIKSPGFPEKYPNSLECTYIVFVPKMSEIILEFESFDLEPDSNPPGGMFCRYDRLEIWDGFPDVGPHIGRYCGQKTPGRIRSSSGILSMVFYTDSAIAKEGFSANYSVLQSSVSEDFKCMEALGMESGEIHSDQITASSQYSTNWSAERSRLNYPENGWTPGEDSYREWIQVDLGLLRFVTAVGTQGAISKETKKKYYVKTYKIDVSSNGEDWITIKEGNKPVLFQGNTNPTDVVVAVFPKPLITRFVRIKPATWETGISMRFEVYGCKITDYPCSGMLGMVSGLISDSQITSSNQGDRNWMPENIRLVTSRSGWALPPAPHSYINEWLQIDLGEEKIVRGIIIQGGKHRENKVFMRKFKIGYSNNGSDWKMIMDDSKRKAKSFEGNNNYDTPELRTFPALSTRFIRIYPERATHGGLGLRMELLGCEVEAPTAGPTTPNGNLVDECDDDQANCHSGTGDDFQLTGGTTVLATEKPTVIDSTIQSEFPTYGFNCEFGWGSHKTFCHWEHDNHVQLKWSVLTSKTGPIQDHTGDGNFIYSQADENQKGKVARLVSPVVYSQNSAHCMTFWYHMSGSHVGTLRVKLRYQKPEEYDQLVWMAIGHQGDHWKEGRVLLHKSLKLYQVIFEGEIGKGNLGGIAVDDISINNHISQEDCAKPADLDKKNPEIKIDETGSTPGYEGEGEGDKNISRKPGNVLKTLDPILITIIAMSALGVLLGAVCGVVLYCACWHNGMSERNLSALENYNFELVDGVKLKKDKLNTQSTYSEA

SEQ ID NO: 9530 - protein, 641 aa, Homo Sapiens
MERGLPLLCAVLALVLAPAGAFRNDKCGDTIKIESPGYLTSPGYPHSYHPSEKCEWLIQAPDPYQRIMINFNPHFDLEDRDCKYDYVEVFDGENENGHFRGKFCGKIAPPPVVSSGPFLFIKFVSDYETHGAGFSIRYEIFKRGPECSQNYTTPSGVIKSPGFPEKYPNSLECTYIVFVPKMSEIILEFESFDLEPDSNPPGGMFCRYDRLEIWDGFPDVGPHIGRYCGQKTPGRIRSSSGILSMVFYTDSAIAKEGFSANYSVLQSSVSEDFKCMEALGMESGEIHSDQITASSQYSTNWSAERSRLNYPENGWTPGEDSYREWIQVDLGLLRFVTAVGTQGAISKETKKKYYVKTYKIDVSSNGEDWITIKEGNKPVLFQGNTNPTDVVVAVFPKPLITRFVRIKPATWETGISMRFEVYGCKITDYPCSGMLGMVSGLISDSQITSSNQGDRNWMPENIRLVTSRSGWALPPAPHSYINEWLQIDLGEEKIVRGIIIQGGKHRENKVFMRKFKIGYSNNGSDWKMIMDDSKRKAKSFEGNNNYDTPELRTFPALSTRFIRIYPERATHGGLGLRMELLGCEVEGTINTDQECPCARALAKDAKKKKRWADSTHCRCVRSIHGEMWSSGKGVCSLDANL

SEQ ID NO: 9531 - protein, 704 aa, Homo Sapiens
MERGLPLLCAVLALVLAPAGAFRNDKCGDTIKIESPGYLTSPGYPHSYHPSEKCEWLIQAPDPYQRIMINFNPHFDLEDRDCKYDYVEVFDGENENGHFRGKFCGKIAPPPVVSSGPFLFIKFVSDYETHGAGFSIRYEIFKRGPECSQNYTTPSGVIKSPGFPEKYPNSLECTYIVFVPKMSEIILEFESFDLEPDSNPPGGMFCRYDRLEIWDGFPDVGPHIGRYCGQKTPGRIRSSSGILSMVFYTDSAIAKEGFSANYSVLQSSVSEDFKCMEALGMESGEIHSDQITASSQYSTNWSAERSRLNYPENGWTPGEDSYREWIQVDLGLLRFVTAVGTQGAISKETKKKYYVKTYKIDVSSNGEDWITIKEGNKPVLFQGNTNPTDVVVAVFPKPLITRFVRIKPATWETGISMRFEVYGCKITDYPCSGMLGMVSGLISDSQITSSNQGDRNWMPENIRLVTSRSGWALPPAPHSYINEWLQIDLGEEKIVRGIIIQGGKHRENKVFMRKFKIGYSNNGSDWKMIMDDSKRKAKSFEGNNNYDTPELRTFPALSTRFIRIYPERATHGGLGLRMELLGCEVEAPTAGPTTPNGNLVDECDDDQANCHSGTGDDFQLTGAETIFIPLLYHFSSCLSWDQLTPVCVLVTPHGRELPRNRSCLARTRASSFPHVIWIDELFLIATTICNNNLSHFESQRLGLS

SEQ ID NO: 9532 - protein, 644 aa, Homo Sapiens
MERGLPLLCAVLALVLAPAGAFRNDKCGDTIKIESPGYLTSPGYPHSYHPSEKCEWLIQAPDPYQRIMINFNPHFDLEDRDCKYDYVEVFDGENENGHFRGKFCGKIAPPPVVSSGPFLFIKFVSDYETHGAGFSIRYEIFKRGPECSQNYTTPSGVIKSPGFPEKYPNSLECTYIVFVPKMSEIILEFESFDLEPDSNPPGGMFCRYDRLEIWDGFPDVGPHIGRYCGQKTPGRIRSSSGILSMVFYTDSAIAKEGFSANYSVLQSSVSEDFKCMEALGMESGEIHSDQITASSQYSTNWSAERSRLNYPENGWTPGEDSYREWIQVDLGLLRFVTAVGTQGAISKETKKKYYVKTYKIDVSSNGEDWITIKEGNKPVLFQGNTNPTDVVVAVFPKPLITRFVRIKPATWETGISMRFEVYGCKITDYPCSGMLGMVSGLISDSQITSSNQGDRNWMPENIRLVTSRSGWALPPAPHSYINEWLQIDLGEEKIVRGIIIQGGKHRENKVFMRKFKIGYSNNGSDWKMIMDDSKRKAKSFEGNNNYDTPELRTFPALSTRFIRIYPERATHGGLGLRMELLGCEVEAPTAGPTTPNGNLVDECDDDQANCHSGTGDDFQLTGGTTVLATEKPTVIDSTIQSGIK

SEQ ID NO: 9533 - protein, 923 aa, Homo Sapiens; identical to SEQ ID NO: 9529

SEQ ID NO: 9534 - protein, 609 aa, Homo Sapiens
MERGLPLLCAVLALVLAPAGAFRNDKCGDTIKIESPGYLTSPGYPHSYHPSEKCEWLIQAPDPYQRIMINFNPHFDLEDRDCKYDYVEVFDGENENGHFRGKFCGKIAPPPVVSSGPFLFIKFVSDYETHGAGFSIRYEIFKRGPECSQNYTTPSGVIKSPGFPEKYPNSLECTYIVFVPKMSEIILEFESFDLEPDSNPPGGMFCRYDRLEIWDGFPDVGPHIGRYCGQKTPGRIRSSSGILSMVFYTDSAIAKEGFSANYSVLQSSVSEDFKCMEALGMESGEIHSDQITASSQYSTNWSAERSRLNYPENGWTPGEDSYREWIQVDLGLLRFVTAVGTQGAISKETKKKYYVKTYKIDVSSNGEDWITIKEGNKPVLFQGNTNPTDVVVAVFPKPLITRFVRIKPATWETGISMRFEVYGCKITDYPCSGMLGMVSGLISDSQITSSNQGDRNWMPENIRLVTSRSGWALPPAPHSYINEWLQIDLGEEKIVRGIIIQGGKHRENKVFMRKFKIGYSNNGSDWKMIMDDSKRKAKSFEGNNNYDTPELRTFPALSTRFIRIYPERATHGGLGLRMELLGCEVEGGTTVLATEKPTVIDSTIQSGIK

SEQ ID NO: 9535 - protein, 597 aa, Homo Sapiens
MERGLPLLCAVLALVLAPAGAFRNDKCGDTIKIESPGYLTSPGYPHSYHPSEKCEWLIQAPDPYQRIMINFNPHFDLEDRDCKYDYVEVFDGENENGHFRGKFCGKIAPPPVVSSGPFLFIKFVSDYETHGAGFSIRYEIFKRGPECSQNYTTPSGVIKSPGFPEKYPNSLECTYIVFVPKMSEIILEFESFDLEPDSNPPGGMFCRYDRLEIWDGFPDVGPHIGRYCGQKTPGRIRSSSGILSMVFYTDSAIAKEGFSANYSVLQSSVSEDFKCMEALGMESGEIHSDQITASSQYSTNWSAERSRLNYPENGWTPGEDSYREWIQVDLGLLRFVTAVGTQGAISKETKKKYYVKTYKIDVSSNGEDWITIKEGNKPVLFQGNTNPTDVVVAVFPKPLITRFVRIKPATWETGISMRFEVYGCKITDYPCSGMLGMVSGLISDSQITSSNQGDRNWMPENIRLVTSRSGWALPPAPHSYINEWLQIDLGEEKIVRGIIIQGGKHRENKVFMRKFKIGYSNNGSDWKMIMDDSKRKAKVRAGDWEEVIPYVLDFNQGPLAFSRGRASYFLPAMTLEEVCDGVSKTLDSRKTGIWHEK

SEQ ID NO: 9536 - protein, 906 aa, Homo Sapiens
MERGLPLLCAVLALVLAPAGAFRNDKCGDTIKIESPGYLTSPGYPHSYHPSEKCEWLIQAPDPYQRIMINFNPHFDLEDRDCKYDYVEVFDGENENGHFRGKFCGKIAPPPVVSSGPFLFIKFVSDYETHGAGFSIRYEIFKRGPECSQNYTTPSGVIKSPGFPEKYPNSLECTYIVFVPKMSEIILEFESFDLEPDSNPPGGMFCRYDRLEIWDGFPDVGPHIGRYCGQKTPGRIRSSSGILSMVFYTDSAIAKEGFSANYSVLQSSVSEDFKCMEALGMESGEIHSDQITASSQYSTNWSAERSRLNYPENGWTPGEDSYREWIQVDLGLLRFVTAVGTQGAISKETKKKYYVKTYKIDVSSNGEDWITIKEGNKPVLFQGNTNPTDVVVAVFPKPLITRFVRIKPATWETGISMRFEVYGCKITDYPCSGMLGMVSGLISDSQITSSNQGDRNWMPENIRLVTSRSGWALPPAPHSYINEWLQIDLGEEKIVRGIIIQGGKHRENKVFMRKFKIGYSNNGSDWKMIMDDSKRKAKSFEGNNNYDTPELRTFPALSTRFIRIYPERATHGGLGLRMELLGCEVEAPTAGPTTPNGNLVDECDDDQANCHSGTGDDFQLTGGTTVLATEKPTVIDSTIQSEFPTYGFNCEFGWGSHKTFCHWEHDNHVQLKWSVLTSKTGPIQDHTGDGNFIYSQADENQKGKVARLVSPVVYSQNSAHCMTFWYHMSGSHVGTLRVKLRYQKPEEYDQLVWMAIGHQGDHWKEGRVLLHKSLKLYQVIFEGEIGKGNLGGIAVDDISINNHISQEDCARSTPGYEGEGEGDKNISRKPGNVLKTLDPILITIIAMSALGVLLGAVCGVVLYCACWHNGMSERNLSALENYNFELVDGVKLKKDKLNTQSTYSEA

SEQ ID NO: 9537 - protein, 735 aa, Homo Sapiens
MSEIILEFESFDLEPDSNPPGGMFCRYDRLEIWDGFPDVGPHIGRYCGQKTPGRIRSSSGILSMVFYTDSAIAKEGFSANYSVLQSSVSEDFKCMEALGMESGEIHSDQITASSQYSTNWSAERSRLNYPENGWTPGEDSYREWIQVDLGLLRFVTAVGTQGAISKETKKKYYVKTYKIDVSSNGEDWITIKEGNKPVLFQGNTNPTDVVVAVFPKPLITRFVRIKPATWETGISMRFEVYGCKITDYPCSGMLGMVSGLISDSQITSSNQGDRNWMPENIRLVTSRSGWALPPAPHSYINEWLQIDLGEEKIVRGIIIQGGKHRENKVFMRKFKIGYSNNGSDWKMIMDDSKRKAKSFEGNNNYDTPELRTFPALSTRFIRIYPERATHGGLGLRMELLGCEVEAPTAGPTTPNGNLVDECDDDQANCHSGTGGTTVLATEKPTVIDSTIQSEFPTYGFNCEFGWGSHKTFCHWEHDNHVQLKWSVLTSKTGPIQDHTGDGNFIYSQADENQKGKVARLVSPVVYSQNSAHCMTFWYHMSGSHVGTLRVKLRYQKPEEYDQLVWMAIGHQGDHWKEGRVLLHKSLKLYQVIFEGEIGKGNLGGIAVDDISINNHISQEDCAKPADLDKKNPEIKIDETGSTPGYEGEGEGDKNISRKPGNVLKTLDPILITIIAMSALGVLLGAVCGVVLYCACWHNGMSERNLSALENYNFELVDGVKLKKDKLNTQSTYSEA

SEQ ID NO: 9538 - protein, 105 aa, Homo Sapiens
NHISQEDCARSTPGYEGEGEGDKNISRKPGNVLKTLDPILITIIAMSALGVLLGAVCGVVLYCACWHNGMSERNLSALENYNFELVDGVKLKKDKLNTQSTYSEA

SEQ ID NO: 9539 - protein, 60 aa, Homo Sapiens
  misc_feature (1)..(1): Xaa can be any naturally occurring amino acid
XINEWLQIDLGEEKIVRGIIIQGGKHRENKVFMRKFKIGYSNNGSDWKMIMDDSKRKALI

SEQ ID NO: 9540 - protein, 170 aa, Homo Sapiens
  misc_feature (1)..(1): Xaa can be any naturally occurring amino acid
XPGGMFCRYDRLEIWDGFPDVGPHIGRYCGQKTPGRIRSSSGILSMVFYTDSAIAKEGFSANYSVLQSSVSEDFKCMEALGMESGEIHSDQITASSQYSTNWSAERSRLNYPENGWTPGEDSYREWIQDAKYRLRVSVVRSKSSSSSTSLEPRPLSSLKLSFFSYKIKIT

SEQ ID NO: 9541 - protein, 77 aa, Homo Sapiens
  misc_feature (1)..(1): Xaa can be any naturally occurring amino acid
XPTAGPTTPNGNLVDECDDDQANCHSGTGDDFQLTGGTTVLATEKPTVIDSTIQSARLEVSTLNLSLHNPPQQKALI

SEQ ID NO: 9542 - protein, 100 aa, Homo Sapiens
  misc_feature (1)..(1): Xaa can be any naturally occurring amino acid
XTHGGLGLRMELLGCEVEAPTAGPTTPNGNLVDECDDDQANCHSGTGDDFQLTGGTTVLATEKPTVIDSTIQSGSRFFKHHHKQQSMRPQNLHHNSILLL

SEQ ID NO: 9543 - protein, 102 aa, Homo Sapiens
MDMFPLTWVFLALYFSRHQVRGQPDPPCGGRLNSKDAGYITSPGYPQDYPSHQNCEWIVYAPEPNQKIVLNFNPHFEIEKHDCKYDFIEIRDGDSESADLLG

SEQ ID NO: 9544 - protein, 906 aa, Homo Sapiens
MDMFPLTWVFLALYFSRHQVRGQPDPPCGGRLNSKDAGYITSPGYPQDYPSHQNCEWIVYAPEPNQKIVLNFNPHFEIEKHDCKYDFIEIRDGDSESADLLGKHCGNIAPPTIISSGSMLYIKFTSDYARQGAGFSLRYEIFKTGSEDCSKNFTSPNGTIESPGFPEKYPHNLDCTFTILAKPKMEIILQFLIFDLEHDPLQVGEGDCKYDWLDIWDGIPHVGPLIGKYCGTKTPSELRSSTGILSLTFHTDMAVAKDGFSARYYLVHQEPLENFQCNVPLGMESGRIANEQISASSTYSDGRWTPQQSRLHGDDNGWTPNLDSNKEYLQVDLRFLTMLTAIATQGAISRETQNGYYVKSYKLEVSTNGEDWMVYRHGKNHKVFQANNDATEVVLNKLHAPLLTRFVRIRPQTWHSGIALRLELFGCRVTDAPCSNMLGMLSGLIADSQISASSTQEYLWSPSAARLVSSRSGWFPRIPQAQPGEEWLQVDLGTPKTVKGVIIQGARGGDSITAVEARAFVRKFKVSYSLNGKDWEYIQDPRTQQPKLFEGNMHYDTPDIRRFDPIPAQYVRVYPERWSPAGIGMRLEVLGCDWTDSKPTVETLGPTVKSEETTTPYPTEEEATECGENCSFEDDKDLQLPSGFNCNFDFLEEPCGWMYDHAKWLRTTWASSSSPNDRTFPDDRNFLRLQSDSQREGQYARLISPPVHLPRSPVCMEFQYQATGGRGVALQVVREASQESKLLWVIREDQGGEWKHGRIILPSYDMEYQIVFEGVIGKGRSGEIAIDDIRISTDVPLENCMEPISAFAGENFKGGTLLPGTEPTVDTVPMQPIPAYWYYVMAAGGAVLVLVSVALALVLHYHRFRYAAKKTDHSITYKTSHYTNGAPLAVEPTLTIKLEQDRGSHC

SEQ ID NO: 9545 - protein, 926 aa, Homo Sapiens
MDMFPLTWVFLALYFSRHQVRGQPDPPCGGRLNSKDAGYITSPGYPQDYPSHQNCEWIVYAPEPNQKIVLNFNPHFEIEKHDCKYDFIEIRDGDSESADLLGKHCGNIAPPTIISSGSMLYIKFTSDYARQGAGFSLRYEIFKTGSEDCSKNFTSPNGTIESPGFPEKYPHNLDCTFTILAKPKMEIILQFLIFDLEHDPLQVGEGDCKYDWLDIWDGIPHVGPLIGKYCGTKTPSELRSSTGILSLTFHTDMAVAKDGFSARYYLVHQEPLENFQCNVPLGMESGRIANEQISASSTYSDGRWTPQQSRLHGDDNGWTPNLDSNKEYLQVDLRFLTMLTAIATQGAISRETQNGYYVKSYKLEVSTNGEDWMVYRHGKNHKVFQANNDATEVVLNKLHAPLLTRFVRIRPQTWHSGIALRLELFGCRVTDAPCSNMLGMLSGLIADSQISASSTQEYLWSPSAARLVSSRSGWFPRIPQAQPGEEWLQVDLGTPKTVKGVIIQGARGGDSITAVEARAFVRKFKVSYSLNGKDWEYIQDPRTQQPKLFEGNMHYDTPDIRRFDPIPAQYVRVYPERWSPAGIGMRLEVLGCDWTDSKPTVETLGPTVKSEETTTPYPTEEEATECGENCSFEDDKDLQLPSGFNCNFDFLEEPCGWMYDHAKWLRTTWASSSSPNDRTFPDDRNFLRLQSDSQREGQYARLISPPVHLPRSPVCMEFQYQATGGRGVALQVVREASQESKLLWVIREDQGGEWKHGRIILPSYDMEYQIVFEGVIGKGRSGEIAIDDIRISTDVPLENCMEPISAFAVDIPEIHEREGYEDEIDDEYEVDWSNSSSATSGSGAPSTDKEKSWLYTLDPILITIIAMSSLGVLLGATCAGLLLYCTCSYSGLSSRSCTTLENYNFELYDGLKHKVKMNHQKCCSEA

SEQ ID NO: 9546 - protein, 931 aa, Homo Sapiens
MDMFPLTWVFLALYFSRHQVRGQPDPPCGGRLNSKDAGYITSPGYPQDYPSHQNCEWIVYAPEPNQKIVLNFNPHFEIEKHDCKYDFIEIRDGDSESADLLGKHCGNIAPPTIISSGSMLYIKFTSDYARQGAGFSLRYEIFKTGSEDCSKNFTSPNGTIESPGFPEKYPHNLDCTFTILAKPKMEIILQFLIFDLEHDPLQVGEGDCKYDWLDIWDGIPHVGPLIGKYCGTKTPSELRSSTGILSLTFHTDMAVAKDGFSARYYLVHQEPLENFQCNVPLGMESGRIANEQISASSTYSDGRWTPQQSRLHGDDNGWTPNLDSNKEYLQVDLRFLTMLTAIATQGAISRETQNGYYVKSYKLEVSTNGEDWMVYRHGKNHKVFQANNDATEVVLNKLHAPLLTRFVRIRPQTWHSGIALRLELFGCRVTDAPCSNMLGMLSGLIADSQISASSTQEYLWSPSAARLVSSRSGWFPRIPQAQPGEEWLQVDLGTPKTVKGVIIQGARGGDSITAVEARAFVRKFKVSYSLNGKDWEYIQDPRTQQPKLFEGNMHYDTPDIRRFDPIPAQYVRVYPERWSPAGIGMRLEVLGCDWTDSKPTVETLGPTVKSEETTTPYPTEEEATECGENCSFEDDKDLQLPSGFNCNFDFLEEPCGWMYDHAKWLRTTWASSSSPNDRTFPDDRNFLRLQSDSQREGQYARLISPPVHLPRSPVCMEFQYQATGGRGVALQVVREASQESKLLWVIREDQGGEWKHGRIILPSYDMEYQIVFEGVIGKGRSGEIAIDDIRISTDVPLENCMEPISAFAGENFKVDIPEIHEREGYEDEIDDEYEVDWSNSSSATSGSGAPSTDKEKSWLYTLDPILITIIAMSSLGVLLGATCAGLLLYCTCSYSGLSSRSCTTLENYNFELYDGLKHKVKMNHQKCCSEA

SEQ ID NO: 9547 - protein, 901 aa, Homo Sapiens
MDMFPLTWVFLALYFSRHQVRGQPDPPCGGRLNSKDAGYITSPGYPQDYPSHQNCEWIVYAPEPNQKIVLNFNPHFEIEKHDCKYDFIEIRDGDSESADLLGKHCGNIAPPTIISSGSMLYIKFTSDYARQGAGFSLRYEIFKTGSEDCSKNFTSPNGTIESPGFPEKYPHNLDCTFTILAKPKMEIILQFLIFDLEHDPLQVGEGDCKYDWLDIWDGIPHVGPLIGKYCGTKTPSELRSSTGILSLTFHTDMAVAKDGFSARYYLVHQEPLENFQCNVPLGMESGRIANEQISASSTYSDGRWTPQQSRLHGDDNGWTPNLDSNKEYLQVDLRFLTMLTAIATQGAISRETQNGYYVKSYKLEVSTNGEDWMVYRHGKNHKVFQANNDATEVVLNKLHAPLLTRFVRIRPQTWHSGIALRLELFGCRVTDAPCSNMLGMLSGLIADSQISASSTQEYLWSPSAARLVSSRSGWFPRIPQAQPGEEWLQVDLGTPKTVKGVIIQGARGGDSITAVEARAFVRKFKVSYSLNGKDWEYIQDPRTQQPKLFEGNMHYDTPDIRRFDPIPAQYVRVYPERWSPAGIGMRLEVLGCDWTDSKPTVETLGPTVKSEETTTPYPTEEEATECGENCSFEDDKDLQLPSGFNCNFDFLEEPCGWMYDHAKWLRTTWASSSSPNDRTFPDDRNFLRLQSDSQREGQYARLISPPVHLPRSPVCMEFQYQATGGRGVALQVVREASQESKLLWVIREDQGGEWKHGRIILPSYDMEYQIVFEGVIGKGRSGEIAIDDIRISTDVPLENCMEPISAFAGGTLLPGTEPTVDTVPMQPIPAYWYYVMAAGGAVLVLVSVALALVLHYHRFRYAAKKTDHSITYKTSHYTNGAPLAVEPTLTIKLEQDRGSHC

SEQ ID NO: 9548 - protein, 555 aa, Homo Sapiens
MDMFPLTWVFLALYFSRHQVRGQPDPPCGGRLNSKDAGYITSPGYPQDYPSHQNCEWIVYAPEPNQKIVLNFNPHFEIEKHDCKYDFIEIRDGDSESADLLGKHCGNIAPPTIISSGSMLYIKFTSDYARQGAGFSLRYEIFKTGSEDCSKNFTSPNGTIESPGFPEKYPHNLDCTFTILAKPKMEIILQFLIFDLEHDPLQVGEGDCKYDWLDIWDGIPHVGPLIGKYCGTKTPSELRSSTGILSLTFHTDMAVAKDGFSARYYLVHQEPLENFQCNVPLGMESGRIANEQISASSTYSDGRWTPQQSRLHGDDNGWTPNLDSNKEYLQVDLRFLTMLTAIATQGAISRETQNGYYVKSYKLEVSTNGEDWMVYRHGKNHKVFQANNDATEVVLNKLHAPLLTRFVRIRPQTWHSGIALRLELFGCRVTDAPCSNMLGMLSGLIADSQISASSTQEYLWSPSAARLVSSRSGWFPRIPQAQPGEEWLQVDLGTPKTVKGVIIQGARGGDSITAVEARAFVRKFKVSYSLNGKDWEYIQDPRTQQPKVGCSWRPL

SEQ ID NO: 9549 - protein, 909 aa, Homo Sapiens
MDMFPLTWVFLALYFSRHQVRGQPDPPCGGRLNSKDAGYITSPGYPQDYPSHQNCEWIVYAPEPNQKIVLNFNPHFEIEKHDCKYDFIEIRDGDSESADLLGKHCGNIAPPTIISSGSMLYIKFTSDYARQGAGFSLRYEIFKTGSEDCSKNFTSPNGTIESPGFPEKYPHNLDCTFTILAKPKMEIILQFLIFDLEHDPLQVGEGDCKYDWLDIWDGIPHVGPLIGKYCGTKTPSELRSSTGILSLTFHTDMAVAKDGFSARYYLVHQEPLENFQCNVPLGMESGRIANEQISASSTYSDGRWTPQQSRLHGDDNGWTPNLDSNKEYLQVDLRFLTMLTAIATQGAISRETQNGYYVKSYKLEVSTNGEDWMVYRHGKNHKVFQANNDATEVVLNKLHAPLLTRFVRIRPQTWHSGIALRLELFGCRVTDAPCSNMLGMLSGLIADSQISASSTQEYLWSPSAARLVSSRSGWFPRIPQAQPGEEWLQVDLGTPKTVKGVIIQGARGGDSITAVEARAFVRKFKVSYSLNGKDWEYIQDPRTQQPKLFEGNMHYDTPDIRRFDPIPAQYVRVYPERWSPAGIGMRLEVLGCDWTDSKPTVETLGPTVKSEETTTPYPTEEEATECGENCSFEDDKDLQLPSGFNCNFDFLEEPCGWMYDHAKWLRTTWASSSSPNDRTFPDDRNFLRLQSDSQREGQYARLISPPVHLPRSPVCMEFQYQATGGRGVALQVVREASQESKLLWVIREDQGGEWKHGRIILPSYDMEYQIVFEGVIGKGRSGEIAIDDIRISTDVPLENCMEPISAFADEYEVDWSNSSSATSGSGAPSTDKEKSWLYTLDPILITIIAMSSLGVLLGATCAGLLLYCTCSYSGLSSRSCTTLENYNFELYDGLKHKVKMNHQKCCSEA

SEQ ID NO: 9550 - protein, 197 aa, Homo Sapiens
MQRWKAAALASVLCSSVLSIWMCREGLLLSHRLGPALVPLHRLPRTLDARIARLAQYRALLQGAPDAMELRELTPWAGRPPGPRRRAGPRRRRARARLGARPCGLRELEVRVSELGLGYASDETVLFRYCAGACEAAARVYDLGLRRLRQRRRLRRERVRAQPCCRPTAYEDEVSFLDAHSRYHTVHELSARECACV

SEQ ID NO: 9551 - protein, 214 aa, Homo Sapiens [sequence omitted]

SEQ ID NO: 9552 - protein, 851 aa, Homo Sapiens
GKEEYIATFKGSEYFCYDLSQNPIQSSSDEITLSFKTLQRNGLMLHTGKSADYVNLALKNGAVSLVINLGSGAFEALVEPVNGKFNDNAWHDVKVTRNLRQHSGIGHAMVNKLHCSVTISVDGILTTTGYTQEDYTMLGSDDFFYVGGSPSTADLPGSPVSNNFMGCLKEVVYKNNDVRLELSRLAKQGDPKMKIHGVVAFKCENVATLDPITFETPESFISLPKWNAKKTGSISFDFRTTEPNGLILFSHGKPRHQKDAKHPQMIKVDFFAIEMLDGHLYLLLDMGSGTIKIKALLKKVNDGEWYHVDFQRDGRSGTISVNTLRTPYTAPGESEILDLDDELYLGGLPENKAGLVFPTEVWTALLNYGYVGCIRDLFIDGQSKDIRQMAEVQSTAGVKPSCSKETAKPCLSNPCKNNGMCRDGWNRYVCDCSGTGYLGRSCEREATVLSYDGSMFMKIQLPVVMHTEAEDVSLRFRSQRAYGILMATTSRDSADTLRLELDAGRVKLTVNLDCIRINCNSSKGPETLFAGYNLNDNEWHTVRVVRRGKSLKLTVDDQQAMTGQMAGDHTRLEFHNIETGIITERRYLSSVPSNFIGHLQSLTFNGMAYIDLCKNGDIDYCELNARFGFRNIIADPVTFKTKSSYVALATLQAYTSMHLFFQFKTTSLDGLILYNSGDGNDFIVVELVKGYLHYVFDLGNGANLIKGSSNKPLNDNQWHNVMISRDTSNLHTVKIDTKITTQITAGARNLDLKSDLYIGGVAKETYKSLPKLVHAKEGFQGCLASVDLNGRLPDLISDALFCNGQIERGCEGPSTTCQEDSCSNQGVCLQQWDGFSCDCSMTSFSGPLCND

SEQ ID NO: 9553 - protein, 836 aa, Homo Sapiens
GKEEYIATFKGSEYFCYDLSQNPIQSSSDEITLSFKTLQRNGLMLHTGKSADYVNLALKNGAVSLVINLGSGAFEALVEPVNGKFNDNAWHDVKVTRNLRQVTISVDGILTTTGYTQEDYTMLGSDDFFYVGGSPSTADLPGSPVSNNFMGCLKEVVYKNNDVRLELSRLAKQGDPKMKIHGVVAFKCENVATLDPITFETPESFISLPKWNAKKTGSISFDFRTTEPNGLILFSHGKPRHQKDAKHPQMIKVDFFAIEMLDGHLYLLLDMGSGTIKIKALLKKVNDGEWYHVDFQRDGRSGTISVNTLRTPYTAPGESEILDLDDELYLGGLPENKAGLVFPTEVWTALLNYGYVGCIRDLFIDGQSKDIRQMAEVQSTAGVKPSCSKETAKPCLSNPCKNNGMCRDGWNRYVCDCSGTGYLGRSCEREATVLSYDGSMFMKIQLPVVMHTEAEDVSLRFRSQRAYGILMATTSRDSADTLRLELDAGRVKLTVNLDCIRINCNSSKGPETLFAGYNLNDNEWHTVRVVRRGKSLKLTVDDQQAMTGQMAGDHTRLEFHNIETGIITERRYLSSVPSNFIGHLQSLTFNGMAYIDLCKNGDIDYCELNARFGFRNIIADPVTFKTKSSYVALATLQAYTSMHLFFQFKTTSLDGLILYNSGDGNDFIVVELVKGYLHYVFDLGNGANLIKGSSNKPLNDNQWHNVMISRDTSNLHTVKIDTKITTQITAGARNLDLKSDLYIGGVAKETYKSLPKLVHAKEGFQGCLASVDLNGRLPDLISDALFCNGQIERGCEGPSTTCQEDSCSNQGVCLQQWDGFSCDCSMTSFSGPLCND

SEQ ID NO: 9554 - protein, 198 aa, Homo Sapiens
MAAENDANIAIVGNVRLVGEVPSSMTTESTATAMQSEMSTSIMETTTTLATSTARRGKPPTKEPISQTTDDILVASAECPSDDEDIDPCEPSSGGLANPTRAGGREPYPGSAEVIRESSSTTGMVVGIVAAAALCILILLYAMYKYRNRDEGSYHVDESRNYISNSAQSNGAVVKEKQPSSAKSSNKNKKNKDKEYYV

SEQ ID NO: 9555 - protein, 139 aa, Homo Sapiens
MDMRWHCENLQTTDDILVASAECPSDDEDIDPCEPSSANPTRAGGREPYPGSAEVIRESSSTTGMVVGIVAAAALCILILLYAMYKYRNRDEGSYHVDESRNYISNSAQSNGAVVKEKQPSSAKSSNKNKKNKDKEYYV

SEQ ID NO: 9556 - protein, 142 aa, Homo Sapiens
MDMRWHCENLQTTDDILVASAECPSDDEDIDPCEPSSGGLANPTRAGGREPYPGSAEVIRESSSTTGMVVGIVAAAALCILILLYAMYKYRNRDEGSYHVDESRNYISNSAQSNGAVVKEKQPSSAKSSNKNKKNKDKEYYV

SEQ ID NO: 9557 - protein, 62 aa, Homo Sapiens
MDMRWHCENLQTTDDILVASAECPSDDEDIDPCEPSSGTKQTMWKTSRDHRILPNARRERKD

SEQ ID NO: 9558 - protein, 143 aa, Homo Sapiens
MDMRWHCENLQVTTDDILVASAECPSDDEDIDPCEPSSGGLANPTRAGGREPYPGSAEVIRESSSTTGMVVGIVAAAALCILILLYAMYKYRNRDEGSYHVDESRNYISNSAQSNGAVVKEKQPSSAKSSNKNKKNKDKEYYV

SEQ ID NO: 9559 - protein, 1477 aa, Homo Sapiens
MGTALLQRGGCFLLCLSLLLLGCWAELGSGLEFPGAEGQWTRFPKWNACCESEMSFQLKTRSARGLVLYFDDEGFCDFLELILTRGGRLQLSFSIFCAEPATLLADTPVNDGAWHSVRIRRQFRNTTLFIDQVEAKWVEVKSKRRDMTVFSGLFVGGLPPELRAAALKLTLASVREREPFKGWIRDVRVNSSQVLPVDSGEVKLDDEPPNSGGGSPCEAGEEGEGGVCLNGGVCSVVDDQAVCDCSRTGFRGKDCSQEDNNVEGLAHLMMGDQGKSKGKEEYIATFKGSEYFCYDLSQNPIQSSSDEITLSFKTLQRNGLMLHTGKSADYVNLALKNGAVSLVINLGSGAFEALVEPVNGKFNDNAWHDVKVTRNLRQHSGIGHAMVTISVDGILTTTGYTQEDYTMLGSDDFFYVGGSPSTADLPGSPVSNNFMGCLKEVVYKNNDVRLELSRLAKQGDPKMKIHGVVAFKCENVATLDPITFETPESFISLPKWNAKKTGSISFDFRTTEPNGLILFSHGKPRHQKDAKHPQMIKVDFFAIEMLDGHLYLLLDMGSGTIKIKALLKKVNDGEWYHVDFQRDGRSGTISVNTLRTPYTAPGESEILDLDDELYLGGLPENKAGLVFPTEVWTALLNYGYVGCIRDLFIDGQSKDIRQMAEVQSTAGVKPSCSKETAKPCLSNPCKNNGMCRDGWNRYVCDCSGTGYLGRSCEREATVLSYDGSMFMKIQLPVVMHTEAEDVSLRFRSQRAYGILMATTSRDSADTLRLELDAGRVKLTVNLDCIRINCNSSKGPETLFAGYNLNDNEWHTVRVVRRGKSLKLTVDDQQAMTGQMAGDHTRLEFHNIETGIITERRYLSSVPSNFIGHLQSLTFNGMAYIDLCKNGDIDYCELNARFGFRNIIADPVTFKTKSSYVALATLQAYTSMHLFFQFKTTSLDGLILYNSGDGNDFIVVELVKGYLHYVFDLGNGANLIKGSSNKPLNDNQWHNVMISRDTSNLHTVKIDTKITTQITAGARNLDLKSDLYIGGVAKETYKSLPKLVHAKEGFQGCLASVDLNGRLPDLISDALFCNGQIERGCEGPSTTCQEDSCSNQGVCLQQWDGFSCDCSMTSFSGPLCNDPGTTYIFSKGGGQITYKWPPNDRPSTRADRLAIGFSTVQKEAVLVRVDSSSGLGDYLELHIHQGKIGVKFNVGTDDIAIEESNAIINDGKYHVVRFTRSGGNATLQVDSWPVIERYPAGRQLTIFNSQATIIIGGKEQGQPFQGQLSGLYYNGLKVLNMAAENDANIAIVGNVRLVGEVPSSMTTESTATAMQSEMSTSIMETTTTLATSTARRGKPPTKEPISQTTDDILVASAECPSDDEDIDPCEPSSGGLANPTRAGGREPYPGSAEVIRESSSTTGMVVGIVAAAALCILILLYAMYKYRNRDEGSYHVDESRNYISNSAQSNGAVVKEKQPSSAKSSNKNKKNKDKEYYV

SEQ ID NO: 9560 - protein, 278 aa, Homo Sapiens
MGTALLQRGGCFLLCLSLLLLGCWAELGSGLEFPGAEGQWTRFPKWNACCESEMSFQLKTRSARGLVLYFDDEGFCDFLELILTRGGRLQLSFSIFCAEPATLLADTPVNDGAWHSVRIRRQFRNTTLFIDQVEAKWVEVKSKRRDMTVFSGLFVGGLPPELRAAALKLTLASVREREPFKGWIRDVRVNSSQVLPVDSGEVKLDDEPPNSGGGSPCEAGEEGEGGVCLNGGVCSVVDDQAVCDCSRTGFRGKDCSQEDNNVEGLAHLMMGDQGKSKD

SEQ ID NO: 9561 - protein, 1547 aa, Homo Sapiens
MGTALLQRGGCFLLCLSLLLLGCWAELGSGLEFPGAEGQWTRFPKWNACCESEMSFQLKTRSARGLVLYFDDEGFCDFLELILTRGGRLQLSFSIFCAEPATLLADTPVNDGAWHSVRIRRQFRNTTLFIDQVEAKWVEVKSKRRDMTVFSGLFVGGLPPELRAAALKLTLASVREREPFKGWIRDVRVNSSQVLPVDSGEVKLDDEPPNSGGGSPCEAGEEGEGGVCLNGGVCSVVDDQAVCDCSRTGFRGKDCSQEIKFGLQCVLPVLLHDNDQGKYCCINTAKPLTEKDNNVEGLAHLMMGDQGKSKGKEEYIATFKGSEYFCYDLSQNPIQSSSDEITLSFKTLQRNGLMLHTGKSADYVNLALKNGAVSLVINLGSGAFEALVEPVNGKFNDNAWHDVKVTRNLRQHSGIGHAMVNKLHCSVTISVDGILTTTGYTQEDYTMLGSDDFFYVGGSPSTADLPGSPVSNNFMGCLKEVVYKNNDVRLELSRLAKQGDPKMKIHGVVAFKCENVATLDPITFETPESFISLPKWNAKKTGSISFDFRTTEPNGLILFSHGKPRHQKDAKHPQMIKVDFFAIEMLDGHLYLLLDMGSGTIKIKALLKKVNDGEWYHVDFQRDGRSGTISVNTLRTPYTAPGESEILDLDDELYLGGLPENKAGLVFPTEVWTALLNYGYVGCIRDLFIDGQSKDIRQMAEVQSTAGVKPSCSKETAKPCLSNPCKNNGMCRDGWNRYVCDCSGTGYLGRSCEREATVLSYDGSMFMKIQLPVVMHTEAEDVSLRFRSQRAYGILMATTSRDSADTLRLELDAGRVKLTVNLDCIRINCNSSKGPETLFAGYNLNDNEWHTVRVVRRGKSLKLTVDDQQAMTGQMAGDHTRLEFHNIETGIITERRYLSSVPSNFIGHLQSLTFNGMAYIDLCKNGDIDYCELNARFGFRNIIADPVTFKTKSSYVALATLQAYTSMHLFFQFKTTSLDGLILYNSGDGNDFIVVELVKGYLHYVFDLGNGANLIKGSSNKPLNDNQWHNVMISRDTSNLHTVKIDTKITTQITAGARNLDLKSDLYIGGVAKETYKSLPKLVHAKEGFQGCLASVDLNGRLPDLISDALFCNGQIERGCEGPSTTCQEDSCSNQGVCLQQWDGFSCDCSMTSFSGPLCNDPGTTYIFSKGGGQITYKWPPNDRPSTRADRLAIGFSTVQKEAVLVRVDSSSGLGDYLELHIHQGKIGVKFNVGTDDIAIEESNAIINDGKYHVVRFTRSGGNATLQVDSWPVIERYPAGNNDNERLAIARQRIPYRLGRVVDEWLLDKGRQLTIFNSQATIIIGGKEQGQPFQGQLSGLYYNGLKVLNMAAENDANIAIVGNVRLVGEVPSSMTTESTATAMQSEMSTSIMETTTTLATSTARRGKPPTKEPISQTTDDILVASAECPSDDEDIDPCEPSSGGLANPTRAGGREPYPGSAEVIRESSSTTGMVVGIVAAAALCILILLYAMYKYRNRDEGSYHVDESRNYISNSAQSNGAVVKEKQPSSAKSSNKNKKNKDKEYYV

SEQ ID NO: 9562 - protein, 1495 aa, Homo Sapiens
MGTALLQRGGCFLLCLSLLLLGCWAELGSGLEFPGAEGQWTRFPKWNACCESEMSFQLKTRSARGLVLYFDDEGFCDFLELILTRGGRLQLSFSIFCAEPATLLADTPVNDGAWHSVRIRRQFRNTTLFIDQVEAKWVEVKSKRRDMTVFSGLFVGGLPPELRAAALKLTLASVREREPFKGWIRDVRVNSSQVLPVDSGEVKLDDEPPNSGGGSPCEAGEEGEGGVCLNGGVCSVVDDQAVCDCSRTGFRGKDCSQEDNNVEGLAHLMMGDQGKEEYIATFKGSEYFCYDLSQNPIQSSSDEITLSFKTLQRNGLMLHTGKSADYVNLALKNGAVSLVINLGSGAFEALVEPVNGKFNDNAWHDVKVTRNLRQVTISVDGILTTTGYTQEDYTMLGSDDFFYVGGSPSTADLPGSPVSNNFMGCLKEVVYKNNDVRLELSRLAKQGDPKMKIHGVVAFKCENVATLDPITFETPESFISLPKWNAKKTGSISFDFRTTEPNGLILFSHGKPRHQKDAKHPQMIKVDFFAIEMLDGHLYLLLDMGSGTIKIKALLKKVNDGEWYHVDFQRDGRSGTISVNTLRTPYTAPGESEILDLDDELYLGGLPENKAGLVFPTEVWTALLNYGYVGCIRDLFIDGQSKDIRQMAEVQSTAGVKPSCSKETAKPCLSNPCKNNGMCRDGWNRYVCDCSGTGYLGRSCEREATVLSYDGSMFMKIQLPVVMHTEAEDVSLRFRSQRAYGILMATTSRDSADTLRLELDAGRVKLTVNLDCIRINCNSSKGPETLFAGYNLNDNEWHTVRVVRRGKSLKLTVDDQQAMTGQMAGDHTRLEFHNIETGIITERRYLSSVPSNFIGHLQSLTFNGMAYIDLCKNGDIDYCELNARFGFRNIIADPVTFKTKSSYVALATLQAYTSMHLFFQFKTTSLDGLILYNSGDGNDFIVVELVKGYLHYVFDLGNGANLIKGSSNKPLNDNQWHNVMISRDTSNLHTVKIDTKITTQITAGARNLDLKSDLYIGGVAKETYKSLPKLVHAKEGFQGCLASVDLNGRLPDLISDALFCNGQIERGCEGPSTTCQEDSCSNQGVCLQQWDGFSCDCSMTSFSGPLCNDPGTTYIFSKGGGQITYKWPPNDRPSTRADRLAIGFSTVQKEAVLVRVDSSSGLGDYLELHIHQGKIGVKFNVGTDDIAIEESNAIINDGKYHVVRFTRSGGNATLQVDSWPVIERYPAGNNDNERLAIARQRIPYRLGRVVDEWLLDKGRQLTIFNSQATIIIGGKEQGQPFQGQLSGLYYNGLKVLNMAAENDANIAIVGNVRLVGEVPSSMTTESTATAMQSEMSTSIMETTTTLATSTARRGKPPTKEPISQTTDDILVASAECPSDDEDIDPCEPSSGGLANPTRAGGREPYPGSAEVIRESSSTTGMVVGIVAAAALCILILLYAMYKYRNRDEGSYHVDESRNYISNSAQSNGAVVKEKQPSSAKSSNKNKKNKDKEYYV

SEQ ID NO: 9563 - protein, 1507 aa, Homo Sapiens
MGTALLQRGGCFLLCLSLLLLGCWAELGSGLEFPGAEGQWTRFPKWNACCESEMSFQLKTRSARGLVLYFDDEGFCDFLELILTRGGRLQLSFSIFCAEPATLLADTPVNDGAWHSVRIRRQFRNTTLFIDQVEAKWVEVKSKRRDMTVFSGLFVGGLPPELRAAALKLTLASVREREPFKGWIRDVRVNSSQVLPVDSGEVKLDDEPPNSGGGSPCEAGEEGEGGVCLNGGVCSVVDDQAVCDCSRTGFRGKDCSQEDNNVEGLAHLMMGDQGKSKGKEEYIATFKGSEYFCYDLSQNPIQSSSDEITLSFKTLQRNGLMLHTGKSADYVNLALKNGAVSLVINLGSGAFEALVEPVNGKFNDNAWHDVKVTRNLRQHSGIGHAMVTISVDGILTTTGYTQEDYTMLGSDDFFYVGGSPSTADLPGSPVSNNFMGCLKEVVYKNNDVRLELSRLAKQGDPKMKIHGVVAFKCENVATLDPITFETPESFISLPKWNAKKTGSISFDFRTTEPNGLILFSHGKPRHQKDAKHPQMIKVDFFAIEMLDGHLYLLLDMGSGTIKIKALLKKVNDGEWYHVDFQRDGRSGTISVNTLRTPYTAPGESEILDLDDELYLGGLPENKAGLVFPTEVWTALLNYGYVGCIRDLFIDGQSKDIRQMAEVQSTAGVKPSCSKETAKPCLSNPCKNNGMCRDGWNRYVCDCSGTGYLGRSCEREATVLSYDGSMFMKIQLPVVMHTEAEDVSLRFRSQRAYGILMATTSRDSADTLRLELDAGRVKLTVNLDCIRINCNSSKGPETLFAGYNLNDNEWHTVRVVRRGKSLKLTVDDQQAMTGQMAGDHTRLEFHNIETGIITERRYLSSVPSNFIGHLQSLTFNGMAYIDLCKNGDIDYCELNARFGFRNIIADPVTFKTKSSYVALATLQAYTSMHLFFQFKTTSLDGLILYNSGDGNDFIVVELVKGYLHYVFDLGNGANLIKGSSNKPLNDNQWHNVMISRDTSNLHTVKIDTKITTQITAGARNLDLKSDLYIGGVAKETYKSLPKLVHAKEGFQGCLASVDLNGRLPDLISDALFCNGQIERGCEGPSTTCQEDSCSNQGVCLQQWDGFSCDCSMTSFSGPLCNDPGTTYIFSKGGGQITYKWPPNDRPSTRADRLAIGFSTVQKEAVLVRVDSSSGLGDYLELHIHQGKIGVKFNVGTDDIAIEESNAIINDGKYHVVRFTRSGGNATLQVDSWPVIERYPAGNNDNERLAIARQRIPYRLGRVVDEWLLDKGRQLTIFNSQATIIIGGKEQGQPFQGQLSGLYYNGLKVLNMAAENDANIAIVGNVRLVGEVPSSMTTESTATAMQSEMSTSIMETTTTLATSTARRGKPPTKEPISQTTDDILVASAECPSDDEDIDPCEPSSGGLANPTRAGGREPYPGSAEVIRESSSTTGMVVGIVAAAALCILILLYAMYKYRNRDEGSYHVDESRNYISNSAQSNGAVVKEKQPSSAKSSNKNKKNKDKEYYV

SEQ ID NO: 9564 - protein, 1496 aa, Homo Sapiens
MGTALLQRGGCFLLCLSLLLLGCWAELGSGLEFPGAEGQWTRFPKWNACCESEMSFQLKTRSARGLVLYFDDEGFCDFLELILTRGGRLQLSFSIFCAEPATLLADTPVNDGAWHSVRIRRQFRNTTLFIDQVEAKWVEVKSKRRDMTVFSGLFVGGLPPELRAAALKLTLASVREREPFKGWIRDVRVNSSQVLPVDSGEVKLDDEPPNSGGGSPCEAGEEGEGGVCLNGGVCSVVDDQAVCDCSRTGFRGKDCSQEDNNVEGLAHLMMGDQGKSKGKEEYIATFKGSEYFCYDLSQNPIQSSSDEITLSFKTLQRNGLMLHTGKSADYVNLALKNGAVSLVINLGSGAFEALVEPVNGKFNDNAWHDVKVTRNLRQVTISVDGILTTTGYTQEDYTMLGSDDFFYVGGSPSTADLPGSPVSNNFMGCLKEVVYKNNDVRLELSRLAKQGDPKMKIHGVVAFKCENVATLDPITFETPESFISLPKWNAKKTGSISFDFRTTEPNGLILFSHGKPRHQKDAKHPQMIKVDFFAIEMLDGHLYLLLDMGSGTIKIKALLKKVNDGEWYHVDFQRDGRSGTISVNTLRTPYTAPGESEILDLDDELYLGGLPENKAGLVFPTEVWTALLNYGYVGCIRDLFIDGQSKDIRQMAEVQSTAGVKPSCSKETAKPCLSNPCKNNGMCRDGWNRYVCDCSGTGYLGRSCEREATVLSYDGSMFMKIQLPVVMHTEAEDVSLRFRSQRAYGILMATTSRDSADTLRLELDAGRVKLTVNLDCIRINCNSSKGPETLFAGYNLNDNEWHTVRVVRRGKSLKLTVDDQQAMTGQMAGDHTRLEFHNIETGIITERRYLSSVPSNFIGHLQSLTFNGMAYIDLCKNGDIDYCELNARFGFRNIIADPVTFKTKSSYVALATLQAYTSMHLFFQFKTTSLDGLILYNSGDGNDFIVVELVKGYLHYVFDLGNGANLIKGSSNKPLNDNQWHNVMISRDTSNLHTVKIDTKITTQITAGARNLDLKSDLYIGGVAKETYKSLPKLVHAKEGFQGCLASVDLNGRLPDLISDALFCNGQIERGCEGPSTTCQEDSCSNQGVCLQQWDGFSCDCSMTSFSGPLCNDPGTTYIFSKGGGQITYKWPPNDRPSTRADRLAIGFSTVQKEAVLVRVDSSSGLGDYLELHIHQGKIGVKFNVGTDDIAIEESNAIINDGKYHVVRFTRSGGNATLQVDSWPVIERYPAGNNDNERLAIARQRIPYRLGRVVDEWLLDKGRQLTIFNSQATIIIGGKEQGQPFQGQLSGLYYNGLKVLNMAAENDANIAIVGNVRLVGEVPSSMTTESTATAMQSEMSTSIMETTTTLATSTARRGKPPTKEPISQTTDDILVASAECPSDDEDIDPCEPSSANPTRAGGREPYPGSAEVIRESSSTTGMVVGIVAAAALCILILLYAMYKYRNRDEGSYHVDESRNYISNSAQSNGAVVKEKQPSSAKSSNKNKKNKDKEYYV

SEQ ID NO: 9565 - protein, 459 aa, Homo Sapiens
MGTALLQRGGCFLLCLSLLLLGCWAELGSGLEFPGAEGQWTRFPKWNACCESEMSFQLKTRSARGLVLYFDDEGFCDFLELILTRGGRLQLSFSIFCAEPATLLADTPVNDGAWHSVRIRRQFRNTTLFIDQVEAKWVEVKSKRRDMTVFSGLFVGGLPPELRAAALKLTLASVREREPFKGWIRDVRVNSSQVLPVDSGEVKLDDEPPNSGGGSPCEAGEEGEGGVCLNGGVCSVVDDQAVCDCSRTGFRGKDCSQGKEEYIATFKGSEYFCYDLSQNPIQSSSDEITLSFKTLQRNGLMLHTGKSADYVNLALKNGAVSLVINLGSGAFEALVEPVNGKFNDNAWHDVKVTRNLRQVTISVDGILTTTGYTQEDYTMLGSDDFFYVGGSPSTADLPGSPVSNNFMGCLKEVNIVAIRIIPNSWSHHFRSSMKAPLLKTRCSRVKRHNFKFNILLLFM

SEQ ID NO: 9566 - protein, 277 aa, Homo Sapiens
MGTALLQRGGCFLLCLSLLLLGCWAELGSGLEFPGAEGQWTRFPKWNACCESEMSFQLKTRSARGLVLYFDDEGFCDFLELILTRGGRLQLSFSIFCAEPATLLADTPVNDGAWHSVRIRRQFRNTTLFIDQVEAKWVEVKSKRRDMTVFSGLFVGGLPPELRAAALKLTLASVREREPFKGWIRDVRVNSSQVLPVDSGEVKLDDEPPNSGGGSPCEAGEEGEGGVCLNGGVCSVVDDQAVCDCSRTGFRGKDCSQDNNVEGLAHLMMGDQGKSKD

SEQ ID NO: 9567 - protein, 293 aa, Homo Sapiens
MGTALLQRGGCFLLCLSLLLLGCWAELGSGLEFPGAEGQWTRFPKWNACCESEMSFQLKTRSARGLVLYFDDEGFCDFLELILTRGGRLQLSFSIFCAEPATLLADTPVNDGAWHSVRIRRQFRNTTLFIDQVEAKWVEVKSKRRDMTVFSGLFVGGLPPELRAAALKLTLASVREREPFKGWIRDVRVNSSQVLPVDSGEVKLDDEPPNSGGGSPCEAGEEGEGGVCLNGGVCSVVDDQAVCDCSRTGFRGKDCSQEDNNVEGLAHLMMGDQGKSKEMNDYLNYKKVKICYT

SEQ ID NO: 9568 - protein, 1499 aa, Homo Sapiens
MGTALLQRGGCFLLCLSLLLLGCWAELGSGLEFPGAEGQWTRFPKWNACCESEMSFQLKTRSARGLVLYFDDEGFCDFLELILTRGGRLQLSFSIFCAEPATLLADTPVNDGAWHSVRIRRQFRNTTLFIDQVEAKWVEVKSKRRDMTVFSGLFVGGLPPELRAAALKLTLASVREREPFKGWIRDVRVNSSQVLPVDSGEVKLDDEPPNSGGGSPCEAGEEGEGGVCLNGGVCSVVDDQAVCDCSRTGFRGKDCSQEDNNVEGLAHLMMGDQGKSKGKEEYIATFKGSEYFCYDLSQNPIQSSSDEITLSFKTLQRNGLMLHTGKSADYVNLALKNGAVSLVINLGSGAFEALVEPVNGKFNDNAWHDVKVTRNLRQVTISVDGILTTTGYTQEDYTMLGSDDFFYVGGSPSTADLPGSPVSNNFMGCLKEVVYKNNDVRLELSRLAKQGDPKMKIHGVVAFKCENVATLDPITFETPESFISLPKWNAKKTGSISFDFRTTEPNGLILFSHGKPRHQKDAKHPQMIKVDFFAIEMLDGHLYLLLDMGSGTIKIKALLKKVNDGEWYHVDFQRDGRSGTISVNTLRTPYTAPGESEILDLDDELYLGGLPENKAGLVFPTEVWTALLNYGYVGCIRDLFIDGQSKDIRQMAEVQSTAGVKPSCSKETAKPCLSNPCKNNGMCRDGWNRYVCDCSGTGYLGRSCEREATVLSYDGSMFMKIQLPVVMHTEAEDVSLRFRSQRAYGILMATTSRDSADTLRLELDAGRVKLTVNLDCIRINCNSSKGPETLFAGYNLNDNEWHTVRVVRRGKSLKLTVDDQQAMTGQMAGDHTRLEFHNIETGIITERRYLSSVPSNFIGHLQSLTFNGMAYIDLCKNGDIDYCELNARFGFRNIIADPVTFKTKSSYVALATLQAYTSMHLFFQFKTTSLDGLILYNSGDGNDFIVVELVKGYLHYVFDLGNGANLIKGSSNKPLNDNQWHNVMISRDTSNLHTVKIDTKITTQITAGARNLDLKSDLYIGGVAKETYKSLPKLVHAKEGFQGCLASVDLNGRLPDLISDALFCNGQIERGCEGPSTTCQEDSCSNQGVCLQQWDGFSCDCSMTSFSGPLCNDPGTTYIFSKGGGQITYKWPPNDRPSTRADRLAIGFSTVQKEAVLVRVDSSSGLGDYLELHIHQGKIGVKFNVGTDDIAIEESNAIINDGKYHVVRFTRSGGNATLQVDSWPVIERYPAGNNDNERLAIARQRIPYRLGRVVDEWLLDKGRQLTIFNSQATIIIGGKEQGQPFQGQLSGLYYNGLKVLNMAAENDANIAIVGNVRLVGEVPSSMTTESTATAMQSEMSTSIMETTTTLATSTARRGKPPTKEPISQTTDDILVASAECPSDDEDIDPCEPSSGGLANPTRAGGREPYPGSAEVIRESSSTTGMVVGIVAAAALCILILLYAMYKYRNRDEGSYHVDESRNYISNSAQSNGAVVKEKQPSSAKSSNKNKKNKDKEYYV

SEQ ID NO: 9569 - protein, 56 aa, Homo Sapiens
MTSGSKCPSTDSASLLPRKSRGLMAYILPLVQLTSSVGEDCSFQISTFLFDLSSIS

SEQ ID NO: 9570 - protein, 176 aa, Homo Sapiens
MTSGSKCPSTDSGKEEYIATFKGSEYFCYDLSQNPIQSSSDEITLSFKTLQRNGLMLHTGKSADYVNLALKNGAVSLVINLGSGAFEALVEPVNGKFNDNAWHDVKVTRNLRQVTISVDGILTTTGYTQEDYTMLGSDDFFYVGGSPSTADLPGSPIQHESTFAEDPMFQSQTAQL

SEQ ID NO: 9571 - protein, 903 aa, Homo Sapiens
MTSGSKCPSTDSGKEEYIATFKGSEYFCYDLSQNPIQSSSDEITLSFKTLQRNGLMLHTGKSADYVNLALKNGAVSLVINLGSGAFEALVEPVNGKFNDNAWHDVKVTRNLRQVTISVDGILTTTGYTQEDYTMLGSDDFFYVGGSPSTADLPGSPVSNNFMGCLKEVVYKNNDVRLELSRLAKQGDPKMKIHGVVAFKCENVATLDPITFETPESFISLPKWNAKKTGSISFDFRTTEPNGLILFSHGKPRHQKDAKHPQMIKVDFFAIEMLDGHLYLLLDMGSGTIKIKALLKKVNDGEWYHVDFQRDGRSGTISVNTLRTPYTAPGESEILDLDDELYLGGLPENKAGLVFPTEVWTALLNYGYVGCIRDLFIDGQSKDIRQMAEVQSTAGVKPSCSKETAKPCLSNPCKNNGMCRDGWNRYVCDCSGTGYLGRSCEREATVLSYDGSMFMKIQLPVVMHTEAEDVSLRFRSQRAYGILMATTSRDSADTLRLELDAGRVKLTVNLGKGPETLFAGYNLNDNEWHTVRVVRRGKSLKLTVDDQQAMTGQMAGDHTRLEFHNIETGIITERRYLSSVPSNFIGHLQSLTFNGMAYIDLCKNGDIDYCELNARFGFRNIIADPVTFKTKSSYVALATLQAYTSMHLFFQFKTTSLDGLILYNSGDGNDFIVVELVKGYLHYVFDLGNGANLIKGSSNKPLNDNQWHNVMISRDTSNLHTVKIDTKITTQITAGARNLDLKSDLYIGGVAKETYKSLPKLVHAKEGFQGCLASVDLNGRLPDLISDALFCNGQIERGCEGPSTTCQEDSCSNQGVCLQQWDGFSCDCSMTSFSGPLCNDPGTTYIFSKGGGQITYKWPPNDRPSTRADRLAIGFSTVQKEAVLVRVDSSSGLGDYLELHITLQ

SEQ ID NO: 9572 - protein, 75 aa, Homo Sapiens
MVVGIVAAAALCILILLYAMYKYRNRDEGSYHVDESRNYISNSAQSNGAVVKEKQPSSAKSSNKNKKNKDKEYYV

SEQ ID NO: 9573 - protein, 472 aa, Homo Sapiens
MYQRMLRCGAELGSPGGGGGGGGGGGAGGRLALLWIVPLTLSGLLGVAWGASSLGAHHIHHFHGSSKHHSVPIAIYRSPASLRGGHAGTTYIFSKGGGQITYKWPPNDRPSTRADRLAIGFSTVQKEAVLVRVDSSSGLGDYLELHIHQGKIGVKFNVGTDDIAIEESNAIINDGKYHVVRFTRSGGNATLQVDSWPVIERYPAGNNDNERLAIARQRIPYRLGRVVDEWLLDKGRQLTIFNSQATIIIGGKEQGQPFQGQLSGLYYNGLKVLNMAAENDANIAIVGNVRLVGEVPSSMTTESTATAMQSEMSTSIMETTTTLATSTARRGKPPTKEPISQTTDDILVASAECPSDDEDIDPCEPSSGGLANPTRAGGREPYPGSAEVIRESSSTTGMVVGIVAAAALCILILLYAMYKYRNRDEGSYHVDESRNYISNSAQSNGAVVKEKQPSSAKSSNKNKKNKDKEYYV

SEQ ID NO: 9574 - protein, 469 aa, Homo Sapiens
MYQRMLRCGAELGSPGGGGGGGGGGGAGGRLALLWIVPLTLSGLLGVAWGASSLGAHHIHHFHGSSKHHSVPIAIYRSPASLRGGHAGTTYIFSKGGGQITYKWPPNDRPSTRADRLAIGFSTVQKEAVLVRVDSSSGLGDYLELHIHQGKIGVKFNVGTDDIAIEESNAIINDGKYHVVRFTRSGGNATLQVDSWPVIERYPAGNNDNERLAIARQRIPYRLGRVVDEWLLDKGRQLTIFNSQATIIIGGKEQGQPFQGQLSGLYYNGLKVLNMAAENDANIAIVGNVRLVGEVPSSMTTESTATAMQSEMSTSIMETTTTLATSTARRGKPPTKEPISQTTDDILVASAECPSDDEDIDPCEPSSANPTRAGGREPYPGSAEVIRESSSTTGMVVGIVAAAALCILILLYAMYKYRNRDEGSYHVDESRNYISNSAQSNGAVVKEKQPSSAKSSNKNKKNKDKEYYV

SEQ ID NO: 9575 - protein, 442 aa, Homo Sapiens
MYQRMLRCGAELGSPGGGGGGGGGGGAGGRLALLWIVPLTLSGLLGVAWGASSLGAHHIHHFHGSSKHHSVPIAIYRSPASLRGGHAGTTYIFSKGGGQITYKWPPNDRPSTRADRLAIGFSTVQKEAVLVRVDSSSGLGDYLELHIHQGKIGVKFNVGTDDIAIEESNAIINDGKYHVVRFTRSGGNATLQVDSWPVIERYPAGRQLTIFNSQATIIIGGKEQGQPFQGQLSGLYYNGLKVLNMAAENDANIAIVGNVRLVGEVPSSMTTESTATAMQSEMSTSIMETTTTLATSTARRGKPPTKEPISQTTDDILVASAECPSDDEDIDPCEPSSGGLANPTRAGGREPYPGSAEVIRESSSTTGMVVGIVAAAALCILILLYAMYKYRNRDEGSYHVDESRNYISNSAQSNGAVVKEKQPSSAKSSNKNKKNKDKEYYV

SEQ ID NO: 9576 - protein, 136 aa, Homo Sapiens
SSQVLPVDSGEVKLDDEPPNSGGGSPCEAGEEGEGGVCLNGGVCSVVDDQAVCDCSRTGFRGKDCSQEIKFGLQCVLPVLLHDNDQGKYCCINTAKPLTEKDNNVEGLAHLMMGDQGKSKEKLEIFRWIRKDFTNF

SEQ ID NO: 9577 - protein, 123 aa, Homo Sapiens
TLSGLLGVAWGASSLGAHHIHHFHGSSKHHSVPIAIYRSPASLRGGHAGTTYIFSKGGGQITYKWPPNDRPSTRADRLAIGFSTVQKEAVLVRVDSSSGLGDYLELHIAFESFTASRSSASRC

SEQ ID NO: 9578 - protein, 33 aa, Homo Sapiens
  misc_feature (1)..(1): Xaa can be any naturally occurring amino acid
XFQRDGRSDFPFASSLVPPSTQNSCPGTISVNT

SEQ ID NO: 9579 - protein, 126 aa, Homo Sapiens
  misc_feature (1)..(1): Xaa can be any naturally occurring amino acid
XPELRAAALKLTLASVREREPFKGWIRDVRVNSSQVLPVDSGEVKLDDEPPNSGGGSPCEAGEEGEGGVCLNGGVCSVVDDQAVCDCSRTGFRGKDCSQGLAHLMMGDQGMGSVPFPLCFQCFLVL

SEQ ID NO: 9580 - protein, 169 aa, Homo Sapiens
  misc_feature (1)..(1): Xaa can be any naturally occurring amino acid
XSNNFMGCLKEVVYKNNDVRLELSRLAKQGDPKMKIHGVVAFKCENVATLDPITFETPESFISLPKWNAKKTGSISFDFRTTEPNGLILFSHGKPRHQKDAKHPQMIKVDFFAIEMLDGHLYLLLDMGSGTIKIKALLKKVNDGEWYHVDFQRDGRSGQMAGDHTRLEF

SEQ ID NO: 9581 - protein, 155 aa, Homo Sapiens
  misc_feature (1)..(1): Xaa can be any naturally occurring amino acid
XVFSGLFVGGLPPELRAAALKLTLASVREREPFKGWIRDVRVNSSQVLPVDSGEVKLDDEPPNSGGGSPCEAGEEGEGGVCLNGGVCSVVDDQAVCDCSRTGFRGKDCSQEDNNVEGLAHLMMGDQGKSKELMLILLCSITTQGLETAKSLIMCT

SEQ ID NO: 9582 - protein, 276 aa, Homo Sapiens
LLLLLLGAAEGARVSSSLSTTHHVHHFHSKHGTVPIAINRMPFLTRGGHAGTTYIFGKGGALITYTWPPNDRPSTRMDRLAVGFSTHQRSAVLVRVDSASGLGDYLQLHIDQGTVGVIFNVGTDDITIDEPNAIVSDGKYHVVRFTRSGGNATLQVDSWPVNERYPAGRQLTIFNSQAAIKIGGRDQGRPFQGQVSGLYYNGLKVLALAAESDPNVRTEGHLRLVGEGPSVLLSAETTATTLLADMATTIMETTTTMATTTTRRGRSPTLRDSTTQ

SEQ ID NO: 9583 - protein, 1712 aa, Homo Sapiens
MASGSRWRPTPPPLLLLLLLALAARADGLEFGGGPGQWARYARWAGAASSGELSFSLRTNATRALLLYLDDGGDCDFLELLLVDGRLRLRFTLSCAEPATLQLDTPVADDRWHMVLLTRDARRTALAVDGEARAAEVRSKRREMQVASDLFVGGIPPDVRLSALTLSTVKYEPPFRGLLANLKLGERPPALLGSQGLRGATADPLCAPARNPCANGGLCTVLAPGEVGCDCSHTGFGGKFCSEEEHPMEGPAHLTLNSEVGSLLFSEGGAGRGGAGDVHQPTKGKEEFVATFKGNEFFCYDLSHNPIQSSTDEITLAFRTLQRNGLMLHTGKSADYVNLSLKSGAVWLVINLGSGAFEALVEPVNGKFNDNAWHDVRVTRNLRQHAGIGHAMVNKLHYLVTISVDGILTTTGYTQEDYTMLGSDDFFYIGGSPNTADLPGSPVSNNFMGCLKDVVYKNNDFKLELSRLAKEGDPKMKLQGDLSFRCEDVAALDPVTFESPEAFVALPRWSAKRTGSISLDFRTTEPNGLLLFSQGRRAGGGAGSHSSAQRADYFAMELLDGHLYLLLDMGSGGIKLRASSRKVNDGEWCHVDFQRDGRKGSISVNSRSTPFLATGDSEILDLESELYLGGLPEGGRVDLPLPPEVWTAALRAGYVGCVRDLFIDGRSRDLRGLAEAQGAVGVAPFCSRETLKQCASAPCRNGGVCREGWNRFICDCIGTGFLGRVCEREATVLSYDGSMYMKIMLPNAMHTEAEDVSLRFMSQRAYGLMMATTSRESADTLRLELDGGQMKLTVNLDCLRVGCAPSKGPETLFAGHKLNDNEWHTVRVVRRGKSLQLSVDNVTVEGQMAGAHMRLEFHNIETGIMTERRFISVVPSNFIGHLSGLVFNGQPYMDQCKDGDITYCELNARFGLRAIVADPVTFKSRSSYLALATLQAYASMHLFFQFKTTAPDGLLLFNSGNGNDFIVIELVKGYIHYVFDLGNGPSLMKGNSDKPVNDNQWHNVVVSRDPGNVHTLKIDSRTVTQHSNGARNLDLKGELYIGGLSKNMFSNLPKLVASRDGFQGCLASVDLNGRLPDLIADALHRIGQVERGCDGPSTTCTEESCANQGVCLQQWDGFTCDCTMTSYGGPVCNDPGTTYIFGKGGALITYTWPPNDRPSTRMDRLAVGFSTHQRSAVLVRVDSASGLGDYLQLHIDQGTVGVIFNVGTDDITIDEPNAIVSDGKYHVVRFTRSGGNATLQVDSWPVNERYPAGNFDNERLAIARQRIPYRLGRVVDEWLLDKGRQLTIFNSQAAIKIGGRDQGRPFQGQVSGLYYNGLKVLALAAESDPNVRTEGHLRLVGEGPSVLLSAETTATTLLADMATTIMETTTTMATTTTRRGRSPTLRDSTTQNTDDLLVASAECPSDDEDLEECEPSTGGELILPIITEDSLDPPPVATRSPFVPPPPTFYPFLTGVGATQDTLPPPAARRPPSGGPCQAERDDSDCEEPIEASGFASGEVFDSSLPPTDDEDFYTTFPLVTDRTTLLSPRKPAPRPNLRTDGATGAPGVLFAPSAPAPNLPAGKMNHRDPLQPLLENPPLGPGAPTSFEPRRPPPLRPGVTSAPGFPHLPTANPTGPGERGPPGAVEVIRESSSTTGMVVGIVAAAALCILILLYAMYKYRNRDEGSYQVDQSRNYISNSAQSNGAVVKEKAPAAPKTPSKAKKNKDKEYYV

SEQ ID NO: 9584 - protein, 1642 aa, Homo Sapiens
MASGSRWRPTPPPLLLLLLLALAARADGLEFGGGPGQWARYARWAGAASSGELSFSLRTNATRALLLYLDDGGDCDFLELLLVDGRLRLRFTLSCAEPATLQLDTPVADDRWHMVLLTRDARRTALAVDGEARAAEVRSKRREMQVASDLFVGGIPPDVRLSALTLSTVKYEPPFRGLLANLKLGERPPALLGSQGLRGATADPLCAPARNPCANGGLCTVLAPGEVGCDCSHTGFGGKFCSEEEHPMEGPAHLTLNSEGKEEFVATFKGNEFFCYDLSHNPIQSSTDEITLAFRTLQRNGLMLHTGKSADYVNLSLKSGAVWLVINLGSGAFEALVEPVNGKFNDNAWHDVRVTRNLRQHAGIGHAMVTISVDGILTTTGYTQEDYTMLGSDDFFYIGGSPNTADLPGSPVSNNFMGCLKDVVYKNNDFKLELSRLAKEGDPKMKLQGDLSFRCEDVAALDPVTFESPEAFVALPRWSAKRTGSISLDFRTTEPNGLLLFSQGRRAGGGAGSHSSAQRADYFAMELLDGHLYLLLDMGSGGIKLRASSRKVNDGEWCHVDFQRDGRKGSISVNSRSTPFLATGDSEILDLESELYLGGLPEGGRVDLPLPPEVWTAALRAGYVGCVRDLFIDGRSRDLRGLAEAQGAVGVAPFCSRETLKQCASAPCRNGGVCREGWNRFICDCIGTGFLGRVCEREATVLSYDGSMYMKIMLPNAMHTEAEDVSLRFMSQRAYGLMMATTSRESADTLRLELDGGQMKLTVNLGKGPETLFAGHKLNDNEWHTVRVVRRGKSLQLSVDNVTVEGQMAGAHMRLEFHNIETGIMTERRFISVVPSNFIGHLSGLVFNGQPYMDQCKDGDITYCELNARFGLRAIVADPVTFKSRSSYLALATLQAYASMHLFFQFKTTAPDGLLLFNSGNGNDFIVIELVKGYIHYVFDLGNGPSLMKGNSDKPVNDNQWHNVVVSRDPGNVHTLKIDSRTVTQHSNGARNLDLKGELYIGGLSKNMFSNLPKLVASRDGFQGCLASVDLNGRLPDLIADALHRIGQVERGCDGPSTTCTEESCANQGVCLQQWDGFTCDCTMTSYGGPVCNDPGTTYIFGKGGALITYTWPPNDRPSTRMDRLAVGFSTHQRSAVLVRVDSASGLGDYLQLHIDQGTVGVIFNVGTDDITIDEPNAIVSDGKYHVVRFTRSGGNATLQVDSWPVNERYPAGRQLTIFNSQAAIKIGGRDQGRPFQGQVSGLYYNGLKVLALAAESDPNVRTEGHLRLVGEGPSVLLSAETTATTLLADMATTIMETTTTMATTTTRRGRSPTLRDSTTQNTDDLLVASAECPSDDEDLEECEPSTGGELILPIITEDSLDPPPVATRSPFVPPPPTFYPFLTGVGATQDTLPPPAARRPPSGGPCQAERDDSDCEEPIEASGFASGEVFDSSLPPTDDEDFYTTFPLVTDRTTLLSPRKPAPRPNLRTDGATGAPGVLFAPSAPAPNLPAGKMNHRDPLQPLLENPPLGPGAPTSFEPRRPPPLRPGVTSAPGFPHLPTANPTGPGERGPPGAVEVIRESSSTTGMVVGIVAAAALCILILLYAMYKYRNRDEGSYQVDQSRNYISNSAQSNGAVVKEKAPAAPKTPSKAKKNKDKEYYV

SEQ ID NO: 9585 - protein, 1712 aa, Homo Sapiens; identical to SEQ ID NO: 9583

SEQ ID NO: 9586 - protein, 1705 aa, Homo Sapiens
MASGSRWRPTPPPLLLLLLLALAARADGLEFGGGPGQWARYARWAGAASSGELSFSLRTNATRALLLYLDDGGDCDFLELLLVDGRLRLRFTLSCAEPATLQLDTPVADDRWHMVLLTRDARRTALAVDGEARAAEVRSKRREMQVASDLFVGGIPPDVRLSALTLSTVKYEPPFRGLLANLKLGERPPALLGSQGLRGATADPLCAPARNPCANGGLCTVLAPGEVGCDCSHTGFGGKFCSEEEHPMEGPAHLTLNSEVGSLLFSEGGAGRGGAGDVHQPTKGKEEFVATFKGNEFFCYDLSHNPIQSSTDEITLAFRTLQRNGLMLHTGKSADYVNLSLKSGAVWLVINLGSGAFEALVEPVNGKFNDNAWHDVRVTRNLRQHAGIGHAMVTISVDGILTTTGYTQEDYTMLGSDDFFYIGGSPNTADLPGSPVSNNFMGCLKDVVYKNNDFKLELSRLAKEGDPKMKLQGDLSFRCEDVAALDPVTFESPEAFVALPRWSAKRTGSISLDFRTTEPNGLLLFSQGRRAGGGAGSHSSAQRADYFAMELLDGHLYLLLDMGSGGIKLRASSRKVNDGEWCHVDFQRDGRKGSISVNSRSTPFLATGDSEILDLESELYLGGLPEGGRVDLPLPPEVWTAALRAGYVGCVRDLFIDGRSRDLRGLAEAQGAVGVAPFCSRETLKQCASAPCRNGGVCREGWNRFICDCIGTGFLGRVCEREATVLSYDGSMYMKIMLPNAMHTEAEDVSLRFMSQRAYGLMMATTSRESADTLRLELDGGQMKLTVNLDCLRVGCAPSKGPETLFAGHKLNDNEWHTVRVVRRGKSLQLSVDNVTVEGQMAGAHMRLEFHNIETGIMTERRFISVVPSNFIGHLSGLVFNGQPYMDQCKDGDITYCELNARFGLRAIVADPVTFKSRSSYLALATLQAYASMHLFFQFKTTAPDGLLLFNSGNGNDFIVIELVKGYIHYVFDLGNGPSLMKGNSDKPVNDNQWHNVVVSRDPGNVHTLKIDSRTVTQHSNGARNLDLKGELYIGGLSKNMFSNLPKLVASRDGFQGCLASVDLNGRLPDLIADALHRIGQVERGCDGPSTTCTEESCANQGVCLQQWDGFTCDCTMTSYGGPVCNDPGTTYIFGKGGALITYTWPPNDRPSTRMDRLAVGFSTHQRSAVLVRVDSASGLGDYLQLHIDQGTVGVIFNVGTDDITIDEPNAIVSDGKYHVVRFTRSGGNATLQVDSWPVNERYPAGNFDNERLAIARQRIPYRLGRVVDEWLLDKGRQLTIFNSQAAIKIGGRDQGRPFQGQVSGLYYNGLKVLALAAESDPNVRTEGHLRLVGEGPSVLLSAETTATTLLADMATTIMETTTTMATTTTRRGRSPTLRDSTTQNTDDLLVASAECPSDDEDLEECEPSTGGELILPIITEDSLDPPPVATRSPFVPPPPTFYPFLTGVGATQDTLPPPAARRPPSGGPCQAERDDSDCEEPIEASGFASGEVFDSSLPPTDDEDFYTTFPLVTDRTTLLSPRKPAPRPNLRTDGATGAPGVLFAPSAPAPNLPAGKMNHRDPLQPLLENPPLGPGAPTSFEPRRPPPLRPGVTSAPGFPHLPTANPTGPGERGPPGAVEVIRESSSTTGMVVGIVAAAALCILILLYAMYKYRNRDEGSYQVDQSRNYISNSAQSNGAVVKEKAPAAPKTPSKAKKNKDKEYYV

SEQ ID NO: 9587 - protein, 666 aa, Homo Sapiens
MPPGGSGPGGCPRRPPALAGPLPPPPPPPPPPLLPLLPLLLLLLLGAAEGARVSSSLSTTHHVHHFHSKHGTVPIAINRMPFLTRGGHAGTTYIFGKGGALITYTWPPNDRPSTRMDRLAVGFSTHQRSAVLVRVDSASGLGDYLQLHIDQGTVGVIFNVGTDDITIDEPNAIVSDGKYHVVRFTRSGGNATLQVDSWPVNERYPAGNFDNERLAIARQRIPYRLGRVVDEWLLDKGRQLTIFNSQAAIKIGGRDQGRPFQGQVSGLYYNGLKVLALAAESDPNVRTEGHLRLVGEGPSVLLSAETTATTLLADMATTIMETTTTMATTTTRRGRSPTLRDSTTQNTDDLLVASAECPSDDEDLEECEPSTGGELILPIITEDSLDPPPVATRSPFVPPPPTFYPFLTGVGATQDTLPPPAARRPPSGGPCQAERDDSDCEEPIEASGFASGEVFDSSLPPTDDEDFYTTFPLVTDRTTLLSPRKPAPRPNLRTDGATGAPGVLFAPSAPAPNLPAGKMNHRDPLQPLLENPPLGPGAPTSFEPRRPPPLRPGVTSAPGFPHLPTANPTGPGERGPPGAVEVIRESSSTTGMVVGIVAAAALCILILLYAMYKYRNRDEGSYQVDQSRNYISNSAQSNGAVVKEKAPAAPKTPSKAKKNKDKEYYV

SEQ ID NO: 9588 - protein, 293 aa, Homo Sapiens [sequence omitted]

SEQ ID NO: 9589 - protein, 215 aa, Homo Sapiens
  misc_feature (1)..(1): Xaa can be any naturally occurring amino acid
XADPLCAPARNPCANGGLCTVLAPGEVGCDCSHTGFGGKFCSEEEHPMEVGSLLFSEGGAGRGGAGDVHQPTKGKEEFVATFKGNEFFCYDLSHNPIQSSTDEITLAFRTLQRNGLMLHTGKSADYVNLSLKSGAVWLVINLGSGAFEALVEPVNGKFNDNAWHDVRVTRNLRQVTISVDGILTTTGYTQEDYTMLGSDDFFYIGGSPNTADLPG

SEQ ID NO: 9590 - protein, 206 aa, Homo Sapiens
  misc_feature (1)..(1): Xaa can be any naturally occurring amino acid
XCSEEEHPMEGPAHLTLNSEVGSLLFSEGGAGRGGAGDVHQPTKGKEEFVATFKGNEFFCYDLSHNPIQSSTDEITLAFRTLQRNGLMLHTGKSADYVNLSLKSGAVWLVINLGSGAFEALVEPVNGKFNDNAWHDVRVTRNLRQVTISVDGILTTTGYTQEDYTMLGSDDFFYIGGSPNTADLPGSPVSNNFMGCLKDVVYKNND

SEQ ID NO: 9591 - protein, 331 aa, Homo Sapiens
MDRAAVARVGAVASASVCALVAGVVLAQYIFTLKRKTGRKTKIIEMMPEFQKSSVRIKNPTRVEEIICGLIKGGAAKLQIITDFDMTLSRFSYKGKRCPTCHNIIDNCKLVTDECRKKLLQLKEKYYAIEVDPVLTVEEKYPYMVEWYTKSHGLLVQQALPKAKLKEIVAESDVMLKEGYENFFDKLQQHSIPVFIFSAGIGDVLEEVIRQAGVYHPNVKVVSNFMDFDETGVLKGFKGELIHVFNKHDGALRNTEYFNQLKDNSNIILLGDSQGDLRMADGVANVEHILKIGYLNDRVDELLEKYMDSYDIVLVQDESLEVANSILQKIL

SEQ ID NO: 9592 - protein, 331 aa, Homo Sapiens; identical to SEQ ID NO: 9591

SEQ ID NO: 9593 - protein, 42 aa, Homo Sapiens
MPEFQKSSVRIKNPTRVEEIICGLIKGGAAKLQIITDFDMTL

SEQ ID NO: 9594 - protein, 285 aa, Homo Sapiens
MPEFQKSSVRIKNPTRVEEIICGLIKGGAAKLQIITDFDMTLSRFSYKGKRCPTCHNIIDNCKLVTDECRKKLLQLKEKYYAIEVDPVLTVEEKYPYMVEWYTKSHGLLVQQALPKAKLKEIVAESDVMLKEGYENFFDKLQQHSIPVFIFSAGIGDVLEEVIRQAGVYHPNVKVVSNFMDFDETGVLKGFKGELIHVFNKHDGALRNTEYFNQLKDNSNIILLGDSQGDLRMADGVANVEHILKIGYLNDRVDELLEKYMDSYDIVLVQDESLEVANSILQKIL

SEQ ID NO: 9595 - protein, 285 aa, Homo Sapiens; identical to SEQ ID NO: 9594

SEQ ID NO: 9596 - protein, 54 aa, Homo Sapiens
MRAPSMDRAAVARVGAVASASVCALVAGVVLAQYIFTLKRKTGRKTKIIEMKIG

SEQ ID NO: 9597 - protein, 336 aa, Homo Sapiens
MRAPSMDRAAVARVGAVASASVCALVAGVVLAQYIFTLKRKTGRKTKIIEMMPEFQKSSVRIKNPTRVEEIICGLIKGGAAKLQIITDFDMTLSRFSYKGKRCPTCHNIIDNCKLVTDECRKKLLQLKEKYYAIEVDPVLTVEEKYPYMVEWYTKSHGLLVQQALPKAKLKEIVAESDVMLKEGYENFFDKLQQHSIPVFIFSAGIGDVLEEVIRQAGVYHPNVKVVSNFMDFDETGVLKGFKGELIHVFNKHDGALRNTEYFNQLKDNSNIILLGDSQGDLRMADGVANVEHILKIGYLNDRVDELLEKYMDSYDIVLVQDESLEVANSILQKIL

SEQ ID NO: 9598 - protein, 297 aa, Homo Sapiens
MTNQESAVHVKMMPEFQKSSVRIKNPTRVEEIICGLIKGGAAKLQIITDFDMTLSRFSYKGKRCPTCHNIIDNCKLVTDECRKKLLQLKEKYYAIEVDPVLTVEEKYPYMVEWYTKSHGLLVQQALPKAKLKEIVAESDVMLKEGYENFFDKLQQHSIPVFIFSAGIGDVLEEVIRQAGVYHPNVKVVSNFMDFDETGVLKGFKGELIHVFNKHDGALRNTEYFNQLKDNSNIILLGDSQGDLRMADGVANVEHILKIGYLNDRVDELLEKYMDSYDIVLVQDESLEVANSILQKIL

SEQ ID NO: 9599 - protein, 297 aa, Homo Sapiens; identical to SEQ ID NO: 9598

SEQ ID NO: 9600 - protein, 297 aa, Homo Sapiens; identical to SEQ ID NO: 9598

SEQ ID NO: 9601 - protein, 205 aa, Homo Sapiens
MTNQESAVHVKMMPEFQKSSVRIKNPTRVEEIICGLIKGGAAKLQIITDFDMTLSRFSYKGKRCPTCHNIIDNCKLVTDECRKKLLQLKEKYYAIEVDPVLTVEEKYPYMVEWYTKSHGLLVQQALPKAKLKEIVAESDVMLKEGYENFFDKLQQHSIPVFIFSAGIGDVLEEVIRQAGVYHPNVKVVSNFMDFDETVRISNRSS

SEQ ID NO: 9602 - protein, 548 aa, Homo Sapiens
MTMAAAAVVARGAGARAATAAALRGGCGTAARGRPCAGPARPLCTAPGTAPDMKRYLWERYREAKRSTEELVPSIMSNLLNPDAIFSNNEMSLSDIEIYGFDYDYTLVFYSKHLHTLIFNAARDLLINEHRYPAEIRKYEYDPNFAIRGLHYDVQRAVLMKIDAFHYIQLGTVYRGLSVVPDEEVIEMYEGSHVPLEQMSDFYGKSSHGNTMKQFMDIFSLPEMTLLSCVNEYFLKNNIDYEPVHLYKDVKDSIRDVHIKGIMYRAIEADIEKYICYAEQTRAVLAKLADHGKKMFLITNSPSSFVDKGMSYIVGKDWRDLFDVVIVQAEKPNFFNDKRRPFRKMNEKGVLLWDKIHKLQKGQIYKQGNLYEFLKLTGWRGSRVLYFGDHIYSDLADLTLKHGWRTGAIIPELRSELKIMNTEQYIQTMTWLQTLTGLLEQMQVHRDAESQLVLQEWKKERKEMREMTKSFFNAQFGSLFRTDQNPTYFLRRLSRFADIYMASLSCLLNYDVSHTFYPRRTPLQHELPAWSERPPTFGTPLLQEAQAK

SEQ ID NO: 9603 - protein, 135 aa, Homo Sapiens
  misc_feature (1)..(1): Xaa can be any naturally occurring amino acid
XAKLADHGKKMFLITNSPSSFVDKGMSYIVGKDWRDLFDVVIVQAEKPNFFNDKRRPFRKMNEKGVLLWDKIHKLQKGQIYKQGNLYEFLKLTGWRGSRVLYFGDHIYSDLATMVNDSRPSVSAGVVTHGNYFQN

SEQ ID NO: 9604 - protein, 122 aa, Homo Sapiens
  misc_feature (1)..(1): Xaa can be any naturally occurring amino acid
XTMTWLQTLTGLLEQMQVHRDAESQLVLQEWKKERKEMREMTKSFFNAQFGSLFRTDQNPTYFLRRLSRFADIYMASLSCLLNYDVSHTFYPRRTPLQHELPAWSERPPTFGTPLLQEAQAK

SEQ ID NO: 9605 - protein, 264 aa, Homo Sapiens
MCPRAARAPATLLLALGAVLWPAAGAWELTILHTNDVHSRLEQTSEDSSKCVNASRCMGGVARLFTKVQQIRRAEPNVLLLDAGDQYQGTIWFTVYKGAEVAHFMNALRYDAMALGNHEFDNGVEGLIEPLLKEAKFPILSANIKAKGPLASQISGLYLPYKVLPVGDEVVGIVGYTSKETPFLSNPGTNLVFEDEITALQPEVDKLKTLNVNKIIALGHSGFEMDKLIAQKVRGVDVVVGGHSNTFLYTGNCFKRIAWARMSR

SEQ ID NO: 9606 - protein, 574 aa, Homo Sapiens
MCPRAARAPATLLLALGAVLWPAAGAWELTILHTNDVHSRLEQTSEDSSKCVNASRCMGGVARLFTKVQQIRRAEPNVLLLDAGDQYQGTIWFTVYKGAEVAHFMNALRYDAMALGNHEFDNGVEGLIEPLLKEAKFPILSANIKAKGPLASQISGLYLPYKVLPVGDEVVGIVGYTSKETPFLSNPGTNLVFEDEITALQPEVDKLKTLNVNKIIALGHSGFEMDKLIAQKVRGVDVVVGGHSNTFLYTGNPPSKEVPAGKYPFIVTSDDGRKVPVVQAYAFGKYLGYLKIEFDERGNVISSHGNPILLNSSIPEDPSIKADINKWRIKLDNYSTQELGKTIVYLDGSSQSCRFRECNMGNLICDAMINNNLRHTDEMFWNHVSMCILNGGGIRSPIDERNNGTITWENLAAVLPFGGTFDLVQLKGSTLKKAFEHSVHRYGQSTGEFLQVGGIHVVYDLSRKPGDRVVKLDVLCTKCRVPSYDPLKMDEVYKVILPNFLANGGDGFQMIKDELLRHDSGDQDINVVSTYISKMKVIYPAVEGRIKFSTGSHCHGSFSLIFLSLWAVIFVLYQ

SEQ ID NO: 9607 - protein, 524 aa, Homo Sapiens
MCPRAARAPATLLLALGAVLWPAAGAWELTILHTNDVHSRLEQTSEDSSKCVNASRCMGGVARLFTKVQQIRRAEPNVLLLDAGDQYQGTIWFTVYKGAEVAHFMNALRYDAMALGNHEFDNGVEGLIEPLLKEAKFPILSANIKAKGPLASQISGLYLPYKVLPVGDEVVGIVGYTSKETPFLSNPGTNLVFEDEITALQPEVDKLKTLNVNKIIALGHSGFEMDKLIAQKVRGVDVVVGGHSNTFLYTGNPPSKEVPAGKYPFIVTSDDGRKVPVVQAYAFGKYLGYLKIEFDERGNVISSHGNPILLNSSIPEDPSIKADINKWRIKLDNYSTQELGKTIVYLDGSSQSCRFRECNMGNLICDAMINNNLRHTDEMFWNHVSMCILNGGGIRSPIDERNNGIHVVYDLSRKPGDRVVKLDVLCTKCRVPSYDPLKMDEVYKVILPNFLANGGDGFQMIKDELLRHDSGDQDINVVSTYISKMKVIYPAVEGRIKFSTGSHCHGSFSLIFLSLWAVIFVLYQ

SEQ ID NO: 9608 - protein, 230 aa, Homo Sapiens
  misc_feature (1)..(1): Xaa can be any naturally occurring amino acid
XDVVVGGHSNTFLYTGNPPSKEVPAGKYPFIVTSDDGRKVPVVQAYAFGKYLGYLKIEFDERGNVISSHGNPILLNSSIPEDPSIKADINKWRIKLDNYSTQELGKTIVYLDGSSQSCRFRECNMGNLICDAMINNNLRHTDEMFWNHVSMCILNGGGIRSPIDERNNGIHVVYDLSRKPGDRVVKLDVLCTKCRVPSYDPLKMDEVYKVILPNFLANGGDGFQMIKDEL

SEQ ID NO: 9609 - protein, 179 aa, Homo Sapiens
  misc_feature (1)..(1): Xaa can be any naturally occurring amino acid
XNPILLNSSIPEDPSIKADINKWRIKLDNYSTQELGKTIVYLDGSSQSCRFRECNMGNLICDAMINNNLRHTDEMFWNHVSMCILNGGGIRSPIDERNNGTITWENLAAVLPFGGTFDLVQLKGSTLKKAFEHSVHRYGQSTGEFLQVGDLKECCPICINQDDSWKEQPTAQTYLNTWF

SEQ ID NO: 9610 - protein, 257 aa, Homo Sapiens
MSILFYVIFLAYLRGIQGNNMDQRSLPEDSLNSLIIKLIQADILKNKLSKQMVDVKENYQSTLPKAEAPREPERGGPAKSAFQPVIAMDTELLRQQRRYNSPRVLLSDSTPLEPPPLYLMEDYVGSPVVANRTSRRKRYAEHKSHRGEYSVCDSESLWVTDKSSAIDIRGHQVTVLGEIKTGNSPVKQYFYETRCKEARPVKNGCRGIDDKHWNSQCKTSQTYVRALTSENNKLVGWRWIRIDTSCVCALSRKIGRT

SEQ ID NO: 9611 - protein, 270 aa, Homo Sapiens
MVTFATILQVNKVMSILFYVIFLAYLRGIQGNNMDQRSLPEDSLNSLIIKLIQADILKNKLSKQMVDVKENYQSTLPKAEAPREPERGGPAKSAFQPVIAMDTELLRQQRRYNSPRVLLSDSTPLEPPPLYLMEDYVGSPVVANRTSRRKRYAEHKSHRGEYSVCDSESLWVTDKSSAIDIRGHQVTVLGEIKTGNSPVKQYFYETRCKEARPVKNGCRGIDDKHWNSQCKTSQTYVRALTSENNKLVGWRWIRIDTSCVCALSRKIGRT

SEQ ID NO: 9612 - protein, 143 aa, Homo Sapiens
MLPLPSCSLPILLLFLLPSVPIESQPPPSTLPPFLAPEWDLLSPRVVLSRGAPAGPPLLFLLEAGAFRESAGAPANRSRRGVSETAPASRRGELAVCDAVSGWVTDRRTAVDLRGREVEVLGEVPAAGGSPLRQYFFETRCKA

SEQ ID NO: 9613 - protein, 210 aa, Homo Sapiens
MLPLPSCSLPILLLFLLPSVPIESQPPPSTLPPFLAPEWDLLSPRVVLSRGAPAGPPLLFLLEAGAFRESAGAPANRSRRGVSETAPASRRGELAVCDAVSGWVTDRRTAVDLRGREVEVLGEVPAAGGSPLRQYFFETRCKADNAEEGGPGAGGGGCRGVDRRHWVSECKAKQSYVRALTADAQGRVGWRWIRIDTACVCTLLSRTGRA

SEQ ID NO: 9614 - protein, 316 aa, Homo Sapiens
MGVCGYLFLPWKCLVVVSLRLLFLVPTGVPVRSGDATFPKAMDNVTVRQGESATLRCTIDNRVTRVAWLNRSTILYAGNDKWCLDPRVVLLSNTQTQYSIEIQNVDVYDEGPYTCSVQTDNHPKTSRVHLIVQVSPKIVEISSDISINEGNNISLTCIATGRPEPTVTWRHISPKAVGFVSEDEYLEIQGITREQSGDYECSASNDVAAPVVRRVKVTVNYPPYISEAKGTGVPVGQKGTLQCEASAVPSAEFQWYKDDKRLIEGKKGVKVENRPFLSKLIFFNVSEHDYGNYTCVASNKLGHTNASIMLFGETVL

SEQ ID NO: 9615 - protein, 344 aa, Homo Sapiens
MGVCGYLFLPWKCLVVVSLRLLFLVPTGVPVRSGDATFPKAMDNVTVRQGESATLRCTIDNRVTRVAWLNRSTILYAGNDKWCLDPRVVLLSNTQTQYSIEIQNVDVYDEGPYTCSVQTDNHPKTSRVHLIVQVSPKIVEISSDISINEGNNISLTCIATGRPEPTVTWRHISPKAVGFVSEDEYLEIQGITREQSGDYECSASNDVAAPVVRRVKVTVNYPPYISEAKGTGVPVGQKGTLQCEASAVPSAEFQWYKDDKRLIEGKKGVKVENRPFLSKLIFFNVSEHDYGNYTCVASNKLGHTNASIMLFGPGAVSEVSNGTSRRAGCVWLLPLLVLHLLLKF

SEQ ID NO: 9616 - protein, 355 aa, Homo Sapiens
MGVCGYLFLPWKCLVVVSLRLLFLVPTGVPVRSGDATFPKAMDNVTVRQGESATLRCTIDNRVTRVAWLNRSTILYAGNDKWCLDPRVVLLSNTQTQYSIEIQNVDVYDEGPYTCSVQTDNHPKTSRVHLIVQVSPKIVEISSDISINEGNNISLTCIATGRPEPTVTWRHISPKAVGFVSEDEYLEIQGITREQSGDYECSASNDVAAPVVRRVKVTVNYPPYISEAKGTGVPVGQKGTLQCEASAVPSAEFQWYKDDKRLIEGKKGVKVENRPFLSKLIFFNVSEHDYGNYTCVASNKLGHTNASIMLFEVKTTALTPWKGPGAVSEVSNGTSRRAGCVWLLPLLVLHLLLKF

SEQ ID NO: 9617 - protein, 344 aa, Homo Sapiens
MKTIQPKMHNSISWAIFTGLAALCLFQGVPVRSGDATFPKAMDNVTVRQGESATLRCTIDNRVTRVAWLNRSTILYAGNDKWCLDPRVVLLSNTQTQYSIEIQNVDVYDEGPYTCSVQTDNHPKTSRVHLIVQVSPKIVEISSDISINEGNNISLTCIATGRPEPTVTWRHISPKAVGFVSEDEYLEIQGITREQSGDYECSASNDVAAPVVRRVKVTVNYPPYISEAKGTGVPVGQKGTLQCEASAVPSAEFQWYKDDKRLIEGKKGVKVENRPFLSKLIFFNVSEHDYGNYTCVASNKLGHTNASIMLFGPGAVSEVSNGTSRRAGCVWLLPLLVLHLLLKF

SEQ ID NO: 9618 - protein, 18 aa, Homo Sapiens
MNGKRNGEGGKRWKWKGT

SEQ ID NO: 9619 - protein, 36 aa, Homo Sapiens
MNGKRNGEGGKRWKWKGTGVPVRSGDATFPKAMDNV

SEQ ID NO: 9620 - protein, 191 aa, Homo Sapiens
MNGKRNGEGGKRWKWKGTGVPVRSGDATFPKAMDNVTVRQGESATLRCTIDNRVTRVAWLNRSTILYAGNDKWCLDPRVVLLSNTQTQYSIEIQNVDVYDEGPYTCSVQTDNHPKTSRVHLIVQVSPKIVEISSDISINEGNNISLTCIATGRPEPTVTWRHISPKAVGFVSEDEYLEIQGITREQSGDYE

SEQ ID NO: 9621 - protein, 179 aa, Homo Sapiens
VGFVSEDEYLEIQGITREQSGDYECSASNDVAAPVVRRVKVTVNYPPYISEAKGTGVPVGQKGTLQCEASAVPSAEFQWYKDDKRLIEGKKGVKVENRPFLSKLIFFNVSEHDYGNYTCVASNKLGHTNASIMLFEVKTTALTPWKGPGAVSEVSNGTSRRAGCVWLLPLLVLHLLLKF

SEQ ID NO: 9622 - protein, 168 aa, Homo Sapiens
VGFVSEDEYLEIQGITREQSGDYECSASNDVAAPVVRRVKVTVNYPPYISEAKGTGVPVGQKGTLQCEASAVPSAEFQWYKDDKRLIEGKKGVKVENRPFLSKLIFFNVSEHDYGNYTCVASNKLGHTNASIMLFGPGAVSEVSNGTSRRAGCVWLLPLLVLHLLLKF

SEQ ID NO: 9623 - protein, 119 aa, Homo Sapiens
  misc_feature (1)..(1): Xaa can be any naturally occurring amino acid
XSAEFQWYKDDKRLIEGKKGVKVENRPFLSKLIFFNVSEHDYGNYTCVASNKLGHTNASIMLFELNEPTSSTLLQEVKTTALTPWKGPGAVSEVSNGTSRRAGCVWLLPLLVLHLLLKF

SEQ ID NO: 9624 - protein, 153 aa, Homo Sapiens
HYCKEGYYRDMGKPITHRKACKACDCHPVGAAGKTCNQTTGQCPCKDGVTGITCNRCAKGYQQSRSPIAPCIKIPVAPPTTAASSVEEPEAARQPNTFQAEGLSLLPGAAEKEGARCWGYRRRLGHRVAQAECRGPRSWAWGRITSSFSFASN

SEQ ID NO: 9625 - protein, 604 aa, Homo Sapiens
MMRAVWEALAALAAVACLVGAVRGGPGLSMFAGQAAQPDPCSDENGHPRRCIPDFVNAAFGKDVRVSSTCGRPPARYCVVSERGEERLRSCHLCNASDPKKAHPPAFLTDLNNPHNLTCWQSENYLQFPHNVTLTLSLGKKFEVTYVSLQFCSPRPESMAIYKSMDYGRTWVPFQFYSTQCRKMYNRPHRAPITKQNEQEAVCTDSHTDMRPLSGGLIAFSTLDGRPSAHDFDNSPVLQDWVTATDIRVAFSRLHTFGDENEDDSELARDSYFYAVSDLQVGGRCKCNGHAARCVRDRDDSLVCDCRHNTAGPECDRCKPFHYDRPWQRATAREANECVACNCNLHARRCRFNMELYKLSGRKSGGVCLNCRHNTAGRHCHYCKEGYYRDMGKPITHRKACKACDCHPVGAAGKTCNQTTGQCPCKDGVTGITCNRCAKGYQQSRSPIAPCIKIPVAPPTTAASSVEEPEDCDSYCKASKGKLKINMKKYCKKDYAVQIHILKADKAGDWWKFTVNIISVYKQGTSRIRRGDQSLWIRSRDIACKCPKIKPLKKYLLLGNAEDSPDQSGIVADKSSLVIQWRDTWARRLRKFQQREKKGKCKKA

SEQ ID NO: 9626 - protein, 580 aa, Homo Sapiens
MPGWPWGLLLTAGTLFAALSPGPPAPADPCHDEGGAPRGCVPGLVNAALGREVLASSTCGRPATRACDASDPRRAHSPALLTSPGGTASPLCWRSESLPRAPLNVTLTVPLGKAFELVFVSLRFCSAPPASVALLKSQDHGRSWAPLGFFSSHCDLDYGRLPAPANGPAGPGPEALCFPAPLAQPDGSGLLAFSMQDSSPPGLDLDSSPVLQDWVTATDVRVVLTRPSTAGDPRDMEAVVPYSYAATDLQVGGRCKCNGHASRCLLDTQGHLICDCRHGTEGPDCGRCKPFYCDRPWQRATARESHACLACSCNGHARRCRFNMELYRLSGRRSGGVCLNCRHNTAGRHCHYCREGFYRDPGRALSDRRACRACDCHPVGAAGKTCNQTTGQCPCKDGVTGLTCNRCAPGFQQSRSPVAPCVKTPIPGPTEDSSPVQPQDCDSHCKPARGSYRISLKKFCKKDYAVQVAVGARGEARGAWTRFPVAVLAVFRSGEERARRGSSALWVPAGDAACGCPRLLPGRRYLLLGGGPGAAAGGAGGRGPGLIAARGSLVLPWRDAWTRRLRRLQRRERRGRCSAA

SEQ ID NO: 9627 - protein, 176 aa, Homo Sapiens
MGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPYDTENPYSA

SEQ ID NO: 9628 - protein, 591 aa, Homo Sapiens
MGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPYDTENPYSAKVQEQLKITNLRVQLLKRQSCPCQRNDLNEEPQHFTHYAIYDFIVKGSCFCNGHADQCIPVHGFRPVKAPGTFHMVHGKCMCKHNTAGSHCQHCAPLYNDRPWEAADGKTGAPNECRTCKCNGHADTCHFDVNVWEASGNRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWYHEVPDFRPVHNKSEPAWEWEDAQGFSALLHSGKCECKEQTLGNAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 9629 - protein, 591 aa, Homo Sapiens; identical to SEQ ID NO: 9628

SEQ ID NO: 9630 - protein, 628 aa, Homo Sapiens
MGSCARLLLLWGCTVVAAGLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPYDTENPYSAKVQEQLKITNLRVQLLKRQSCPCQRNDLNEEPQHFTHYAIYDFIVKGSCFCNGHADQCIPVHGFRPVKAPGTFHMVHGKCMCKHNTAGSHCQHCAPLYNDRPWEAADGKTGAPNECRTCKCNGHADTCHFDVNVWEASGNRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWYHEVPDFRPVHNKSEPAWEWEDAQGFSALLHSGKCECKEQTLGNAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 9631 - protein, 605 aa, Homo Sapiens
MGSCARLLLLWGCTVVAAGLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPYDTENPYSAKVQEQLKITNLRVQLLKRQSCPCQRNDLNEEPQHFTHYAIYDFIVKGSCFCNGHADQCIPVHGFRPVKAPGTFHMVHGKCMCKHNTAGSHCQHCAPLYNDRPWEAADGKTGAPNECRTCKCNGHADTCHFDVNVWEASGNRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWYHEVPDFRPVHNKSEPAWEWEDAQGFSALLHSVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 9632 - protein, 75 aa, Homo Sapiens
MPCQRIPEATTTLATTPGAYSSDPQCQNYCNMSDTRVHMSLRRYCQQDHVLRAQVLASEAAGPAWQRLAVRVLAV

SEQ ID NO: 9633 - protein, 489 aa, Homo Sapiens
MPVTFALLLLLGQATADPCYDPQGRPQFCLPPVTQLAAVAASCPQACALSPGNHLGARETCNGSLTLALGGPFLLTSVSLRFCTPGPPALILSAAWASGGPWRLLWHRPAWPGALGGPERVTFHSTPGPKATVAASHLRVEFGGQAGLAAAGLRGRCQCHGHAARCAARARPPRCHCRHHTTGPGCESCRPSHRDWPWRPATPRHPHPCLPCSCNQHARRCRFNSELFRLSGGRSGGVCERCRHHTAGRHCHYCQPGFWRDPSQPIFSRRACRACQCHPIGATGGTCNQTSGQCTCKLGVTGLTCNRCGPGYQQSRSPRMPCQRIPEATTTLATTPGAYSSDPQCQNYCNMSDTRVHMSLRRYCQQDHVLRAQVLASEAAGPAWQRLAVRVLAVYKQRAQPVRRGDQDAWVPRADLTCGCLRLQPGTDYLLLGSAVGDPDPTRLILDRHGLALPWRPRWARPLKRLQQEERAGGCRGVRAPTPSPRPEH

SEQ ID NO: 9634 - protein, 480 aa, Homo Sapiens
MYLSRFLSIHALWVTVSSVMQPYPLVWGHYDLCKTQIYTEEGKVWDYMACQPESTDMTKYLKVKLDPPDITCGDPPETFCAMGNPYMCNNECDASTPELAHPPELMFDFEGRHPSTFWQSATWKEYPKPLQVNITLSWSKTIELTDNIVITFESGRPDQMILEKSLDYGRTWQPYQYYATDCLDAFHMDPKSVKDLSQHTVLEIICTEEYSTGYTTNSKIIHFEIKDRFAFFAGPRLRNMASLYGQLDTTKKLRDFFTVTDLRIRLLRPAVGEIFVDELHLARYFYAISDIKVRGRCKCNLHATVCVYDNSKLTCECEHNTTGPDCGKCKKNYQGRPWSPGSYLPIPKGTANTCIPSISSIGNPPKFNRIWPNISSLEVSNPKQVAPKLALSTVSSVQVANHKRANVCDNELLHCQNGGTCHNNVRCLCPAAYTGILCEKLRCEEAGSCGSDSGQGAPPHGSPALLLLTTLLGTASPLVF

SEQ ID NO: 9635 - protein, 539 aa, Homo Sapiens
MYLSRFLSIHALWVTVSSVMQPYPLVWGHYDLCKTQIYTEEGKVWDYMACQPESTDMTKYLKVKLDPPDITCGDPPETFCAMGNPYMCNNECDASTPELAHPPELMFDFEGRHPSTFWQSATWKEYPKPLQVNITLSWSKTIELTDNIVITFESGRPDQMILEKSLDYGRTWQPYQYYATDCLDAFHMDPKSVKDLSQHTVLEIICTEEYSTGYTTNSKIIHFEIKDRFAFFAGPRLRNMASLYGQLDTTKKLRDFFTVTDLRIRLLRPAVGEIFVDELHLARYFYAISDIKVRGRCKCNLHATVCVYDNSKLTCECEHNTTGPDCGKCKKNYQGRPWSPGSYLPIPKGTANTCIPSISSIGNCECFGHSNRCSYIDLLNTVICVSCKHNTRGQHCELCRLGYFRNASAQLDDENVCIECYCNPLGSIHDRCNGSGFCECKTGTTGPKCDECLPGNSWHYGCQPNVCDNELLHCQNGGTCHNNVRCLCPAAYTGILCEKLRCEEAGSCGSDSGQGAPPHGSPALLLLTTLLGTASPLVF

SEQ ID NO: 9636 - protein, 539 aa, Homo Sapiens; identical to SEQ ID NO: 9635

SEQ ID NO: 9637 - protein, 460 aa, Homo Sapiens
MYLSRFLSIHALWVTVSSVMQPYPLVWGHYDLCKTQIYTEEGKVWDYMACQPESTDMTKYLKVKLDPPDITCGDPPETFCAMGNPYMCNNECDASTPELAHPPELMFDFEGRHPSTFWQSATWKEYPKPLQVNITLSWSKTIELTDNIVITFESGRPDQMILEKSLDYGRTWQPYQYYATDCLDAFHMDPKSVKDLSQHTVLEIICTEEYSTGYTTNSKIIHFEIKDRFAFFAGPRLRNMASLYGQLDTTKKLRDFFTVTDLRIRLLRPAVGEIFVDELHLARYFYAISDIKVRGRCKCNLHATVCVYDNSKLTCECEHNTTGPDCGKCKKNYQGRPWSPGSYLPIPKGTANTCIPSISSIGNPPKFNRIWPNISSLEVSNPKQANVCDNELLHCQNGGTCHNNVRCLCPAAYTGILCEKLRCEEAGSCGSDSGQGAPPHGSPALLLLTTLLGTASPLVF

SEQ ID NO: 9638 - protein, 480 aa, Homo Sapiens; identical to SEQ ID NO: 9634

SEQ ID NO: 9639 - protein, 438 aa, Homo Sapiens
MYLSRFLSIHALWVTVSSVMQPYPLVWGHYDLCKTQIYTEEGKVWDYMACQPESTDMTKYLKVKLDPPDITCGDPPETFCAMGNPYMCNNECDASTPELAHPPELMFDFEGRHPSTFWQSATWKEYPKPLQVNITLSWSKTIELTDNIVITFESGRPDQMILEKSLDYGRTWQPYQYYATDCLDAFHMDPKSVKDLSQHTVLEIICTEEYSTGYTTNSKIIHFEIKDRFAFFAGPRLRNMASLYGQLDTTKKLRDFFTVTDLRIRLLRPAVGEIFVDELHLARYFYAISDIKVRGRCKCNLHATVCVYDNSKLTCECEHNTTGPDCGKCKKNYQGRPWSPGSYLPIPKGTANTCIPSISSIGTNVCDNELLHCQNGGTCHNNVRCLCPAAYTGILCEKLRCEEAGSCGSDSGQGAPPHGSPALLLLTTLLGTASPLVF

SEQ ID NO: 9640 - protein, 494 aa, Homo Sapiens
MYLSRFLSIHALWVTVSSVMQPYPLVWGHYDLCKTQIYTEEGKVWDYMACQPESTDMTKYLKVKLDPPDITCGDPPETFCAMGNPYMCNNECDASTPELAHPPELMFDFEGRHPSTFWQSATWKEYPKPLQVNITLSWSKTIELTDNIVITFESGRPDQMILEKSLDYGRTWQPYQYYATDCLDAFHMDPKSVKDLSQHTVLEIICTEEYSTGYTTNSKIIHFEIKDRFAFFAGPRLRNMASLYGQLDTTKKLRDFFTVTDLRIRLLRPAVGEIFVDELHLARYFYAISDIKVRGRCKCNLHATVCVYDNSKLTCECEHNTTGPDCGKCKKNYQGRPWSPGSYLPIPKGTANTCIPSISSIGNCECFGHSNRCSYIDLLNTVICVSCKHNTRGQHCELCRLGYFRNASAQLDDENVCIANVCDNELLHCQNGGTCHNNVRCLCPAAYTGILCEKLRCEEAGSCGSDSGQGAPPHGSPALLLLTTLLGTASPLVF

SEQ ID NO: 9641 - protein, 422 aa, Homo Sapiens
MLHLLALFLHCLPLASGDYDICKSWVTTDEGPTWEFYACQPKVMRLKDYVKVKVEPSGITCGDPPERFCSHENPYLCSNECDASNPDLAHPPRLMFDKEEEGLATYWQSITWSRYPSPLEANITLSWNKTVELTDDVVMTFEYGRPTVMVLEKSLDNGRTWQPYQFYAEDCMEAFGMSARRARDMSSSSAHRVLCTEEYSRWAGSKKEKHVRFEVRDRFAIFAGPDLRNMDNLYTRLESAKGLKEFFTLTDLRMRLLRPALGGTYVQRENLYKYFYAISNIEVIGRCKCNLHANLCSMREGSLQCECEHNTTGPDCGKCKKNFRTRSWRAGSYLPLPHGSPNACATAGSFGTLQTPPPGRSPSALRGSRRGLANVKEPAGSRPQISEMLLGCTVTLHQGSVGPHIPPKLSLPDPGGPWLGSQ

SEQ ID NO: 9642 - protein, 530 aa, Homo Sapiens
MLHLLALFLHCLPLASGDYDICKSWVTTDEGPTWEFYACQPKVMRLKDYVKVKVEPSGITCGDPPERFCSHENPYLCSNECDASNPDLAHPPRLMFDKEEEGLATYWQSITWSRYPSPLEANITLSWNKTVELTDDVVMTFEYGRPTVMVLEKSLDNGRTWQPYQFYAEDCMEAFGMSARRARDMSSSSAHRVLCTEEYSRWAGSKKEKHVRFEVRDRFAIFAGPDLRNMDNLYTRLESAKGLKEFFTLTDLRMRLLRPALGGTYVQRENLYKYFYAISNIEVIGRCKCNLHANLCSMREGSLQCECEHNTTGPDCGKCKKNFRTRSWRAGSYLPLPHGSPNACATAGSFGNCECYGHSNRCSYIDFLNVVTCVSCKHNTRGQHCQHCRLGYYRNGSAELDDENVCIECNCNQIGSVHDRCNETGFCECREGAAGPKCDDCLPTHYWRQGCYPNVCDDDQLLCQNGGTCLQNQRCACPRGYTGVRCEQPRCDPADDDGGLDCDRAPGAAPRPATLLGCLLLLGLAARLGR

SEQ ID NO: 9643 - protein, 170 aa, Homo Sapiens
MMAGMKIQLVCMLLLAFSSWSLCSDSEEEMKALEADFLTNMHTSKISKAHVPSWKMTLLNVCSLVNNLNSPAEETGEVHEEELVARRKLPTALDGFSLEAMLTIYQLHKICHSRAFQHWELIQEDILDTGNDKNGKEEVIKRKIPYILKRQLYENKPRRPYILKRDSYYY

SEQ ID NO: 9644 - protein, 95 aa, Homo Sapiens
MMAGMKIQLVCMLLLAFSSWSLCSDSEEEMKALEADFLTNMHTSKLIQEDILDTGNDKNGKEEVIKRKIPYILKRQLYENKPRRPYILKRDSYYY

SEQ ID NO: 9645 - protein, 103 aa, Homo Sapiens
MGIWQRLLLFGGVSLRAGGGATAPLGGSRAMVCGRQLSGAGSETLKQRRTQIMSRGLPKQKPIEGVKQVIVVASGKGGVGKSTTAVETGFHRVNQDGLHLLIS

SEQ ID NO: 9646 - protein, 319 aa, Homo Sapiens
MGIWQRLLLFGGVSLRAGGGATAPLGGSRAMVCGRQLSGAGSETLKQRRTQIMSRGLPKQKPIEGVKQVIVVASGKGGVGKSTTAVNLALALAANDSSKAIGLLDVDVYGPSVPKMMNLKGNPELSQSNLMRPLLNYGIACMSMGFLVEESEPVVWRGLMVMSAIEKLLRQVDWGQLDYLVVDMPPGTGDVQLSVSQNIPITGAVIVSTPQDIALMDAHKGAEMFRRVHVPVLGLVQNMSVFQCPKCKHKTHIFGADGARKLAQTLGLEVLGDIPLHLNIREASDTGQPIVFSQPESDEAKAYLRIAVEVVRRLPSPSE

SEQ ID NO: 9647 - protein, 173 aa, Homo Sapiens
MGIWQRLLLFGGVSLRAGGGATAPLGGSRAMVCGRQLSGAGSETLKQRRTQIMSRGLPKQKPIEGVKQVIVVASGKGGVGKSTTAVNLALALAANDSSKAIGLLDVDVYGPSVPKMMNLKGNPELSQSNLMRPLLNYGIACMSMGFLVEESEPVVWRGLMVMSAIEKLLRQVL

SEQ ID NO: 9648 - protein, 167 aa, Homo Sapiens
MGIWQRLLLFGGVSLRAGGGATAPLGGSRAMVCGRQLSGAGSETLKQRRTQIMSRGLPKQKPIEGVKQVIVVASGKGGVGKSTTAVNLALALAANDSVLGLVQNMSVFQCPKCKHKTHIFGADGARKLAQTLGLEVLGDIPLHLNIREASDTGQPIVFSQPESDEAK

SEQ ID NO: 9649 - protein, 54 aa, Homo Sapiens
MMRIEVKVKMMLSGAGSETLKQRRTQIMSRGLPKQKPIEGVKQVIVVASGKGGV

SEQ ID NO: 9650 - protein, 133 aa, Homo Sapiens
MSRGLPKQKPIEGVKQVIVVASGKGGVGKSTTAVNLALALAANDSSKAIGLLDVDVYGPSVPKMMNLKGNPELSQSNLMRPLLNYGIACMSMGFLVEESEPVVWRGLMVMSAIEKLLRQVDWGQLDYLVVDMP

SEQ ID NO: 9651 - protein, 130 aa, Homo Sapiens
VSLRAGGGATAPLGGSRAMVCGRQLSGAGSETLKQRRTQIMSRGLPKQKPIEGVKQVIVVASGKGGVGKSTTAVNLALALAANDSSKAIGLLDVDVYGPSVPKMMNLKGNPELSQSISQRCCRSCSRPPQ

SEQ ID NO: 9652 - protein, 111 aa, Homo Sapiens
MPPSGPRGTLLLLPLLLLLLLRAVLAVPLERGAPNKEETPATESPDTGLYYHRYLQEVIDVLETDGHFREKLQAANAEDIKSGKLSRELDFVSHHVRTKLDELKRQEVSRL

SEQ ID NO: 9653 - protein, 124 aa, Homo Sapiens
MPPSGPRGTLLLLPLLLLLLLRAVLAVPLERGAPNKEETPATESPDTGLYYHRYLQEVIDVLETDGHFREKLQAANAEDIKSGKLSRELDFVSHHVRTKLDELKRQEVSRLRMLLKAKMDAEQD

SEQ ID NO: 9654 - protein, 268 aa, Homo Sapiens
MPPSGPRGTLLLLPLLLLLLLRAVLAVPLERGAPNKEETPATESPDTGLYYHRYLQEVIDVLETDGHFREKLQAANAEDIKSGKLSRELDFVSHHVRTKLDELKRQEVSRLRMLLKAKMDAEQDPNVQVDHLNLLKQFEHLDPQNQHTFEARDLELLIQTATRDLAQYDAAHHEEFKRYEMLKEHERRRYLESLGEEQRKEAERKLEEQQRRHREHPKVNVPGSQAQLKEVWEELDGLDPNRDLTHPVLGPLRYLAILFPSDINSDGV

SEQ ID NO: 9655 - protein, 461 aa, Homo Sapiens
MPPSGPRGTLLLLPLLLLLLLRAVLAVPLERGAPNKEETPATESPDTGLYYHRYLQEVIDVLETDGHFREKLQAANAEDIKSGKLSRELDFVSHHVRTKLDELKRQEVSRLRMLLKAKMDAEQDPNVQVDHLNLLKQFEHLDPQNQHTFEARDLELLIQTATRDLAQYDAAHHEEFKRYEMLKEHERRRYLESLGEEQRKEAERKLEEQQRRHREHPKVNVPGSQAQLKEVWEELDGLDPNRFNPKTFFILHDINSDGVLDEQELEALFTKELEKVYDPKNEEDDMREMEEERLRMREHVMKNVDTNQDRLVTLEEFLASTQRKEFGDTGEGWETVEMHPAYTEEELRRFEEELAAREAELNAKAQRLSQETEALGRSQGRLEAQKRELQQAVLHMEQRKQQQQQQQGHKAPAAHPEGQLKFHPDTDDVPVPAPAGDQKEVDTSEKKLLERLPEVEVPQHL

SEQ ID NO: 9656 - protein, 461 aa, Homo Sapiens; identical to SEQ ID NO: 9655

SEQ ID NO: 9657 - protein, 75 aa, Homo Sapiens
MPPSGPRGTLLLLPLLLLLLLRAVLAVPLERGAPNKEETPATESPVSGPALLSSQVFAVVLQLLQTPVPVGRMLQ

SEQ ID NO: 9658 - protein, 295 aa, Homo Sapiens
  misc_feature (1)..(1): Xaa can be any naturally occurring amino acid
XPPSGPRGTLLLLPLLLLLLLRAVLAVPLERGAPNKEETPATESPDTGLYYHRYLQEVIDVLETDGHFREKLQAANAEDIKSGKLSRELDFVSHHVRTKLDELKRQEFEHLDPQNQHTFEARDLELLIQTATRDLAQYDAAHHEEFKRYEMLKEHERRRYLESLGEEQRKEAERKLEEQQRRHREHPKVNVPGSQAQLKEVWEELDGLDPNRFNPKTFFILHDINSDGVLDEQELEALFTKELEKVYDPKNEEDDMREMEEERLRMREHVMKNVDTNQDRLVTLEEFLASTQRKE

SEQ ID NO: 9659 - protein, 34 aa, Homo Sapiens
MRWRTILLQYCFLLITCLLTALEAVPIDIDKTKV

SEQ ID NO: 9660 - protein, 34 aa, Homo Sapiens; identical to SEQ ID NO: 9659

SEQ ID NO: 9661 - protein, 39 aa, Homo Sapiens
MRWRTILLQYCFLLITCLLTALEAVPIDIDKTKVQNIHP

SEQ ID NO: 9662 - protein, 69 aa, Homo Sapiens
MRWRTILLQYCFLLITCLLTALEAVPIDIDKTKVQNIHPVESAKIEPPDTGLYYDEYLKQVIDVLETDK

SEQ ID NO: 9663 - protein, 69 aa, Homo Sapiens; identical to SEQ ID NO: 9662

SEQ ID NO: 9664 - protein, 90 aa, Homo Sapiens
MRWRTILLQYCFLLITCLLTALEAVPIDIDKTKVQNIHPVESAKIEPPDTGLYYDEYLKQVIDVLETDKHFREKLQKADIEEIKSGRLSK

SEQ ID NO: 9665 - protein, 195 aa, Homo Sapiens
MRWRTILLQYCFLLITCLLTALEAVPIDIDKTKVQNIHPVESAKIEPPDTGLYYDEYLKQVIDVLETDKHFREKLQKADIEEIKSGRLSKELDLVSHHVRTKLDELKRQEVGRLRMLIKAKLDSLQDIGMDHQALLKQFDHLNHLNPDKFESTDLDMLIKAATSDLEHYDKTRHEEFKKYEMMKEHERREYLKTL

SEQ ID NO: 9666 - protein, 198 aa, Homo Sapiens
MRWRTILLQYCFLLITCLLTALEAVPIDIDKTKVQNIHPVESAKIEPPDTGLYYDEYLKQVIDVLETDKHFREKLQKADIEEIKSGRLSKELDLVSHHVRTKLDELKRQEVGRLRMLIKAKLDSLQDIGMDHQALLKQFDHLNHLNPDKFESTDLDMLIKAATSDLEHYDKTRHEEFKKYEMMKEHERREYLKTLNEE

SEQ ID NO: 9667 - protein, 420 aa, Homo Sapiens
MRWRTILLQYCFLLITCLLTALEAVPIDIDKTKVQNIHPVESAKIEPPDTGLYYDEYLKQVIDVLETDKHFREKLQKADIEEIKSGRLSKELDLVSHHVRTKLDELKRQEVGRLRMLIKAKLDSLQDIGMDHQALLKQFDHLNHLNPDKFESTDLDMLIKAATSDLEHYDKTRHEEFKKYEMMKEHERREYLKTLNEEKRKEEESKFEEMKKKHENHPKVNHPGSKDQLKEVWEETDGLDPNDFDPKTFFKLHDVNSDGFLDEQELEALFTKELEKVYDPKNEEDDMVEMEEERLRMREHVMNEVDTNKDRLVTLEEFLKATEKKEFLEPDSWETLDQQQFFTEEELKEYENIIALQENELKKKADELQKQKEELQRQHDQLEAQKLEYHQVIQQMEQKKLQQGIPPSGPAGELKFEPRV

SEQ ID NO: 9668 - protein, 390 aa, Homo Sapiens
MRWRTILLQYCFLLITCLLTALEAVPIDIDKTKVQNIHPVESAKIEPPDTGLYYDEYLKQVIDVLETDKHFREKLQKADIEEIKSGRLSKELDLVSHHVRTKLDELKRQEVGRLRMLIKAKLDSLQDIGMDHQALLKQFDHLNHLNPDKFESTDLDMLIKAATSDLEHYDKTRHEEFKKYEMMKEHERREYLKTLNEEKRKEEESKFEEMKKKHENHPKVNHPGSKDQLKEVWEETDGLDPNDFDPKTFFKLHDVNSDGFLDEQELEALFTKELEKVYDPKNEEDDMVEMEEERLRMREHVMNETLDQQQFFTEEELKEYENIIALQENELKKKADELQKQKEELQRQHDQLEAQKLEYHQVIQQMEQKKLQQGIPPSGPAGELKFEPHI

SEQ ID NO: 9669 - protein, 420 aa, Homo Sapiens
MRWRTILLQYCFLLITCLLTALEAVPIDIDKTKVQNIHPVESAKIEPPDTGLYYDEYLKQVIDVLETDKHFREKLQKADIEEIKSGRLSKELDLVSHHVRTKLDELKRQEVGRLRMLIKAKLDSLQDIGMDHQALLKQFDHLNHLNPDKFESTDLDMLIKAATSDLEHYDKTRHEEFKKYEMMKEHERREYLKTLNEEKRKEEESKFEEMKKKHENHPKVNHPGSKDQLKEVWEETDGLDPNDFDPKTFFKLHDVNSDGFLDEQELEALFTKELEKVYDPKNEEDDMVEMEEERLRMREHVMNEVDTNKDRLVTLEEFLKATEKKEFLEPDSWETLDQQQFFTEEELKEYENIIALQENELKKKADELQKQKEELQRQHDQLEAQKLEYHQVIQQMEQKKLQQGIPPSGPAGELKFEPHI

SEQ ID NO: 9670 - protein, 338 aa, Homo Sapiens
MRWRTILLQYCFLLITCLLTALEAVPIDIDKTKVQNIHPVESAKIEPPDTGLYYDEYLKQVIDVLETDKHFREKLQKADIEEIKSGRLSKELDLVSHHVRTKLDELKRQEVGRLRMLIKAKLDSLQDIGMDHQALLKQFDHLNHLNPDKFESTDLDMLIKAATSDLEHYDKTRHEEFKKYEMMKEHERREYLKTLNEEKRKEEESKFEEMKKKHENHPKVNHPGSKDQLKEVWEETDGLDPNDFDPKTFFKLHDVNSDGFLDEQELEALFTKELEKVYDPKNEEDDMVEMEEERLRMREHVMNEVDTNKDRLVTLEEFLKATEKKEFLEPDSWESPSI

SEQ ID NO: 9671 - protein, 420 aa, Homo Sapiens; identical to SEQ ID NO: 9669

SEQ ID NO: 9672 - protein, 231 aa, Homo Sapiens
MRWRTILLQYCFLLITCLLTALEAVPIDIDKTKVQNIHPVESAKIEPPDTGLYYDEYLKQVIDVLETDKHFREKLQKADIEEIKSGRLSKELDLVSHHVRTKLDELKRQEVGRLRMLIKAKLDSLQDIGMDHQALLKQFDHLNHLNPDKFESTDLDMLIKAATSDLEHYDKTRHEEFKKYEMMKEHERREYLKTLNEEKRKEEESKFEEMKKKHENHPKVNHPVHREAKIN

SEQ ID NO: 9673 - protein, 73 aa, Homo Sapiens
  misc_feature (1)..(1): Xaa can be any naturally occurring amino acid
XEERLRMREHVMNEVDTNKDRLVTLEEFLKATEKKEFLEPDSWEVIQQMEQKKLQQGIPPSGPAGELKFEPHI

SEQ ID NO: 9674 - protein, 198 aa, Homo Sapiens
  misc_feature (1)..(1): Xaa can be any naturally occurring amino acid
XTLNEEKRKEEESKFEEMKKKHENHPKVNHPGSKDQLKEVWEETDGLDPNDFDPKTFFKLHDVNSDGFLDEQELEALFTKELEKVYDPKNEEDDMVEMEEERLRMREHVMNETLDQQQFFTEEELKEYENIIALQENELKKKADELQKQKEELQRQHDQLEAQKLEYHQVIQQMEQKKLQQGIPPSGPAGELKFEPHI

SEQ ID NO: 9675 - protein, 375 aa, Homo Sapiens
MSSSLRPGPSRWRRAASIVLAAGWSRPETATPPSRPPPAEGFRLLLLQRSPHQGFMPGAHVFSGGVLDAADRSADWLGLFAPHHGPPRFGLGPAPFSRTAFPSLPDTDDHKTDNTGTLPEDVAFRICAVREAFEEAGVLLLRPRTSPPGPAPGPGLALEPPPGLASWRDRVRQDPRHFLRLCAHLDCTPDIWALHNWSAWLTPFLRGTTRRFDTAFFLCCLREPPPVYPDLAEVVGYQWSSPSEATESFLSKEIWLPPPQFYEVRRLANFASLSDLHKFCLGRALEGLERWLPIILLTADGMVHLLPGDELYLEDSDFLENLMSTEKKTEEIMKEGKQFHRIVTYHRHLYDIHVTVQPKYKHVYPKNSVVRKSHL

SEQ ID NO: 9676 - protein, 77 aa, Homo Sapiens
MAGRLLGKALAAVSLSLALASVTIRSSRCRGIQAFRNPAGRTGLVGRGLLGRWGPNHAADPIITRGWWIQERRLVPH

SEQ ID NO: 9677 - protein, 284 aa, Homo Sapiens
MAGRLLGKALAAVSLSLALASVTIRSSRCRGIQAFRNSFSSSWFHLNTNVMSGSNGSKENSHNKARTSPYPGSKVERSQVPNEKVGWLVEWQDYKPVEYTAVSVLAGPRWADPQIRNPAGRTGLVGRGLLGRWGPNHAADPIITRWKRDSSGNKIMHPVSGKHILQFVAIKRKDCGEWAIPGGMVDPGEKISATLKREFGEEALNSLQKTSAEKREIEEKLHKLFSQDHLVIYKGYVDDPRNTDNAWMETEAVNYHDETGEIMDNLMLEAGDDAGKVKWVDIND

SEQ ID NO: 9678 - protein, 350 aa, Homo Sapiens
MAGRLLGKALAAVSLSLALASVTIRSSRCRGIQAFRNSFSSSWFHLNTNVMSGSNGSKENSHNKARTSPYPGSKVERSQVPNEKVGWLVEWQDYKPVEYTAVSVLAGPRWADPQISESNFSPKFNEKDGHVERKSKNGLYEIENGRPRNPAGRTGLVGRGLLGRWGPNHAADPIITRWKRDSSGNKIMHPVSGKHILQFVAIKRKDCGEWAIPGGMVDPGEKISATLKREFGEEALNSLQKTSAEKREIEEKLHKLFSQDHLVIYKGYVDDPRNTDNAWMETEAVNYHDETGEIMDNLMLEAGDDAGKVKWVDINDKLKLYASHSQFIKLVAEKRDAHWSEDSEADCHAL

SEQ ID NO: 9679 - protein, 206 aa, Homo Sapiens
MSGSNGSKENSHNKARTSPYPGSKVERSQVPNEKVGWLVEWQDYKPVEYTAVSVLAGPRWADPQISESNFSPKFNEKDGHVERKSKNGLYEIENGRPRNPAGRTGLVGRGLLGRWGPNHAADPIITRWKRDSSGNKIMHPVSGKHILQFVAIKRKDCGEWAIPGGMVDPGEKISATLKREFGEEALNSLQKTSAEKREIEEKLHKL

SEQ ID NO: 9680 - protein, 300 aa, Homo Sapiens
MSGSNGSKENSHNKARTSPYPGSKVERSQVPNEKVGWLVEWQDYKPVEYTAVSVLAGPRWADPQISESNFSPKFNEKDGHVERKSKNGLYEIENGRPRNPAGRTGLVGRGLLGRWGPNHAADPIITRWKRDSSGNKIMHPVSGKHILQFVAIKRKDCGEWAIPGGMVDPGEKISATLKREFGEEALNSLQKTSAEKREIEEKLHKLFSQDHLVIYKGYVDDPRNTDNAWMETEAVNYHDETGEIMDNLMLEAGDDAGKVKWVDINDKLKLYASHSQFIKLVAEKRDAHWSEDSEADCHAL

SEQ ID NO: 9681 - protein, 1391 aa, Homo Sapiens
MPSSLLGAAMPASTSAAALQEALENAGRLIDRQLQEDRMYPDLSELLMVSAPNNPTVSGMSDMDYPLQGPGLLSVPNLPEISSIRRVPLPPELVEQFGHMQCNCMMGVFPPISRAWLTIDSDIFMWNYEDGGDLAYFDGLSETILAVGLVKPKAGIFQPHVRHLLVLATPVDIVILGLSYANLQTGSGVLNDSLSGGMQLLPDPLYSLPTDNTYLLTITSTDNGRIFLAGKDGCLYEVAYQAEAGWFSQRCRKINHSKSSLSFLVPSLLQFTFSEDDPILQIAIDNSRNILYTRSEKGVIQVYDLGQDGQGMSRVASVSQNAIVSAAGNIARTIDRSVFKPIVQIAVIENSESLDCQLLAVTHAGVRLYFSTCPFRQPLARPNTLTLVHVRLPPGFSASSTVEKPSKVHRALYSKGILLMAASENEDNDILWCVNHDTFPFQKPMMETQMTAGVDGHSWALSAIDELKVDKIITPLNKDHIPITDSPVVVQQHMLPPKKFVLLSAQGSLMFHKLRPVDQLRHLLVSNVGGDGEEIERFFKLHQEDQACATCLILACSTAACDREVSAWATRAFFRYGGEAQMRFPTTLPPPSNVGPILGSPVYSSSPVPSGSPYPNPSFLGTPSHGIQPPAMSTPVCALGNPATQATNMSCVTGPEIVYSGKHNGICIYFSRIMGNIWDASLVVERIFKSGNREITAIESSVPCQLLESVLQELKGLQEFLDRNSQFAGGPLGNPNTTAKVQQRLIGFMRPENGNPQQMQQELQRKFHEAQLSEKISLQAIQQLVRKSYQALALWKLLCEHQFTIIVAELQKELQEQLKITTFKDLVIRDKELTGALIASLINCYIRDNAAVDGISLHLQDICPLLYSTDDAICSKANELLQRSRQVQNKTEKERMLRESLKEYQKISNQVDLSNVCAQYRQVRFYEGVVELSLTAAEKKDPQGLGLHFYKHGEPEEDIVGLQAFQERLNSYKCITDTLQELVNQSKAAPQSPSVPKKPGPPVLSSDPNMLSNEEAGHHFEQMLKLSQRSKDELFSIALYNWLIQVDLADKLLQVASPFLEPHLVRMAKVDQNRVRYMDLLWRYYEKNRSFSNAARVLSRLADMHSTEISLQQRLEYIARAILSAKSSTAISSIAADGEFLHELEEKMEVARIQLQIQETLQRQYSHHSSVQDAVSQLDSELMDITKLYGEFADPFKLAECKLAIIHCAGYSDPILVQTLWQDIIEKELSDSVTLSSSDRMHALSLKIVLLGKIYAGTPRFFPLDFIVQFLEQQVCTLNWDVGFVIQTMNEIGVPLPRLLEVYDQLFKSRDPFWNRMKKPLHLLDCIHVLLIRYVENPSQVLNCERRRFTNLCLDAVCGYLVELQSMSSSVAVQAITGNFKSLQAKLERLH

SEQ ID NO: 9682 - protein, 1327 aa, Homo Sapiens
MPSSLLGAAMPASTSAAALQEALENAGRLIDRQLQEDRMYPDLSELLMVSAPNNPTVSGMSDMDYPLQGPGLLSVPNLPEISSIRRVPLPPELVEQFGHMQCNCMMGVFPPISRAWLTIDSDIFMWNYEDGGDLAYFDGLSETILAVGLVKPKAGIFQPHVRHLLVLATPVDIVILGLSYANLQTGSGVLNDSLSGGMQLLPDPLYSLPTDNTYLLTITSTDNGRIFLAGKDGCLYEVAYQAEAGWFSQRCRKINHSKSSLSFLVPSLLQFTFSEDDPILQIAIDNSRNILYTRSEKGVIQVYDLGQDGQGMSRVASVSQNAIVSAAGNIARTIDRSVFKPIVQIAVIENSESLDCQLLAVTHAGVRLYFSTCPFRQPLARPNTLTLVHVRLPPGFSASSTVEKPSKVHRALYSKGILLMAASENEDNDILWCVNHDTFPFQKPMMETQMTAGVDGHSWALSAIDELKVDKIITPLNKDHIPITDSPVVVQQHMLPPKKFVLLSAQGSLMFHKLRPVDQLRHLLVSNVGGDGEEIERFFKLHQEDQACATCLILACSTAACDREVSAWATRAFFRYGGEAQMRFPTTLPPPSNVGPILGSPVYSSSPVPSGSPYPNPSFLGTPSHGIQPPAMSTPVCALGNPATQATNMSCVTGPEIVYSGKHNGICIYFSRIMGNIWDASLVVERIFKSGNREITAIESSVPCQLLESVLQELKGLQEFLDRNSQFAGGPLGNPNTTAKVQQRLIGFMRPENGNPQQMQQELQRKFHEAQLSEKISLQAIQQLVRKSYQALALWKLLCEHQFTIIVAELQKANELLQRSRQVQNKTEKERMLRESLKEYQKISNQVDLSNVCAQYRQVRFYEGVVELSLTAAEKKDPQGLGLHFYKHGEPEEDIVGLQAFQERLNSYKCITDTLQELVNQSKAAPQSPSVPKKPGPPVLSSDPNMLSNEEAGHHFEQMLKLSQRSKDELFSIALYNWLIQVDLADKLLQVASPFLEPHLVRMAKVDQNRVRYMDLLWRYYEKNRSFSNAARVLSRLADMHSTEISLQQRLEYIARAILSAKSSTAISSIAADGEFLHELEEKMEVARIQLQIQETLQRQYSHHSSVQDAVSQLDSELMDITKLYGEFADPFKLAECKLAIIHCAGYSDPILVQTLWQDIIEKELSDSVTLSSSDRMHALSLKIVLLGKIYAGTPRFFPLDFIVQFLEQQVCTLNWDVGFVIQTMNEIGVPLPRLLEVYDQLFKSRDPFWNRMKKPLHLLDCIHVLLIRYVENPSQVLNCERRRFTNLCLDAVCGYLVELQSMSSSVAVQAITGNFKSLQAKLERLH

SEQ ID NO: 9683 - protein, 54 aa, Homo Sapiens
MPSSLLGAAMPASTSAAALQEALENAGRLIDRQLQEDRMYPDLSELLMVSAPSE

SEQ ID NO: 9684 - protein, 1332 aa, Homo Sapiens
MSDMDYPLQGPGLLSVPNLPEISSIRRVPLPPELVEQFGHMQCNCMMGVFPPISRAWLTIDSDIFMWNYEDGGDLAYFDGLSETILAVGLVKPKAGIFQPHVRHLLVLATPVDIVILGLSYANLQTGSGVLNDSLSGGMQLLPDPLYSLPTDNTYLLTITSTDNGRIFLAGKDGCLYEVAYQAEAGWFSQRCRKINHSKSSLSFLVPSLLQFTFSEDDPILQIAIDNSRNILYTRSEKGVIQVYDLGQDGQGMSRVASVSQNAIVSAAGNIARTIDRSVFKPIVQIAVIENSESLDCQLLAVTHAGVRLYFSTCPFRQPLARPNTLTLVHVRLPPGFSASSTVEKPSKVHRALYSKGILLMAASENEDNDILWCVNHDTFPFQKPMMETQMTAGVDGHSWALSAIDELKVDKIITPLNKDHIPITDSPVVVQQHMLPPKKFVLLSAQGSLMFHKLRPVDQLRHLLVSNVGGDGEEIERFFKLHQEDQACATCLILACSTAACDREVSAWATRAFFRYGGEAQMRFPTTLPPPSNVGPILGSPVYSSSPVPSGSPYPNPSFLGTPSHGIQPPAMSTPVCALGNPATQATNMSCVTGPEIVYSGKHNGICIYFSRIMGNIWDASLVVERIFKSGNREITAIESSVPCQLLESVLQELKGLQEFLDRNSQFAGGPLGNPNTTAKVQQRLIGFMRPENGNPQQMQQELQRKFHEAQLSEKISLQAIQQLVRKSYQALALWKLLCEHQFTIIVAELQKELQEQLKITTFKDLVIRDKELTGALIASLINCYIRDNAAVDGISLHLQDICPLLYSTDDAICSKANELLQRSRQVQNKTEKERMLRESLKEYQKISNQVDLSNVCAQYRQVRFYEGVVELSLTAAEKKDPQGLGLHFYKHGEPEEDIVGLQAFQERLNSYKCITDTLQELVNQSKAAPQSPSVPKKPGPPVLSSDPNMLSNEEAGHHFEQMLKLSQRSKDELFSIALYNWLIQVDLADKLLQVASPFLEPHLVRMAKVDQNRVRYMDLLWRYYEKNRSFSNAARVLSRLADMHSTEISLQQRLEYIARAILSAKSSTAISSIAADGEFLHELEEKMEVARIQLQIQETLQRQYSHHSSVQDAVSQLDSELMDITKLYGEFADPFKLAECKLAIIHCAGYSDPILVQTLWQDIIEKELSDSVTLSSSDRMHALSLKIVLLGKIYAGTPRFFPLDFIVQFLEQQVCTLNWDVGFVIQTMNEIGVPLPRLLEVYDQLFKSRDPFWNRMKKPLHLLDCIHVLLIRYVENPSQVLNCERRRFTNLCLDAVCGYLVELQSMSSSVAVQAITGNFKSLQAKLERLH

SEQ ID NO: 9685 - protein, 140 aa, Homo Sapiens
CKDDEAVVQAPRHAPVVRTPSIQPSLLPHAAPFAKSHLVHGSSPGVMGTSVATSASKIIPQGADSTMLATKTVKHGAPSPSHPISAPQAAAAAALRRQMASQAPAVNTLTESTLKNVPQVVNVQELKNNPATPSTAMGGL

SEQ ID NO: 9686 - protein, 78 aa, Homo Sapiens
GEGTAAASAGGFGFGSSSNTTSFGTLASQNAPTFGSLSQQTSGFGTQSSGFSGFGSGTGGFSFGSNNSSVQGFGGWRS

SEQ ID NO: 9687 - protein, 113 aa, Homo Sapiens
LQCLAALLLLGDPLGLEGCQHSVQPQPLQALWARREAKCSERALQLPAQEDSGLGAAATPHPSARSRVRMPPLSDHCPNRLLVLGPRVADSLVLDQAQEGSALGQITRKYPPF

SEQ ID NO: 9688 - protein, 2090 aa, Homo Sapiens
MGDEMDAMIPEREMKDFQFRALKKVRIFDSPEELPKERSSLLAVSNKYGLVFAGGASGLQIFPTKNLLIQNKPGDDPNKIVDKVQGLLVPMKFPIHHLALSCDNLTLSACMMSSEYGSIIAFFDVRTFSNEAKQQKRPFAYHKLLKDAGGMVIDMKWNPTVPSMVAVCLADGSIAVLQVTETVKVCATLPSTVAVTSVCWSPKGKQLAVGKQNGTVVQYLPTLQEKKVIPCPPFYESDHPVRVLDVLWIGTYVFAIVYAAADGTLETSPDVVMALLPKKEEKHPEIFVNFMEPCYGSCTERQHHYYLSYIEEWDLVLAASAASTEVSILARQSDQINWESWLLEDSSRAELPVTDKSDDSLPMGVVVDYTNQVEITISDEKTLPPAPVLMLLSTDGVLCPFYMINQNPGVKSLIKTPERLSLEGERQPKSPGSTPTTPTSSQAPQKLDASAAAAPASLPPSSPAAPIATFSLLPAGGAPTVFSFGSSSLKSSATVTGEPPSYSSGSDSSKAAPGPGPSTFSFVPPSKASLAPTPAASPVAPSAASFSFGSSGFKPTLESTPVPSVSAPNIAMKPSFPPSTSAVKVNLSEKFTAAATSTPVSSSQSAPPMSPFSSASKPAASGPLSHPTPLSAPPSSVPLKSSVLPSPSGRSAQGSSSPVPSMVQKSPRITPPAAKPGSPQAKSLQPAVAEKQGHQWKDSDPVMAGIGEEIAHFQKELEELKARTSKACFQVGTSEEMKMLRTESDDLHTFLLEIKETTESLHGDISSLKTTLLEGFAGVEEAREQNERNRDSGYLHLLYKRPLDPKSEAQLQEIRRLHQYVKFAVQDVNDVLDLEWDQHLEQKKKQRHLLVPERETLFNTLANNREIINQQRKRLNHLVDSLQQLRLYKQTSLWSLSSAVPSQSSIHSFDSDLESLCNALLKTTIESHTKSLPKVPAKLSPMKQAQLRNFLAKRKTPPVRSTAPASLSRSAFLSQRYYEDLDEVSSTSSVSQSLESEDARTSCKDDEAVVQAPRHAPVVRTPSIQPSLLPHAAPFAKSHLVHGSSPGVMGTSVATSASKIIPQGADSTMLATKTVKHGAPSPSHPISAPQAAAAAALRRQMASQAPAVNTLTESTLKNVPQVVNVQELKNNPATPSTAMGSSVPYSTAKTPHPVLTPVAANQAKQGSLINSLKPSGPTPASGQLSSGDKASGTAKIETAVTSTPSASGQFSKPFSFSPSGTGFNFGIITPTPSSNFTAAQGATPSTKESSQPDAFSSGGGSKPSYEAIPESSPPSGITSASNTTPGEPAASSSRPVAPSGTALSTTSSKLETPPSKLGELLFPSSLAGETLGSFSGLRVGQADDSTKPTNKASSTSLTSTQPTKTSGVPSGFNFTAPPVLGKHTEPPVTSSATTTSVAPPAATSTSSTAVFGSLPVTSAGSSGVISFGGTSLSAGKTSFSFGSQQTNSTVPPSAPPPTTAATPLPTSFPTLSFGSLLSSATTPSLPMSAGRSTEEATSSALPEKPGDSEVSASAASLLEEQQSAQLPQAPPQTSDSVKKEPVLAQPAVSNSGTAASSTSLVALSAEATPATTGVPDARTEAVPPASSFSVPGQTAVTAAAISSAGPVAVETSSTPIASSTTSIVAPGPSAEAAAFGTVTSGSSVFAQPPAASSSSAFNQLTNNTATAPSATPVFGQVAASTAPSLFGQQTGSTASTAAATPQVSSSGFSSPAFGTTAPGVFGQTTFGQASVFGQSASSAASVFSFSQPGFSSVPAFGQPASSTPTSTSGSVFGAASSTSSSSSFSFGQSSPNTGGGLFGQSNAPAFGQSPGFGQGGSVFGGTSAATTTAATSGFSFCQASGFGSSNTGSVFGQAASTGGIVFGQQSSSSSGSVFGSGNTGRGGGFFSGLGGKPSQDAANKNPFSSASGGFGSTATSNTSNLFGNSGAKTFGGFASSSFGEQKPTGTFSSGGGSVASQGFGFSSPNKTGGFGAAPVFGSPPTFGGSPGFGGVPAFGSAPAFTSPLGSTGGKVFGEGTAAASAGGFGFGSSSNTTSFGTLASQNAPTFGSLSQQTSGFGTQSSGFSGFGSGTGGFSFGSNNSSVQGFGGWRS

SEQ ID NO: 9689 - protein, 2080 aa, Homo Sapiens
MGDEMDAMIPEREMKDFQFRALKKVRIFDSPEELPKERSSLLAVSNKYGLVFAGGASGLQIFPTKNLLIQNKPGDDPNKIVDKVQGLLVPMKFPIHHLALSCDNLTLSACMMSSEYGSIIAFFDVRTFSNEAKQQKRPFAYHKLLKDAGGMVIDMKWNPTVPSMVAVCLADGSIAVLQVTETVKVCATLPSTVAVTSVCWSPKGKQLAVGKQNGTVVQYLPTLQEKKVIPCPPFYESDHPVRVLDVLWIGTYVFAIVYAAADGTLETSPDVVMALLPKKEEKHPEIFVNFMEPCYGSCTERQHHYYLSYIEEWDLVLAASAASTEVSILARQSDQINWESWLLEDSSRAELPVTDKSDDSLPMGVVVDYTNQVEITISDEKTLPPAPVLMLLSTDGVLCPFYMINQNPGVKSLIKTPERLSLEGERQPKSPGSTPTTPTSSQAPQKLDASAAAAPASLPPSSPAAPIATFSLLPAGGAPTVFSFGSSSLKSSATVTGEPPSYSSGSDSSKAAPGPGPSTFSFVPPSKASLAPTPAASPVAPSAASFSFGSSGFKPTLESTPVPSVSAPNIAMKPSFPPSTSAVKVNLSENSSQSAPPMSPFSSASKPAASGPLSHPTPLSAPPSSVPLKSSVLPSPSAGRSAQGSSSPVPSMVQKSPRITPPAAKPGSPQAKSLQPAVAEKQGHQWKDSDPVMAGIGEEIAHFQKELEELKARTSKACFQVGTSEEMKMLRTESDDLHTFLLEIKETTESLHGDISSLKTTLLEGFAGVEEAREQNERNRDSGYLHLLYKRPLDPKSEAQLQEIRRLHQYVKFAVQDVNDVLDLEWDQHLEQKKKQRHLLVPERETLFNTLANNREIINQQRKRLNHLVDSLQQLRLYKQTSLWSLSSAVPSQSSIHSFDSDLESLCNALLKTTIESHTKSLPKVPAKLSPMKQAQLRNFLAKRKTPPVRSTAPASLSRSAFLSQRYYEDLDEVSSTSSVSQSLESEDARTSCKDDEAVVQAPRHAPVVRTPSIQPSLLPHAAPFAKSHLVHGSSPGVMGTSVATSASKIIPQGADSTMLATKTVKHGAPSPSHPISAPQAAAAAALRRQMASQAPAVNTLTESTLKNVPQVVNVQELKNNPATPSTAMGSSVPYSTAKTPHPVLTPVAANQAKQGSLINSLKPSGPTPASGQLSSGDKASGTAKIETAVTSTPSASGQFSKPFSFSPSGTGFNFGIITPTPSSNFTAAQGATPSTKESSQPDAFSSGGGSKPSYEAIPESSPPSGITSASNTTPGEPAASSSRPVAPSGTALSTTSSKLETPPSKLGELLFPSSLAGETLGSFSGLRVGQADDSTKPTNKASSTSLTSTQPTKTSGVPSGFNFTAPPVLGKHTEPPVTSSATTTSVAPPAATSTSSTAVFGSLPVTSAGSSGVISFGGTSLSAGKTSFSFGSQQTNSTVPPSAPPPTTAATPLPTSFPTLSFGSLLSSATTPSLPMSAGRSTEEATSSALPEKPGDSEVSASAASLLEEQQSAQLPQAPPQTSDSVKKEPVLAQPAVSNSGTAASSTSLVALSAEATPATTGVPDARTEAVPPASSFSVPGQTAVTAAAISSAGPVAVETSSTPIASSTTSIVAPGPSAEAAAFGTVTSGSSVFAQPPAASSSSAFNQLTNNTATAPSATPVFGQVAASTAPSLFGQQTGSTASTAAATPQVSSSGFSSPAFGTTAPGVFGQTTFGQASVFGQSASSAASVFSFSQPGFSSVPAFGQPASSTPTSTSGSVFGAASSTSSSSSFSFGQSSPNTGGGLFGQSNAPAFGQSPGFGQGGSVFGGTSAATTTAATSGFSFCQASGFGSSNTGSVFGQAASTGGIVFGQQSSSSSGSVFGSGNTGRGGGFFSGLGGKPSQDAANKNPFSSASGGFGSTATSNTSNLFGNSGAKTFGGFASSSFGEQKPTGTFSSGGGSVASQGFGFSSPNKTGGFGAAPVFGSPPTFGGSPGFGGVPAFGSAPAFTSPLGSTGGKVFGEGTAAASAGGFGFGSSSNTTSFGTLASQNAPTFGSLSQQTSGFGTQSSGFSGFGSGTGGFSFGSNNSSVQGFGGWRS

SEQ ID NO: 9690 - protein, 52 aa, Homo Sapiens
MKFPIHHLALSCDNLTLSACMMSSEYGSIIAFFDVRTFSNEAKQQKRPFAYH

SEQ ID NO: 9691 - protein, 1519 aa, Homo Sapiens
MKPSFPPSTSAVKVNLSEKFTAAATSTPVSSSQSAPPMSPFSSASKPAASGPLSHPTPLSAPPSSVPLKSSVLPSPSGRSAQGSSSPVPSMVQKSPRITPPAAKPGSPQAKSLQPAVAEKQGHQWKDSDPVMAGIGEEIAHFQKELEELKARTSKACFQVGTSEEMKMLRTESDDLHTFLLEIKETTESLHGDISSLKTTLLEGFAGVEEAREQNERNRDSGYLHLLYKRPLDPKSEAQLQEIRRLHQYVKFAVQDVNDVLDLEWDQHLEQKKKQRHLLVPERETLFNTLANNREIINQQRKRLNHLVDSLQQLRLYKQTSLWSLSSAVPSQSSIHSFDSDLESLCNALLKTTIESHTKSLPKVPAKLSPMKQAQLRNFLAKRKTPPVRSTAPASLSRSAFLSQRYYEDLDEVSSTSSVSQSLESEDARTSCKDDEAVVQAPRHAPVVRTPSIQPSLLPHAAPFAKSHLVHGSSPGVMGTSVATSASKIIPQGADSTMLATKTVKHGAPSPSHPISAPQAAAAAALRRQMASQAPAVNTLTESTLKNVPQVVNVQELKNNPATPSTAMGSSVPYSTAKTPHPVLTPVAANQAKQGSLINSLKPSGPTPASGQLSSGDKASGTAKIETAVTSTPSASGQFSKPFSFSPSGTGFNFGIITPTPSSNFTAAQGATPSTKESSQPDAFSSGGGSKPSYEAIPESSPPSGITSASNTTPGEPAASSSRPVAPSGTALSTTSSKLETPPSKLGELLFPSSLAGETLGSFSGLRVGQADDSTKPTNKASSTSLTSTQPTKTSGVPSGFNFTAPPVLGKHTEPPVTSSATTTSVAPPAATSTSSTAVFGSLPVTSAGSSGVISFGGTSLSAGKTSFSFGSQQTNSTVPPSAPPPTTAATPLPTSFPTLSFGSLLSSATTPSLPMSAGRSTEEATSSALPEKPGDSEVSASAASLLEEQQSAQLPQAPPQTSDSVKKEPVLAQPAVSNSGTAASSTSLVALSAEATPATTGVPDARTEAVPPASSFSVPGQTAVTAAAISSAGPVAVETSSTPIASSTTSIVAPGPSAEAAAFGTVTSGSSVFAQPPAASSSSAFNQLTNNTATAPSATPVFGQVAASTAPSLFGQQTGSTASTAAATPQVSSSGFSSPAFGTTAPGVFGQTTFGQASVFGQSASSAASVFSFSQPGFSSVPAFGQPASSTPTSTSGSVFGAASSTSSSSSFSFGQSSPNTGGGLFGQSNAPAFGQSPGFGQGGSVFGGTSAATTTAATSGFSFCQASGFGSSNTGSVFGQAASTGGIVFGQQSSSSSGSVFGSGNTGRGGGFFSGLGGKPSQDAANKNPFSSASGGFGSTATSNTSNLFGNSGAKTFGGFASSSFGEQKPTGTFSSGGGSVASQGFGFSSPNKTGGFGAAPVFGSPPTFGGSPGFGGVPAFGSAPAFTSPLGSTGGKVFGEGTAAASAGGFGFGSSSNTTSFGTLASQNAPTFGSLSQQTSGFGTQSSGFSGFGSGTGGFSFGSNNSSVQGFGGWRS

SEQ ID NO: 9692 - protein, 495 aa, Homo Sapiens
MKSSLLLRGVHFCFHLPGATPSTKESSQPDAFSSGGGSKPSYEAIPESSPPSGITSASNTTPGEPAASSSRPVAPSGTALSTTSSKLETPPSKLGELLFPSSLAGETLGSFSGLRVGQADDSTKPTNKASSTSLTSTQPTKTSGVPSGFNFTAPPVLGKHTEPPVTSSATTTSVAPPAATSTSSTAVFGSLPVTSAGSSGVISFGGTSLSAGKTSFSFGSQQTNSTVPPSAPPPTTAATPLPTSFPTLSFGSLLSSATTPSLPMSAGRSTEEATSSALPEKPGDSEVSASAASLLEEQQSAQLPQAPPQTSDSVKKEPVLAQPAVSNSGTAASSTSLVALSAEATPATTGVPDARTEAVPPASSFSVPGQTAVTAAAISSAGPVAVETSSTPIASSTTSIVAPGPSAEAAAFGTVTSGSSVFAQPPAASSSSAFNQLTNNTATAPSATPVFGQVAASTAPSLFGQQTGSTASTAAATPQVSSSGFSSPAFGTTAP

SEQ ID NO: 9693 - protein, 916 aa, Homo Sapiens
MKSSLLLRGVHFCFHLPGTAKIETAVTSTPSASGQFSKPFSFSPSGTGFNFGIITPTPSSNFTAAQGATPSTKESSQPDAFSSGGGSKPSYEAIPESSPPSGITSASNTTPGEPAASSSRPVAPSGTALSTTSSKLETPPSKLGELLFPSSLAGETLGSFSGLRVGQADDSTKPTNKASSTSLTSTQPTKTSGVPSGFNFTAPPVLGKHTEPPVTSSATTTSVAPPAATSTSSTAVFGSLPVTSAGSSGVISFGGTSLSAGKTSFSFGSQQTNSTVPPSAPPPTTAATPLPTSFPTLSFGSLLSSATTPSLPMSAGRSTEEATSSALPEKPGDSEVSASAASLLEEQQSAQLPQAPPQTSDSVKKEPVLAQPAVSNSGTAASSTSLVALSAEATPATTGVPDARTEAVPPASSFSVPGQTAVTAAAISSAGPVAVETSSTPIASSTTSIVAPGPSAEAAAFGTVTSGSSVFAQPPAASSSSAFNQLTNNTATAPSATPVFGQVAASTAPSLFGQQTGSTASTAAATPQVSSSGFSSPAFGTTAPGVFGQTTFGQASVFGQSASSAASVFSFSQPGFSSVPAFGQPASSTPTSTSGSVFGAASSTSSSSSFSFGQSSPNTGGGLFGQSNAPAFGQSPGFGQGGSVFGGTSAATTTAATSGFSFCQASGFGSSNTGSVFGQAASTGGIVFGQQSSSSSGSVFGSGNTGRGGGFFSGLGGKPSQDAANKNPFSSASGGFGSTATSNTSNLFGNSGAKTFGGFASSSFGEQKPTGTFSSGGGSVASQGFGFSSPNKTGGFGAAPVFGSPPTFGGSPGFGGVPAFGSAPAFTSPLGSTGGKVFGEGTAAASAGGFGFGSSSNTTSFGTLASQNAPTFGSLSQQTSGFGTQSSGFSGFGSGTGGFSFGSNNSSVQGFGGWRS

SEQ ID NO: 9694 - protein, 187 aa, Homo Sapiens
  misc_feature (1)..(1): Xaa can be any naturally occurring amino acid
XARQSDQINWESWLLEDSSRAELPVTDKSDDSLPMGVVVDYTNQVEITISDEKTLPPAPVLMLLSTDGVLCPFYMINQNPGVKSLIKTPERLSLEGERQPKSPASLAPTPAASPVAPSAASFSFGSSGFKPTLESTPVPSVSAPNIAMKPSFPPSTSAVKVNLSEKFTAAATSTPVSSSQSAPPMSP

SEQ ID NO: 9695 - protein, 145 aa, Homo Sapiens
  misc_feature (1)..(1): Xaa can be any naturally occurring amino acid
XGVPAFGSAPAFTSPLGSTGGKVFGEGTAAASAGGFGFGSSSNTTSFGTLASQNAPTFGSLSQQTSGFGTQSSGFSGFGSGTGGLSRVLVAGEAEGVSAGLSIPGTNRILSFFPEKCWSRLFRPTLPSKHIHPERNNRNQNSQGA

SEQ ID NO: 9696 - protein, 967 aa, Homo Sapiens
  misc_feature (1)..(1): Xaa can be any naturally occurring amino acid
XKTPHPVLTPVAANQAKQGSLINSLKPSGPTPASGQLSSGDKASGTAKIETAVTSTPSASGQFSKPFSFSPSGTGFNFGIITPTPSSNFTAAQGATPSTKESSQPDAFSSGGGSKPSYEAIPESSPPSGITSASNTTPGEPAASSSRPVAPSGTALSTTSSKLETPPSKLGELLFPSSLAGETLGSFSGLRVGQADDSTKPTNKASSTSLTSTQPTKTSGVPSGFNFTAPPVLGKHTEPPVTSSATTTSVAPPAATSTSSTAVFGSLPVTSAGSSGVISFGGTSLSAGKTSFSFGSQQTNSTVPPSAPPPTTAATPLPTSFPTLSFGSLLSSATTPSLPMSAGRSTEEATSSALPEKPGDSEVSASAASLLEEQQSAQLPQAPPQTSDSVKKEPVLAQPAVSNSGTAASSTSLVALSAEATPATTGVPDARTEAVPPASSFSVPGQTAVTAAAISSAGPVAVETSSTPIASSTTSIVAPGPSAEAAAFGTVTSGSSVFAQPPAASSSSAFNQLTNNTATAPSATPVFGQVAASTAPSLFGQQTGSTASTAAATPQVSSSGFSSPAFGTTAPGVFGQTTFGQASVFGQSASSAASVFSFSQPGFSSVPAFGQPASSTPTSTSGSVFGAASSTSSSSSFSFGQSSPNTGGGLFGQSNAPAFGQSPGFGQGGSVFGGTSAATTTAATSGFSFCQASGFGSSNTGSVFGQAASTGGIVFGQQSSSSSGSVFGSGNTGRGGGFFSGLGGKPSQDAANKNPFSSASGGFGSTATSNTSNLFGNSGAKTFGGFASSSFGEQKPTGTFSSGGGSVASQGFGFSSPNKTGGFGAAPVFGSPPTFGGSPGFGGVPAFGSAPAFTSPLGSTGGKVFGEGTAAASAGGFGSLAMSLSPTLKGRLLLMRPKAGGGREQAAPGRKSNESRSLGHLCMERALTSPLKVWEQQQHHILRHARESECPHFRITVPTDFWFWDPE

SEQ ID NO: 9697 - protein, 114 aa, Homo Sapiens
AMMLSDRLTFLGKYREFHRMYGEKRFADAASLLLSLMTSRIAPRSFWMTLLTDALPLLEQKQVIFSAEQTYELMRCLEDLTSRRPVHGESDTEQLQYGPLVLLSFTSIICWKLL

SEQ ID NO: 9698 - protein, 191 aa, Homo Sapiens
LDWVRLHVCEVDSLSADVLGSENPSKHDSFWNLGRLDEARQMLSKEADASPASAGICRIMGDLMRTMPILSPGNTQTLTELELKWQHWHEECERYLQDSTFATSPHLESLLKIMLGDEAALLEQKELLSNWYHFLVTRLLYSNPTVKPIDLHYYAQSSLDLFLGGESSPEPLDNILLAAFEFDIHQVIKEC

SEQ ID NO: 9699 - protein, 19 aa, Homo Sapiens
LLAAFEFDIHQVIKECSFL

SEQ ID NO: 9700 - protein, 18 aa, Homo Sapiens
LTDALPLLEQKQQNRLMS

SEQ ID NO: 9701 - protein, 611 aa, Homo Sapiens
MEELDGEPTVTLIPGVNSKKNQMYFDWGPGEMLVCETSFNKKEKSEMVPSCPFIYIIRKDVDVYSQILRKLFNESHGIFLGLQRIDEELTGKSRKSQLVRVSKNYRSVIRACMEEMHQVAIAAKDPANGRQFSSQVSILSAMELIWNLCEILFIEVAPAGPLLLHLLDWVRLHVCEVDSLSADVLGSENPSKHDSFWNLPGNTQTLTELELKWQHWHEECERYLQDSTFATSPHLESLLKIMLGDEAALLEQKELLSNWYHFLVTRLLYSNPTVKPIDLHYYAQSSLDLFLGGESSPEPLDNILLAAFEFDIHQVIKECSIALSNWWFVAHLTDLLDHCKLLQSHNLYFGSNMREFLLLEYASGLFAHPSLWQLGVDYFDYCPELGRVSLELHIERIPLNTEQKALKVLRICEQRQMTEQVRSICKILAMKAVRNNRLGSALSWSIRAKDAAFATLVSDRFLRDYCERGCFSDLDLIDNLGPAMMLSDRLTFLGKYREFHRMYGEKRFADAASLLLSLMTSRIAPRSFWMTLLTDALPLLEQKQVIFSAEQTYELMRCLEDLTSRRPVHGESDTEQLQDDDIETTKVEMLRLSLARNLARAIIREGSLEGS

SEQ ID NO: 9702 - protein, 656 aa, Homo Sapiens
MEELDGEPTVTLIPGVNSKKNQMYFDWGPGEMLVCETSFNKKEKSEMVPSCPFIYIIRKDVDVYSQILRKLFNESHGIFLGLQRIDEELTGKSRKSQLVRVSKNYRSVIRACMEEMHQVAIAAKDPANGRQFSSQVSILSAMELIWNLCEILFIEVAPAGPLLLHLLDWVRLHVCEVDSLSADVLGSENPSKHDSFWNLVTILVLQGRLDEARQMLSKEADASPASAGICRIMGDLMRTMPILSPGNTQTLTELELKWQHWHEECERYLQDSTFATSPHLESLLKIMLGDEAALLEQKELLSNWYHFLVTRLLYSNPTVKPIDLHYYAQSSLDLFLGGESSPEPLDNILLAAFEFDIHQVIKECSIALSNWWFVAHLTDLLDHCKLLQSHNLYFGSNMREFLLLEYASGLFAHPSLWQLGVDYFDYCPELGRVSLELHIERIPLNTEQKALKVLRICEQRQMTEQVRSICKILAMKAVRNNRLGSALSWSIRAKDAAFATLVSDRFLRDYCERGCFSDLDLIDNLGPAMMLSDRLTFLGKYREFHRMYGEKRFADAASLLLSLMTSRIAPRSFWMTLLTDALPLLEQKQVIFSAEQTYELMRCLEDLTSRRPVHGESDTEQLQDDDIETTKVEMLRLSLARNLARAIIREGSLEGS

SEQ ID NO: 9703 - protein, 169 aa, Homo Sapiens
MEELDGEPTVTLIPGVNSKKNQMYFDWGPGEMLVCETSFNKKEKSEMVPSCPFIYIIRKDVDVYSQILRKLFNESHGIFLGLQRIDEELTGKSRKSQLVRVSKNYRSVIRACMEEMHQVAIAAKDPANGRQFSSQVSILSAMELIWNLCEILFIEVAPGDHLGAAGPAG

SEQ ID NO: 9704 - protein, 544 aa, Homo Sapiens
MEEMHQVAIAAKDPANGRQFSSQVSILSAMELIWNLCEILFIEVAPAGPLLLHLLDWVRLHVCEVDSLSADVLGSENPSKHDSFWNLVTILVLQGRLDEARQMLSKEADASPASAGICRIMGDLMRTMPILSPGNTQTLTELELKWQHWHEECERYLQDSTFATSPHLESLLKIMLGDEAALLEQKELLSNWYHFLVTRLLYSNPTVKPIDLHYYAQSSLDLFLGGESSPEPLDNILLAAFEFDIHQVIKECSIALSNWWFVAHLTDLLDHCKLLQSHNLYFGSNMREFLLLEYASGLFAHPSLWQLGVDYFDYCPELGRVSLELHIERIPLNTEQKALKVLRICEQRQMTEQVRSICKILAMKAVRNNRLGSALSWSIRAKDAAFATLVSDRFLRDYCERGCFSDLDLIDNLGPAMMLSDRLTFLGKYREFHRMYGEKRFADAASLLLSLMTSRIAPRSFWMTLLTDALPLLEQKQVIFSAEQTYELMRCLEDLTSRRPVHGESDTEQLQDDDIETTKVEMLRLSLARNLARAIIREGSLEGS

SEQ ID NO: 9705 - protein, 259 aa, Homo Sapiens
MREFLLLEYASGLFAHPSLWQLGVDYFDYCPELGRVSLELHIERIPLNTEQKALKVLRICEQRQMTEQVRSICKILAMKAVRNNRLGSALSWSIRAKDAAFATLVSDRFLRDYCERGCFSDLDLIDNLGPAMMLSDRLTFLGKYREFHRMYGEKRFADAASLLLSLMTSRIAPRSFWMTLLTDALPLLEQKQVIFSAEQTYELMRCLEDLTSRRPVHGESDTEQLQDDDIETTKVEMLRLSLARNLARAIIREGSLEGS

SEQ ID NO: 9706 - protein, 120 aa, Homo Sapiens
MYFDWGPGEMLVCETSFNKKEKSEMVPSCPFIYIIRKDVDVYSQILRKLFNESHGIFLGLQRIDEELTGKSRKSQLVRVSKNYRSVIRACMEEMHQVAIAAKDPANGRQFSSQVSILSAM

SEQ ID NO: 9707 - protein, 272 aa, Homo Sapiens
VTILVLQGRLDEARQMLSKEADASPASAGICRIMGDLMRTMPILSPGNTQTLTELELKWQHWHEECERYLQDSTFATSPHLESLLKIMLGDEAALLEQKELLSNWYHFLVTRLLYSNPTVKPIDLHYYAQSSLDLFLGGESSPEPLDNILLAAFEFDIHQVIKECSFGSNMREFLLLEYASGLFAHPSLWQLGVDYFDYCPELGRVSLELHIERIPLNTEQKALKVLRICEQRQMTEQVRSICKILAMKAVRNNRLGSALSWSIRAKDAAFA

SEQ ID NO: 9708 - protein, 46 aa, Homo Sapiens
  misc_feature (1)..(1): Xaa can be any naturally occurring amino acid
XEKRFADAASLLLSLMTSRIAPRSFWMTLLTDALPLLEQKQNRLMS

SEQ ID NO: 9709 - protein, 302 aa, Homo Sapiens
  misc_feature (1)..(1): Xaa can be any naturally occurring amino acid
XHEECERYLQDSTFATSPHLESLLKSSLDLFLGGESSPEPLDNILLAAFEFDIHQVIKECSIALSNWWFVAHLTDLLDHCKLLQSHNLYFGSNMREFLLLEYASGLFAHPSLWQLGVDYFDYCPELGRVSLELHIERIPLNTEQKALKVLRICEQRQMTEQVRSICKILAMKAVRNNRLGSALSWSIRAKDAAFATLVSDRFLRDYCERGCFSDLDLIDNLGPAMMLSDRLTFLGKYREFHRMYGEKRFADAASLLLSLMTSRIAPRSFWMTLLTDALPLLEQKQVIFSAEQTYELMRCLED

SEQ ID NO: 9710 - protein, 100 aa, Homo Sapiens
  misc_feature (1)..(1): Xaa can be any naturally occurring amino acid
XLFIEVAPAGPLLLHLLDWVRLHVCEVDSLSADVLGSENPSKHDSFWNLIMLGDEAALLEQKELLSNWYHFLVTRLLYSNPTVKPIDLHYYAQPGPVSGR

SEQ ID NO: 9711 - protein, 98 aa, Homo Sapiens
  misc_feature (1)..(1): Xaa can be any naturally occurring amino acid
XSLMTSRIAPRSFWMTLLTDALPLLEQKQVKVIFSAEQTYELMRCLEDLTSRRPVHGESDTEQLQDDDIETTKVEMLRLSLARNLARAIIREGSLEGS

SEQ ID NO: 9712 - protein, 89 aa, Homo Sapiens
MPVNSSGPDWVTVIPRRIKETNSLELSQGSGTFPSGYYYKDQWRPRKFKMRQFNDPTTLQSAYKEKWCIYLVTQQSGNGLNTLLHLFQI

SEQ ID NO: 9713 - protein, 53 aa, Homo Sapiens
MWTNFFKLRLFCCLLAVLMVVVLVINVTQVEYLDHETVSATFIDSSGQFVSSQ

SEQ ID NO: 9714 - protein, 559 aa, Homo Sapiens
MWTNFFKLRLFCCLLAVLMVVVLVINVTQVEYLDHETVSATFIDSSGQFVSSQVTGISRNPYCGYDQQTLSSQERMEEDSLLAALHRQVPDVGPVPFVKSTDPSSSYFVILNSAAFFKVGSQLEVLVHVQDFQRKPKKYGGDYLQARIHSLKLQAGAVGRVVDYQNGFYKVFFTLLWPGKVKVSVSLVHPSEGIRVLQRLQEDKPDRVYFKSLFRSGRISETTECNVCLPGNLPLCNFTDLYTGEPWFCFKPKKLPCSSRITHFKGGYLKGLLTAAESAFFQSGVNIKMPVNSSGPDWVTVIPRRIKETNSLELSQGSGTFPSGYYYKDQWRPRKFKMRQFNDPDNITECLQRKVVHLFGDSTIRQWFEYLTTFVPDLVEFNLGSPKNVGPFLAVDQKHNILLKYRCHGPPIRFTTVFSNELHYVANELNGIVGGKNTVVAIAVWSHFSTFPLEVYIRRLRNIRRAVVRLLDRSPKTVVVIRTANAQELGPEVSLFNSDWYNFQLDTILRRMFSGVGVYLVDAWEMTLAHYLPHKLHPDEVIVKNQLDMFLSFVCPLET

SEQ ID NO: 9715 - protein, 559 aa, Homo Sapiens; identical to SEQ ID NO: 9714

SEQ ID NO: 9716 - protein, 559 aa, Homo Sapiens; identical to SEQ ID NO: 9714

SEQ ID NO: 9717 - protein, 260 aa, Homo Sapiens
MEKFNTISVSKCNKETVAMKEKCKFGMTSTIPSGHVWRNTWNPVSCSLATVKMKECLRGKLIYLMGDSTIRQWMEYFKASINTLKSVDLHESGKLQHQLAVDLDRNINIQWQKYCYPLIGSMTYSVKEMEYLTRAIDRTGGEKNTVIVISLGQHFRPFPIDVFIRRALNVHKAIQHLLLRSPDTMVIIKTENIREMYNDAERFSDFHGYIQYLIIKDIFQDLSVSIIDAWDITIAYGTNNVHPPQHVVGNQINILLNYIC

SEQ ID NO: 9718 - protein, 544 aa, Homo Sapiens
MKISMINYKSLLALLFILASWIIFTVFQNSTKVWSALNLSISLHYWNNSTKSLFPKTPLISLKPLTETELRIKEIIEKLDQQIPPRPFTHVNTTTSATHSTATILNPRDTYCRGDQLHILLEVRDHLGRRKQYGGDFLRARMSSPALMAGASGKVTDFNNGTYLVSFTLFWEGQVSLSLLLIHPSEGVSALWSARNQGYDRVIFTGQFVNGTSQVHSECGLILNTNAELCQYLDNRDQEGFYCVRPQHMPCAALTHMYSKNKKVSYLSKQEKSLFERSNVGVEIMEKFNTISVSKCNKETVAMKEKCKFGMTSTIPSGHVWRNTWNPVSCSLATVKMKECLRGKLIYLMGDSTIRQWMEYFKASINTLKSVDLHESGKLQHQLAVDLDRNINIQWQKYCYPLIGSMTYSVKEMEYLTRAIDRTGGEKNTVIVISLGQHFRPFPIDVFIRRALNVHKAIQHLLLRSPDTMVIIKTENIREMYNDAERFSDFHGYIQYLIIKDIFQDLSVSIIDAWDITIAYGTNNVHPPQHVVGNQINILLNYIC

SEQ ID NO: 9719 - protein, 139 aa, Homo Sapiens
MQAACWYVLFLLQPTVYLVTCANLTNGGKSELLKSGSSKSTLKHIWTESSKDLSISRLLSQTFRGKENDTDLDLRYDTPEPYSEQDLWDWLRNSTDLQEPRPRAKRRPIVKTGKFKKMFGWGDFHSNIKTVKLNLLITG

SEQ ID NO: 9720 - protein, 143 aa, Homo Sapiens
MQAACWYVLFLLQPTVYLVTCANLTNGGKSELLKSGSSKSTLKHIWTESSKDLSISRLLSQTFRGKENDTDLDLRYDTPEPYSEQDLWDWLRNSTDLQEPRPRAKRRPIVKTGKFKKMFGWGDFHSNIKTVKLNLLITGKIVD

SEQ ID NO: 9721 - protein, 271 aa, Homo Sapiens
MQAACWYVLFLLQPTVYLVTCANLTNGGKSELLKSGSSKSTLKHIWTESSKDLSISRLLSQTFRGKENDTDLDLRYDTPEPYSEQDLWDWLRNSTDLQEPRPRAKRRPIVKTGKFKKMFGWGDFHSNIKTVKLNLLITGKIVDHGNGTFSVYFRHNSTGQGNVSVSLVPPTKIVEFDLAQQTVIDAKDSKSFNCRIEYEKVDKATKNTLCNYDPSKTCYQEQTQSHVSWLCSKPFKVICIYISFYSTDYKLVQKVCPDYNYHSDTPYFPSG

SEQ ID NO: 9722 - protein, 253 aa, Homo Sapiens
VTCANLTNGGKSELLKSGSSKSTLKHIWTESSKDLSISRLLSQTFRGKENDTDLDLRYDTPEPYSEQDLWDWLRNSTDLQEPRPRAKRRPIVKTGKFKKMFGWGDFHSNIKTVKLNLLITGKIVDHGNGTFSVYFRHNSTGQGNVSVSLVPPTKIVEFDLAQQTVIDAKDSKSFNCRIEYEKVDKATKNTLCNYDPSKTCYQEQTQSHVSWLCSKPFKVICIYISFYSTDYKLVQKVCPDYNYHSDTPYFPSG

SEQ ID NO: 9723 - protein, 264 aa, Homo Sapiens
MRLRPLPLVVVPGLLQLLFCDSKEVVHATEGLDWEDKDAPGTLVGNVVHSRIISPLRLFVKQSPVPKPGPMAYADSMENFWDWLANITEIQEPLARTKRRPIVKTGKFKKMFGWGDFHSNIKTVKLNLLITGKIVDHGNGTFSVYFRHNSTGLGNVSVSLVPPSKVVEFEVSPQSTLETKESKSFNCRIEYEKTDRAKKTALCNFDPSKICYQEQTQSHVSWLCSKPFKVICIYIAFYSVDYKLVQKVCPDYNYHSETPYLSSG

SEQ ID NO: 9724 - protein, 354 aa, Homo Sapiens
MQLTRCCFVFLVQGSLYLVICGQDDGPPGSEDPERDDHEGQPRPRVPRKRGHISPKSRPMANSTLLGLLAPPGEAWGILGQPPNRPNHSPPPSAKVKKIFGWGDFYSNIKTVALNLLVTGKIVDHGNGTFSVHFQHNATGQGNISISLVPPSKAVEFHQEQQIFIEAKASKIFNCRMEWEKVERGRRTSLCTHDPAKICSRDHAQSSATWSCSQPFKVVCVYIAFYSTDYRLVQKGPSLLSGDVRHTPLLQTTLRSPPWRLETAGTGAAHQWTPTVCRSASHSAVETAGRRRKQWGQRPWAPSPPPLAELSAGTGGTLTPLLLLSSCGEPDAGDSWRARPSWHTVLPAPGMDSF

SEQ ID NO: 9725 - protein, 252 aa, Homo Sapiens
MQLTRCCFVFLVQGSLYLVICGQDDGPPGSEDPERDDHEGQPRPRVPRKRGHISPKSRPMANSTLLGLLAPPGEAWGILGQPPNRPNHSPPPSAKVKKIFGWGDFYSNIKTVALNLLVTGKIVDHGNGTFSVHFQHNATGQGNISISLVPPSKAVEFHQEQQIFIEAKASKIFNCRMEWEKVERGRRTSLCTHDPAKICSRDHAQSSATWSCSQPFKVVCVYIAFYSTDYRLVQKVCPDYNYHSDTPYYPSG

SEQ ID NO: 9726 - protein, 308 aa, Homo Sapiens
MRLLPEWFLLLFGPWLLRKAVSAQIPESGRPQYLGLRPAAAGAGAPGQQLPEPRSSDGLGVGRAWSWAWPTNHTGALARAGAAGALPAQRTKRKPSIKAARAKKIFGWGDFYFRVHTLKFSLLVTGKIVDHVNGTFSVYFRHNSSSLGNLSVSIVPPSKRVEFGGVWLPGPVPHPLQSTLALEGVLPGLGPPLGMAAAAAGPGLGGSLGGALAGPLGGALGVPGAKESRAFNCHVEYEKTNRARKHRPCLYDPSQVCFTEHTQSQAAWLCAKPFKVICIFVSFLSFDYKLVQKVCPDYNFQSEHPYFG

SEQ ID NO: 9727 - protein, 36 aa, Homo Sapiens
MRLLPEWFLLLFGPWLLRKPRPGLSLPPARSWEHPA

SEQ ID NO: 9728 - protein, 481 aa, Homo Sapiens
MKGRGMLVLLLHAVVLGLPSAWAVGACARACPAACACSTVERGCSVRCDRAGLLRVPAELPCEAVSIDLDRNGLRFLGERAFGTLPSLRRLSLRHNNLSFITPGAFKGLPRLAELRLAHNGDLRYLHARTFAALSRLRRLDLAACRLFSVPERLLAELPALRELAAFDNLFRRVPGALRGLANLTHAHLERGRIEAVASSSLQGLRRLRSLSLQANRVRAVHAGAFGDCGVLEHLLLNDNLLAELPADAFRGLRRLRTLNLGGNALDRVARAWFADLAELELLYLDRNSIAFVEEGAFQNLSGLLALHLNGNRLTVLAWVAFQPGFFLGRLFLFRNPWCCDCRLEWLRDWMEGSGRVTDVPCASPGSVAGLDLSQVTFGRSSDGLCVDPEELNLTTSSPGPSPEPAATTVSRFSSLLSKLLAPRVPVEEAANTTGGLANASLSDSLSSRGVGGAGRQPWFLLASCLLPSVAQHVVFGLQMD

SEQ ID NO: 9729 - protein, 481 aa, Homo Sapiens; identical to SEQ ID NO: 9728

SEQ ID NO: 9730 - protein, 157 aa, Homo Sapiens
MAKLRQKNPRAVRQAEEVRGLEHLHMDVAVNFSQGALLSPHLHNVCAEAVDAIYTRQEDVRFWLEQGVDSSVFEALPKASEQAELPRCRQVGDHGKPCVCRYGLSLAWYPCMLKYCHSRDRPTPYKCGIRSCQKSYSFDFYVPQRQLCLWDEDPYPG

SEQ ID NO: 9731 - protein, 273 aa, Homo Sapiens
MRLPGVPLARPALLLLLPLLAPLLGTGAPAELRVRVRLPDGQVTEESLQADSDADSISLELRKPDGTLVSFTADFKKDVKVFRALILGELEKGQSQFQALCFVTQLQHNEIIPSEAMAKLRQKNPRAVRQAEEVRGLEHLHMDVAVNFSQGALLSPHLHNVCAEAVDAIYTRQEDVRFWLEQGVDSSVFEALPKASEQAELPRCRQVGDHGKPCVCRYGLSLAWYPCMLKYCHSRDRPTPYKCGIRSCQKSYSFDFYVPQRQLCLWDEDPYPG

SEQ ID NO: 9732 - protein, 85 aa, Homo Sapiens
MKTLFLGVTLGLAAALSFTLEEEDEGGSVHPEENPDAEDGGAWQIQRLWGQEAHIPAGAARDGRLRLLLQRPAPWGPALHGKACG

SEQ ID NO: 9733 - protein, 147 aa, Homo Sapiens
MKTLFLGVTLGLAAALSFTLEEEDEGGSVHPEENPDAEDGGAWQIQRLWGQEAHIPAGAARDGRLRLLLQRPAPWGPALHGKACGICSLQGRAAVPTLAHLATSPAGRNPNTNLEALEEFKKLVQHKGLSEEDIFMPLQTGSCVLEH

SEQ ID NO: 9734 - protein, 228 aa, Homo Sapiens
MKTLFLGVTLGLAAALSFTLEEEDITGTWYVKAMVVDKDFPEDRRPRKVSPVKVTALGGGNLEATFTFMREDRCIQKKILMRKTEEPGKFSAYGGRKLIYLQELPGTDDYVFYCKDQRRGGLRYMGKLVASAPCRAVPLSPPWLTWPPHLQVGILIPTWRPWKNLRNWCSTRDSRRRTFSCPCRREAAFSNTRQPPGLHLQSPPYHQTQSPDHLDLPSSHDPSLLPPT

SEQ ID NO: 9735 - protein, 220 aa, Homo Sapiens
MKTLFLGVTLGLAAALSFTLEEEDITGTWYVKAMVVDKDFPEDRRPRKVSPVKVTALGGGNLEATFTFMREDRCIQKKILMRKTEEPGKFSAYGGRKLIYLQELPGTDDYVFYCKDQRRGGLRYMGKLVASAPCRAVPLSPPWLTWPPHLQVGILIPTWRPWKNLRNWCSTRDSRRRTFSCPCRREAAFSNTRVTPGSAPPEPTLPPDTEPGPPGPTLQP

SEQ ID NO: 9736 - protein, 146 aa, Homo Sapiens
MKTLFLGVTLGLAAALSFTLEEEDITGTWYVKAMVVDKDFPEDRRPRKVSPVKVTALGGGNLEATFTFMREDRCIQKKILMRKTEEPGKFSAYGGRKLIYLQELPGTDDYVFYCKDQRRGGLRYMGKLVGPCRCPHLGSPGHLTCR

SEQ ID NO: 9737 - protein, 170 aa, Homo Sapiens
MKTLFLGVTLGLAAALSFTLEEEDITGTWYVKAMVVDKDFPEDRRPRKVSPVKVTALGGGNLEATFTFMREDRCIQKKILMRKTEEPGKFSAYGGRKLIYLQELPGTDDYVFYCKDQRRGGLRYMGKLVGRNPNTNLEALEEFKKLVQHKGLSEEDIFMPLQTGSCVLEH

SEQ ID NO: 9738 - protein, 170 aa, Homo Sapiens; identical to SEQ ID NO: 9737

SEQ ID NO: 9739 - protein, 165 aa, Homo Sapiens
MKTLFLGVTLGLAAALSFTLEEEDITGTWYVKAMVVDKDFPEDRRPRKVSPVKVTALGGGKLEATFTFMREDRCIQKKILMRKTEEPGKYSACLSAVEMDQITPALWEALAIDTLRKLRIGTRRPRIRWGQEAHVPAGAAQEGPLHLLLQRPAPWGPAPHGKACG

SEQ ID NO: 9740 - protein, 220 aa, Homo Sapiens [sequence omitted]

SEQ ID NO: 9741 - protein, 170 aa, Homo Sapiens
MKTLFLGVTLGLAAALSFTLEEEDITGTWYVKAMVVDKDFPEDRRPRKVSPVKVTALGGGKLEATFTFMREDRCIQKKILMRKTEEPGKYSAYGGRKLMYLQELPRRDHYIFYCKDQHHGGLLHMGKLVGRNSDTNREALEEFKKLVQRKGLSEEDIFTPLQTGSCVPEH

SEQ ID NO: 9742 - protein, 170 aa, Homo Sapiens; identical to SEQ ID NO: 9741

SEQ ID NO: 9743 - protein, 477 aa, Homo Sapiens
MIAFLLTSVLMIPHAGGHPLDTPHLPQELPPGLPNNINITFFSGMFKNVESVAEIFDCLGPHFTWLQAVFTNFPVLIQFVNGMKCVAGLCPRDFEDYGCTCRFEMEGLPVDESDSCCFQHRRCYEEAAEMDCLQDPAKLSTEVNCVSKKIICESKDNCEHLLCTCDKAAIECLARSSLNSSLNLLDTSFCLAQTPETTIKEDLTTLLPRVVPVEPTDTSLTALSGEEAGHDQEGVGAARATSPPGSAEIVATRVTAKIVTLVPAGIKSLGLAVSSVENDPEETTEKACDRFTFLHLGSGDNMQVMPQLGEMLFCLTSRCPEEFESYGCYCGQEGRGEPRDDLDRCCLSHHCCLEQVRRLGCLLERLPWSPVVCVDHTPKCGGQSLCEKLLCACDQTAAECMTSASFNQSLKSPSRLGCPGQPAACEDSLHPVPAAPTLGSSSEEDSEEDPPQEDLGRAKRFLRKSLGPLGIGPLHGR

SEQ ID NO: 9744 - protein, 271 aa, Homo Sapiens
MIIVAFALIIFFAVKTRRKMDRYDKSNILWDKEHIYDEQPPNVEEWVKNVSAGTQDVPSPPSDYVERVDSPMAYSSNGKVNDKRFYPESSYKSTPVPEVVQELPLTSPVDDFRQPRYSSGGNFETPSKRAPAKGRAGRSKRTEQDHYETDYTTGGESCDELEEDWIREYPPITSDQQRQLYKRNFDTGLQEYKSLQSELDEINKELSRLDKELDDYREESEEYMAAADEYNRLKQVKGSADYKSKKNHCKQLKSKLSHIKKMVGDYDRQKT

SEQ ID NO: 9745 - protein, 522 aa, Homo Sapiens
MSSRPLESPPPYRPDEFKPNHYAPSNDIYGGEMHVRPMLSQPAYSFYPEDEILHFYKWTSPPGVIRILSMLIIVMCIAIFACVASTLAWDRGYGTSLLGGSVGYPYGGSGFGSYGSGYGYGYGYGYGYGGYTDPRAAKGFMLAMAAFCFIAALVIFVTSVIRSEMSRTRRYYLSVIIVSAILGIMVFIATIVYIMGVNPTAQSSGSLYGSQIYALCNQFYTPAATGLYVDQYLYHYCVVDPQEAIAIVLGFMIIVAFALIIFFAVKTRRKMDRYDKSNILWDKEHIYDEQPPNVEEWVKNVSAGTQDVPSPPSDYVERVDSPMAYSSNGKVNDKRFYPESSYKSTPVPEVVQELPLTSPVDDFRQPRYSSGGNFETPSKRAPAKGRAGRSKRTEQDHYETDYTTGGESCDELEEDWIREYPPITSDQQRQLYKRNFDTGLQEYKSLQSELDEINKELSRLDKELDDYREESEEYMAAADEYNRLKQVKGSADYKSKKNHCKQLKSKLSHIKKMVGDYDRQKT

SEQ ID NO: 9746 - protein, 522 aa, Homo Sapiens; identical to SEQ ID NO: 9745

SEQ ID NO: 9747 - protein, 216 aa, Homo Sapiens
GPLNSWIPPFSGILQQQQQAQIPGLSQFSLSALDQFAGLLPNQIPLTGEASFAQGAQAGQVDPLQLQTPPQTQPGPSHVMPYVFSFKMPQEQGQMFQYYPVYMVLPWEQPQQTVPRSPQQTRQQQYEEQAISGGQQQLAFDPQLGTAPEIAVMSTGEEIPYLQKEAINFRHDSAGVFMPSTSPKPSTTNVFTSAVDQTITPELPEEKDKTDSLREP

SEQ ID NO: 9748 - protein, 279 aa, Homo Sapiens
MKIIILLGFLGATLSAPLIPQRLMSASNSNELLLNLNNGQLLPLQLQGPLNSWIPPFSGILQQQQQAQIPGLSQFSLSALDQFAGLLPNQIPLTGEASFAQGAQAGQVDPLQLQTPPQTQPGPSHVMPYVFSFKMPQEQGQMFQYYPVYMVLPWEQPQQTVPRSPQQTRQQQYEEQIPFYAQFGYIPQLAEPAISGGQQQLAFDPQLGTAPEIAVMSTGEEIPYLQKEAINFRHDSAGVFMPSTSPKPSTTNVFTSAVDQTITPELPEEKDKTDSLREP

SEQ ID NO: 9749 - protein, 253 aa, Homo Sapiens
MKIIILLGFLGATLSAPLLLNLNNGQLLPLQLQGPLNSWIPPFSGILQQQQQAQIPGLSQFSLSALDQFAGLLPNQIPLTGEASFAQGAQAGQVDPLQLQTPPQTQPGPSHVMPYVFSFKMPQEQGQMFQYYPVYMVLPWEQPQQTVPRSPQQTRQQQYEEQIPFYAQFGYIPQLAEPAISGGQQQLAFDPQLGTAPEIAVMSTGEEIPYLQKEAINFRHDSAGVFMPSTSPKPSTTNVFTSAVDQTITPELP

SEQ ID NO: 9750 - protein, 30 aa, Homo Sapiens
QTPPQTQPGPSHVMPYVFSFKMPQEQGQNI

SEQ ID NO: 9751 - protein, 176 aa, Homo Sapiens
MARRHCFSYWLLVCWLVVTVAEALSTFYLQQHINLHMDKKRYLRLLEIHKIMRTLPTARSLHSPLHLPRGVRSQGPSPSQRHPGVPSIFFHEGPESILGFQTDLSSLQGVTTVFHSSHFIGHTVTLLIGISPEEDSREEAHLRKAEREEKPKHTEAKKSLSFRKKQQKDFCFIFRN

SEQ ID NO: 9752 - protein, 130 aa, Homo Sapiens
MARRHCFSYWLLVCWLVVTVAEGQEEVFTPPGDSQNNADATDCQIFTLTPPPAPRSPVTRAQPITKTPRCPFHFFPRRPRIHFRFPNRPFVPSRCNHRFPFQPFYWPHRYLTYRYFPRRRLQRGSSSEES

SEQ ID NO: 9753 - protein, 85 aa, Homo Sapiens
MARRHCFSYWLLVCWLVVTVAEGQEEVFTPPGDSQNNADATDCQIFTLTPPPAPRSPVTRAQPITKTPRYFPRRRLQRGSSSEES

SEQ ID NO: 9754 - protein, 40 aa, Homo Sapiens
MARRHCFSYWLLVCWLVVTVAEVETGFHHVSQDGLDLLTS

SEQ ID NO: 9755 - protein, 52 aa, Homo Sapiens
MPARALLPRRMGHRTLASTPALWASIPCPRSELRLDLVLPSGQSFRWLTASA

SEQ ID NO: 9756 - protein, 357 aa, Homo Sapiens
MPARALLPRRMGHRTLASTPALWASIPCPRSELRLDLVLPSGQSFRWREQSPAHWSGVLADQVWTLTQTEEQLHCTVYRGDKSQASRPTPDELEAVRKYFQLDVTLAQLYHHWGSVDSHFQEVAQKFQGVRLLRQDPIECLFSFICSSNNNIARITGMVERLCQAFGPRLIQLDDVTYHGFPSLQALAGPEVEAHLRKLGLGYRARYVSASARAILEEQGGLAWLQQLRESSYEEAHKALCILPGVGTKGLLGNAFDGHQLLRPLIFCQDHLREGPPIGRGDSQGEELEPQLPSSLSSIPYGFCDHCWTKDVDDPPLVTHPSPGSRDGHMTQAWPVKVVSPLATVIGHVMQASLLAL

SEQ ID NO: 9757 - protein, 424 aa, Homo Sapiens
MPARALLPRRMGHRTLASTPALWASIPCPRSELRLDLVLPSGQSFRWREQSPAHWSGVLADQVWTLTQTEEQLHCTVYRGDKSQASRPTPDELEAVRKYFQLDVTLAQLYHHWGSVDSHFQEVAQKFQGVRLLRQDPIECLFSFICSSNNNIARITGMVERLCQAFGPRLIQLDDVTYHGFPSLQALAGPEVEAHLRKLGLGYRARYVSASARAILEEQGGLAWLQQLRESSYEEAHKALCILPGVGTKVADCICLMALDKPQAVPVDVHMWHIAQRDYSWHPTTSQAKGPSPQTNKELGNFFRSLWGPYAGWAQAGLLGNAFDGHQLLRPLIFCQDHLREGPPIGRGDSQGEELEPQLPSSLSSIPYGFCDHCWTKDVDDPPLVTHPSPGSRDGHMTQAWPVKVVSPLATVIGHVMQASLLAL

SEQ ID NO: 9758 - protein, 410 aa, Homo Sapiens
MPARALLPRRMGHRTLASTPALWASIPCPRSELRLDLVLPSGQSFRWREQSPAHWSGVLADQVWTLTQTEEQLHCTVYRGDKSQASRPTPDELEAVRKYFQLDVTLAQLYHHWGSVDSHFQEVAQKFQGVRLLRQDPIECLFSFICSSNNNIARITGMVERLCQAFGPRLIQLDDVTYHGFPSLQALAGPEVEAHLRKLGLGYRARYVSASARAILEEQGGLAWLQQLRESSYEEAHKALCILPGVGTKVADCICLMALDKPQAVPVDVHMWHIAQRDYSWHPTTSQAKGPSPQTNKELGNFFRSLWGPYAGWAQATPPSYRCCSVPTCANPAMLRSHQQSAERVPKGRKARWGTLDKEIPQAPSPPFPTSLSPSPPSLMLGRGLPVTTSKARHPQIKQSVCTTRWGGGY

SEQ ID NO: 9759 - protein, 356 aa, Homo Sapiens
MPARALLPRRMGHRTLASTPALWASIPCPRSELRLDLVLPSGQSFRWREQSPAHWSGVLADQVWTLTQTEEQLHCTVYRGDKSQASRPTPDELEAVRKYFQLDVTLAQLYHHWGSVDSHFQEVAQKFQGVRLLRQDPIECLFSFICSSNNNIARITGMVERLCQAFGPRLIQLDDVTYHGFPSLQALAGPEVEAHLRKLGLGYRARYVSASARAILEEQGGLAWLQQLRESSYEEAHKALCILPGVGTKVADCICLMALDKPQAVPVDVHMWHIAQRDYSWHPTTSQAKGPSPQTNKELGNFFRSLWGPYAGWAQALCQVITTFMTFLGPHRLDQMPPEELQTSSSRLGGPPWQCI

SEQ ID NO: 9760 - protein, 324 aa, Homo Sapiens
MPARALLPRRMGHRTLASTPALWASIPCPRSELRLDLVLPSGQSFRWREQSPAHWSGVLADQVWTLTQTEEQLHCTVYRGDKSQASRPTPDELEAVRKYFQLDVTLAQLYHHWGSVDSHFQEVAQKFQGVRLLRQDPIECLFSFICSSNNNIARITGMVERLCQAFGPRLIQLDDVTYHGFPSLQALAGPEVEAHLRKLGLGYRARYVSASARAILEEQGGLAWLQQLRESSYEEAHKALCILPGVGTKVADCICLMALDKPQAVPVDVHMWHIAQRDYSWHPTTSQAKGPSPQTNKELGNFFRSLWGPYAGWAQAVSVPRCPP

SEQ ID NO: 9761 - protein, 345 aa, Homo Sapiens
MPARALLPRRMGHRTLASTPALWASIPCPRSELRLDLVLPSGQSFRWREQSPAHWSGVLADQVWTLTQTEEQLHCTVYRGDKSQASRPTPDELEAVRKYFQLDVTLAQLYHHWGSVDSHFQEVAQKFQGVRLLRQDPIECLFSFICSSNNNIARITGMVERLCQAFGPRLIQLDDVTYHGFPSLQALAGPEVEAHLRKLGLGYRARYVSASARAILEEQGGLAWLQQLRESSYEEAHKALCILPGVGTKVADCICLMALDKPQAVPVDVHMWHIAQRDYSWHPTTSQAKGPSPQTNKELGNFFRSLWGPYAGWAQAVLFSADLRQSRHAQEPPAKRRKGSKGPEG

SEQ ID NO: 9762 - protein, 322 aa, Homo Sapiens
MPARALLPRRMGHRTLASTPALWASIPCPRSELRLDLVLPSGQSFRWREQSPAHWSGVLADQVWTLTQTEEQLHCTVYRGDKSQASRPTPDELEAVRKYFQLDVTLAQLYHHWGSVDSHFQEVAQKFQGVRLLRQDPIECLFSFICSSNNNIARITGMVERLCQAFGPRLIQLDDVTYHGFPSLQALAGPEVEAHLRKLGLGYRARYVSASARAILEEQGGLAWLQQLRESSYEEAHKALCILPGVGTKVADCICLMALDKPQAVPVDVHMWHIAQRDYSWHPTTSQAKGPSPQTNKELGNFFRSLWGPYAGWAQAAGSDAS

SEQ ID NO: 9763 - protein, 195 aa, Homo Sapiens
MPARALLPRRMGHRTLASTPALWASIPCPRSELRLDLVLPSGQSFRWREQSPAHWSGVLADQVWTLTQTEEQLHCTVYRGDKSQASRPTPDELEAVRKYFQLDVTLAQLYHHWGSVDSHFQEVAQKFQGVRLLRQDPIECLFSFICSSNNNIARITGMVERLCQAFGPRLIQLDDVTYHGFPSLQALAGPPWQCI

SEQ ID NO: 9764 - protein, 168 aa, Homo Sapiens
  misc_feature (1)..(1): Xaa can be any naturally occurring amino acid
XASIPCPRSELRLDLVLPSGQSFRWREQSPAHWSGVLADQVWTLTQTEEQLHCTVYRGDKSQASRPTPDELEAVRKYFQLDVTLAQLYHHWGSVDSHFQEVAQKFQGVRLLRQDPIECLFSFICSSNNNIARITGMVERLCQAFGPRLIQLDDVTYHGFPSLQALAGG

SEQ ID NO: 9765 - protein, 128 aa, Homo Sapiens
  misc_feature (1)..(1): Xaa can be any naturally occurring amino acid
XELEAVRKYFQLDVTLAQLYHHWGSVDSHFQEVAQKFQGVRLLRQDPIECLFSFICSSNNNIARITGMVERLCQAFGPRLIQLDDVTYHGFPSLQALAGVPVPAEGLLTSASAFQSPLRSRQPEADRR

SEQ ID NO: 9766 - protein, 132 aa, Homo Sapiens
  misc_feature (1)..(1): Xaa can be any naturally occurring amino acid
XMMSPTMASPACRPWLVADCICLMALDKPQAVPVDVHMWHIAQRDYSWHPTTSQAKGPSPQTNKELGNFFRSLWGPYAGWAQATPPSYRCCSVPTCANPAMLRSHQQSAERVPKGRKARWGTLDKEIPQAPS

SEQ ID NO: 9767 - protein, 222 aa, Homo Sapiens
  misc_feature (1)..(1): Xaa can be any naturally occurring amino acid
XPCGPPSRALALSCAWTWFCLLDNLSGVRLLRQDPIECLFSFICSSNNNIARITGMVERLCQAFGPRLIQLDDVTYHGFPSLQALAGPEVEAHLRKLGLGYRARYVSASARAILEEQGGLAWLQQLRESSYEEAHKALCILPGVGTKVADCICLMALDKPQAVPVDVHMWHIAQRDYSWHPTTSQAKGPSPQTNKELGNFFRSLWGPYAGWAQAVSVPRCPP

SEQ ID NO: 9768 - protein, 263 aa, Homo Sapiens
  misc_feature (1)..(1): Xaa can be any naturally occurring amino acid
XVRKYFQLDVTLAQLYHHWGSVDSHFQEVAQKFQGVRLLRQDPIECLFSFICSSNNNIARITGMVERLCQAFGPRLIQLDDVTYHGFPSLQALAGPEVEAHLRKLGLGYRARYVSASARAILEEQGGLAWLQQLRESSYEEAHKALCILPGVGTKGLLGNAFDGHQLLRPLIFCQDHLREGPPIGRGDSQGEELEPQLPSSLSSIPYGFCDHCWTKDVDDPPLVTHPSPGSRDGHMTQAWPVKVVSPLATVIGHVMQASLLAL

SEQ ID NO: 9769 - protein, 298 aa, Homo Sapiens
MKTLQSTLLLLLLVPLIKPAPPTQQDSRIIYDYGTDNFEESIFSQDYEDKYLDGKNIKEKETVIIPNEKSLQLQKDEAITPLPPKKENDEMPTCLLCVCLSGSVYCEEVDIDAVPPLPKESAYLYARFNKIKKLTAKDFADIPNLRRLDFTGNLIEDIEDGTFSKLSLLEELSLAENQLLKLPVLPPKLTLFNAKYNKIKSRGIKANAFKKLNNLTFLYLDHNALESVPLNLPESLRVIHLQFNNIASITDDTFCKANDTSYIRDRIEEIRLEGNPIVLGKHPNSFICLKRLPIGSYF

SEQ ID NO: 9770 - protein, 298 aa, Homo Sapiens; identical to SEQ ID NO: 9769

SEQ ID NO: 9771 - protein, 268 aa, Homo Sapiens
MLAKISTTWKLFLKLLGPEILLSSLKSRHSFSHSPSHLGLMHRHEHLLRKTTKNFKTATTTLQSTLLLLLLVPLIKPAPPTQQDSRIIYDYGTDNFEESIFSQDYEDKYLDGKNIKEKETVIIPNEKSLQLQKDEAITPLPPKKENDEMPTCLLCVCLSGSVYCEEVDIDAVPPLPKESAYLYARFNKIKKLTAKDFADIPNLRRLDFTGNLIEDIEDGTFSKLSLLEELSLAENQLLKLPVLPPKLTLFNAKYNKIKSRGIKANAFK

SEQ ID NO: 9772 - protein, 545 aa, Homo Sapiens
MPPFLLLTCLFITGTSVSPVALDPCSAYISLNEPWRNTDHQLDESQGPPLCDNHVNGEWYHFTGMAGDAMPTFCIPENHCGTHAPVWLNGSHPLEGDGIVQRQACASFNGNCCLWNTTVEVKACPGGYYVYRLTKPSVCFHVYCGHFYDICDEDCHGSCSDTSECTCAPGTVLGPDRQTCFDENECEQNNGGCSEICVNLKNSYRCECGVGRVLRSDGKTCEDVEGCHNNNGGCSHSCLGSEKGYQCECPRGLVLSEDNHTCQVPVLCKSNAIEVNIPRELVGGLELFLTNTSCRGVSNGTHVNILFSLKTCGTVVDVVNDKIVASNLVTGLPKQTPGSSGDFIIRTSKLLIPVTCEFPRLYTISEGYVPNLRNSPLEIMSRNHGIFPFTLEIFKDNEFEEPYREALPTLKLRDSLYFGIEPVVHVSGLESLVESCFATPTSKIDEVLKYYLIRDGCVSDDSVKQYTSRDHLAKHFQVPVFKFVGKDHKEVFLHCRVLVCGVLDERSRCAQGCHRRMRRGAGGEDSAGLQGQTLTGGPIRIDWED

SEQ ID NO: 9773 - protein, 321 aa, Homo Sapiens
MPPFLLLTCLFITGTSVSPVALDPCSAYISLNEPWRNTDHQLDESQGPPLCDNHVNGEWYHFTGMAGDAMPTFCIPENHCGTHAPVWLNGSHPLEGDGIVQRQACASFNGNCCLWNTTVEVKACPGGYYVYRLTKPSVCFHVYCGHFYDICDEDCHGSCSDTSECTCAPGTVLGPDRQTCFDENECEQNNGGCSEICVNLKNSYRCECGVGRVLRSDGKTCEDVEGCHNNNGGCSHSCLGSEKGYQCECPRGLVLSEDNHTCQVPVLCKSNAIEVNIPRELVGGLELFLTNTSCRGVSNGTHVNILFSLKTCGTVVDLCFR

SEQ ID NO: 9774 - protein, 129 aa, Homo Sapiens
MCSRDARTKQLRQLLEKVQNMSQSIEVLDRRTQRDLQYVEKMENQMKGLESKFKQVEESHKQHLARQFKAIKAKMDELRPLIPVLEEYKADAKLVLQFKEEVQNLTSVLNELQEEIGAYDYDELQSRVS

SEQ ID NO: 9775 - protein, 163 aa, Homo Sapiens
MEGPGGSGFHLRLEAFCKCKSPINVFDPVRPALQVGLTRVLPTNPEESWQVYSSAQDSEGRCICTVVAPQQTMCSRDARTKQLRQLLEKVQNMSQSIEVLDRRTQRDLQYVEKMENQMKGLESKFKQVEESHKQHLARQFKAIKAKMDELRPLIPVLEEYKAD

SEQ ID NO: 9776 - protein, 458 aa, Homo Sapiens
MGEAPGREGRGPCPQLESPRRRRVLPTNPEESWQVYSSAQDSEGRCICTVVAPQQTMCSRDARTKQLRQLLEKVQNMSQSIEVLDRRTQRDLQYVEKMENQMKGLESKFKQVEESHKQHLARQFKAIKAKMDELRPLIPVLEEYKADAKLVLQFKEEVQNLTSVLNELQEEIGAYDYDELQSRVSNLEERLRACMQKLACGKLTGISDPVTVKTSGSRFGSWMTDPLAPEGDNRVWYMDGYHNNRFVREYKSMVDFMNTDNFTSHRLPHPWSGTGQVVYNGSIYFNKFQSHIIIRFDLKTETILKTRSLDYAGYNNMYHYAWGGHSDIDLMVDESGLWAVYATNQNAGNIVVSRLDPVSLQTLQTWNTSYPKRSAGEAFIICGTLYVTNGYSGGTKVHYAYQTNASTYEYIDIPFQNKYSHISMLDYNPKDRALYAWNNGHQILYNVTLFHVIRSDEL

SEQ ID NO: 9777 - protein, 129 aa, Homo Sapiens
MPGRWRWQRDMHPARKLLSLLFLILMGTELTQDSAAPDSLLRSSKGSTRGSLAAIVIWRGKSESRIAKTPGIFRGGGTLVLPPTHTPEWLILPLGITLPLGAPETGGGDCAAETWKGSQRAGQLCALLA

SEQ ID NO: 9778 - protein, 167 aa, Homo Sapiens
MPGRWRWQRDMHPARKLLSLLFLILMGTELTQNKRENKAEKMGGPESERKTTGEKTLNELPLFCLEAHAGSLALPRMCSPNPNPAVGLCRPAYPQSPSPGAAQTISQSLLERFCMASRRGFLGPRKAWWRVVVVHCCWTDAFIHVHTHTHTCTHRGADTCREEPTRS

SEQ ID NO: 9779 - protein, 467 aa, Homo Sapiens
MPGRWRWQRDMHPARKLLSLLFLILMGTELTQVLPTNPEESWQVYSSAQDSEGRCICTVVAPQQTMCSRDARTKQLRQLLEKVQNMSQSIEVLDRRTQRDLQYVEKMENQMKGLESKFKQVEESHKQHLARQFKAIKAKMDELRPLIPVLEEYKADAKLVLQFKEEVQNLTSVLNELQEEIGAYDYDELQSRVSNLEERLRACMQKLACGKLTGISDPVTVKTSGSRFGSWMTDPLAPEGDNRVWYMDGYHNNRFVREYKSMVDFMNTDNFTSHRLPHPWSGTGQVVYNGSIYFNKFQSHIIIRFDLKTETILKTRSLDYAGYNNMYHYAWGGHSDIDLMVDESGLWAVYATNQNAGNIVVSRLDPVSLQTLQTWNTSYPKRSAGEAFIICGTLYVTNGYSGGTKVHYAYQTNASTYEYIDIPFQNKYSHISMLDYNPKDRALYAWNNGHQILYNVTLFHVIRSDEL

SEQ ID NO: 9780 - protein, 135 aa, Homo Sapiens
MPGRWRWQRDMHPARKLLSLLFLILMGTELTQVLPTNPEESWQVYSSAQDSEGRCICTVVAPQQTMCSRDARTKQLRQLLEKVQNMSQSIEVLDRRTQRDLQYVEKMENQMKGLESKFKQVEESHKQHLARQFKG

SEQ ID NO: 9781 - protein, 208 aa, Homo Sapiens
MSQSIEVLDRRTQRDLQYVEKMENQMKGLESKFKQVEESHKQHLARQFKAIKAKMDELRPLIPVLEEYKADAKLVLQFKEEVQNLTSVLNELQEEIGAYDYDELQSRVSNLEERLRACMQKLACGKLTGISDPVTVKTSGSRFGSWMTDPLAPEGDNRVWYMDGYHNNRFVREYKSMVDFMNTDNFTSHRLPHPWSGTGQVVYNGSIY

SEQ ID NO: 9782 - protein, 485 aa, Homo Sapiens
MSVPLLKIGVVLSTMAMITNWMSQTLPSLVGLNTTKLSAAGGGTLDRSTGVLPTNPEESWQVYSSAQDSEGRCICTVVAPQQTMCSRDARTKQLRQLLEKVQNMSQSIEVLDRRTQRDLQYVEKMENQMKGLESKFKQVEESHKQHLARQFKAIKAKMDELRPLIPVLEEYKADAKLVLQFKEEVQNLTSVLNELQEEIGAYDYDELQSRVSNLEERLRACMQKLACGKLTGISDPVTVKTSGSRFGSWMTDPLAPEGDNRVWYMDGYHNNRFVREYKSMVDFMNTDNFTSHRLPHPWSGTGQVVYNGSIYFNKFQSHIIIRFDLKTETILKTRSLDYAGYNNMYHYAWGGHSDIDLMVDESGLWAVYATNQNAGNIVVSRLDPVSLQTLQTWNTSYPKRSAGEAFIICGTLYVTNGYSGGTKVHYAYQTNASTYEYIDIPFQNKYSHISMLDYNPKDRALYAWNNGHQILYNVTLFHVIRSDEL

SEQ ID NO: 9783 - protein, 153 aa, Homo Sapiens
MSVPLLKIGVVLSTMAMITNWMSQTLPSLVGLNTTKLSAAGGGTLDRSTGVLPTNPEESWQVYSSAQDSEGRCICTVVAPQQTMCSRDARTKQLRQLLEKVQNMSQSIEVLDRRTQRDLQYVEKMENQMKGLESKFKQVEESHKQHLARQFKG

SEQ ID NO: 9784 - protein, 99 aa, Homo Sapiens
  misc_feature (1)..(1): Xaa can be any naturally occurring amino acid
XSHKQHLARQFKAIKAKMDELRPLIPVLEEYKADAKLVLQFKEEVQNLTSVLNELQEEIGAYDYDELQSRVSNLEERLRACMQKLGVVHGRLSQQPLRT

SEQ ID NO: 9785 - protein, 78 aa, Homo Sapiens
MEVLELRTYRDLQYVRGMETLMRSLDARLRAADGSLSAKSFQELKDRMTELLPLSSVLEQYKADTRTIVRLREEAVGS

SEQ ID NO: 9786 - protein, 376 aa, Homo Sapiens
MEVLELRTYRDLQYVRGMETLMRSLDARLRAADGSLSAKSFQELKDRMTELLPLSSVLEQYKADTRTIVRLREEVRNLSGSLAAIQEEMGAYGYEDLQQRVMALEARLHACAQKLGCGKLTGVSNPITVRAMGSRFGSWMTDTMAPSADSRVWYMDGYYKGRRVLEFRTLGDFIKGQNFIQHLLPQPWAGTGHVVYNGSLFYNKYQSNVVVKYHFRSRSVLVQRSLPGAGYNNTFPYSWGGFSDMDFMVDESGLWAVYTTNQNAGNIVVSRLDPHTLEVMRSWDTGYPKRSAGEAFMICGVLYVTNSHLAGAKVYFAYFTNTSSYEYTDVPFHNQYSHISMLDYNPRERALYTWNNGHQVLYNVTLFHVISTSGDP

SEQ ID NO: 9787 - protein, 336 aa, Homo Sapiens
MSVPLLKIGAVLSTMAMVTNWMSQTLPSLVGLNGTVSRAGASEKITLFQNPEEGWQLYTSAQAPDGKCICTAVIPAQSTCSRDGRSRELRQLMEKVQNVSQSMEVLELRTYRDLQYVRGMETLMRSLDARLRAADGSLSAKSFQELKDRMTELLPLSSVLEQYKADTRTIVRLREEVRNLSGSLAAIQEEMGAYGYEDLQQRVMALEARLHACAQKLGCGKLTGVSNPITVRAMGSRFGSWMTDTMAPSADSRVWYMDGYYKGRRVLEFRTLGDFIKGQNFIQHLLPQPWAGTGHVVYNGSLFYNKYQSNVVVKYHFRSRSVLVQRSLPGAGYNNT

SEQ ID NO: 9788 - protein, 454 aa, Homo Sapiens
MWPLTVPPPLLLLLCSGLAGQTLFQNPEEGWQLYTSAQAPDGKCICTAVIPAQSTCSRDGRSRELRQLMEKVQNVSQSMEVLELRTYRDLQYVRGMETLMRSLDARLRAADGSLSAKSFQELKDRMTELLPLSSVLEQYKADTRTIVRLREEVRNLSGSLAAIQEEMGAYGYEDLQQRVMALEARLHACAQKLGCGKLTGVSNPITVRAMGSRFGSWMTDTMAPSADSRVWYMDGYYKGRRVLEFRTLGDFIKGQNFIQHLLPQPWAGTGHVVYNGSLFYNKYQSNVVVKYHFRSRSVLVQRSLPGAGYNNTFPYSWGGFSDMDFMVDESGLWAVYTTNQNAGNIVVSRLDPHTLEVMRSWDTGYPKRSAGEAFMICGVLYVTNSHLAGAKVYFAYFTNTSSYEYTDVPFHNQYSHISMLDYNPRERALYTWNNGHQVLYNVTLFHVISTSGDP

SEQ ID NO: 9789 - protein, 458 aa, Homo Sapiens
MQATSNLLNLLLLSLFAGLDPSKTQISPKEGWQVYSSAQDPDGRCICTVVAPEQNLCSRDAKSRQLRQLLEKVQNMSQSIEVLNLRTQRDFQYVLKMETQMKGLKAKFRQIEDDRKTLMTKHFQELKEKMDELLPLIPVLEQYKTDAKLITQFKEEIRNLSAVLTGIQEEIGAYDYEELHQRVLSLETRLRDCMKKLTCGKLMKITGPVTVKTSGTRFGAWMTDPLASEKNNRVWYMDSYTNNKIVREYKSIADFVSGAESRTYNLPFKWAGTNHVVYNGSLYFNKYQSNIIIKYSFDMGRVLAQRSLEYAGFHNVYPYTWGGFSDIDLMADEIGLWAVYATNQNAGNIVISQLNQDTLEVMKSWSTGYPKRSAGESFMICGTLYVTNSHLTGAKVYYSYSTKTSTYEYTDIPFHNQYFHISMLDYNARDRALYAWNNGHQVLFNVTLFHIIKTEDDT

SEQ ID NO: 9790 - protein, 478 aa, Homo Sapiens
MSPPLLKLGAVLSTMAMISNWMSQTLPSLVGLNTTRLSTPDTLTQISPKEGWQVYSSAQDPDGRCICTVVAPEQNLCSRDAKSRQLRQLLEKVQNMSQSIEVLNLRTQRDFQYVLKMETQMKGLKAKFRQIEDDRKTLMTKHFQELKEKMDELLPLIPVLEQYKTDAKLITQFKEEIRNLSAVLTGIQEEIGAYDYEELHQRVLSLETRLRDCMKKLTCGKLMKITGPVTVKTSGTRFGAWMTDPLASEKNNRVWYMDSYTNNKIVREYKSIADFVSGAESRTYNLPFKWAGTNHVVYNGSLYFNKYQSNIIIKYSFDMGRVLAQRSLEYAGFHNVYPYTWGGFSDIDLMADEIGLWAVYATNQNAGNIVISQLNQDTLEVMKSWSTGYPKRSAGESFMICGTLYVTNSHLTGAKVYYSYSTKTSTYEYTDIPFHNQYFHISMLDYNARDRALYAWNNGHQVLFNVTLFHIIKTEDDT

SEQ ID NO: 9791 - protein, 140 aa, Homo Sapiens
MSQSIEVLNLRTQRDFQYVLKMETQMKGLKAKFRQIEDDRKTLMTKHFQELKEKMDELLPLIPVLEQYKTDAKLITQFKEEIRNLSAVLTGIQEEIGAYDYEELHQRVLSLETRLRDCMKKLIDLKKRKEEEKRQQKGEA

SEQ ID NO: 9792 - protein, 510 aa, Homo Sapiens
MRPGLSFLLALLFFLGQAAGDLGDVGPPIPSPGFSSFPGVDSSSSFSSSSRSGSSSSRSLGSGGSVSQLFSNFTGSVDDRGTCQCSVSLPDTTFPVDRVERLEFTAHVLSQKFEKELSKVREYVQLISVYEKKLLNLTVRIDIMEKDTISYTELDFELIKVEVKEMEKLVIQLKESFGGSSEIVDQLEVEIRNMTLLVEKLETLDKNNVLAIRREIVALKTKLKECEASKDQNTPVVHPPPTPGSCGHGGVVNISKPSVVQLNWRGFSYLYGAWGRDYSPQHPNKGLYWVAPLNTDGRLLEYYRLYNTLDDLLLYINARELRITYGQGSGTAVYNNNMYVNMYNTGNIARVNLTTNTIAVTQTLPNAAYNNRFSYANVAWQDIDFAVDENGLWVIYSTEASTGNMVISKLNDTTLQVLNTWYTKQYKPSASNAFMVCGVLYATRTMNTRTEEIFYYYDTNTGKEGKLDIVMHKMQEKVQSINYNPFDQKLYVYNDGYLLNYDLSVLQKPQ

SEQ ID NO: 9793 - protein, 68 aa, Homo Sapiens
MMVALRGASALLVLFLAAFLPPPQCTQDPAMVHYIYQRFRVLEGWKNVPKQRGHTFKNSKSSQKIYLS

SEQ ID NO: 9794 - protein, 402 aa, Homo Sapiens
MMVALRGASALLVLFLAAFLPPPQCTQDPAMVHYIYQRFRVLEQGLEKCTQATRAYIQEFQEFSKNISVMLGRCQTYTSEYKSAVGNLALRVERAQREIDYIQYLREADECIESEDKTLAEMLLQEAEEEKKIRTLLNASCDNMLMGIKSLKIVKKMMDTHGSWMKDAVYNSPKVYLLIGSRNNTVWEFANIRAFMEDNTKPAPRKQILTLSWQGTGQVIYKGFLFFHNQATSNEIIKYNLQKRTVEDRMLLPGGVGRALVYQHSPSTYIDLAVDEHGLWAIHSGPGTHSHLVLTKIEPGTLGVEHSWDTPCRSQDAEASFLLCGVLYVVYSTGGQGPHRITCIYDPLGTISEEDLPNLFFPKRPRSHSMIHYNPRDKQLYAWNEGNQIIYKLQTKRKLPLK

SEQ ID NO: 9795 - protein, 402 aa, Homo Sapiens; identical to SEQ ID NO: 9794

SEQ ID NO: 9796 - protein, 56 aa, Homo Sapiens
MMVALRGASALLVLFLAAFLPPPQCTQDPAMVHYIYQRFRVLEQGLEKCTQAVTTC

SEQ ID NO: 9797 - protein, 652 aa, Homo Sapiens
MAAAALPPRPLLLLPLVLLLSGRPTRADSKVFGDLDQVRMTSEGSDCRCKCIMRPLSKDACSRVRSGRARVEDFYTVETVSSGTDCRCSCTAPPSSLNPCENEWKMEKLKKQAPELLKLQSMVDLLEGTLYSMDLMKVHAYVHKVASQMNTLEESIKANLSRENEVVKDSVRHLSEQLRHYENHSAIMLGIKKELSRLGLQLLQKDAAAAPATPATGTGSKAQDTARGKGKDISKYGSVQKSFADRGLPKPPKEKLLQVEKLRKESGKGSFLQPTAKPRALAQQQAVIRGFTYYKAGKQEVTEAVADNTLQGTSWLEQLPPKVEGRSNSAEPNSAEQDEAEPRSSERVDLASGTPTSIPATTTTATTTPTPTTSLLPTEPPSGPEVSSQGREASCEGTLRAVDPPVRHHSYGRHEGAWMKDPAARDDRIYVTNYYYGNSLVEFRNLENFKQGRWSNMYKLPYNWIGTGHVVYQGAFYYNRAFTKNIIKYDLRQRFVASWALLPDVVYEDTTPWKWRGHSDIDFAVDESGLWVIYPAVDDRDEAQPEVIVLSRLDPGDLSVHRETTWKTRLRRNSYGNCFLVCGILYAVDTYNQQEGQVAYAFDTHTGTDARPQLPFLNEHAYTTQIDYNPKERVLYAWDNGHQLTYTLHFVV

SEQ ID NO: 9798 - protein, 318 aa, Homo Sapiens
MAAAALPPRPLLLLPLVLLLSGRPTRADSKVFGDLDQVRMTSEGSDCRCKCIMRPLSKDACSRVRSGRARVEDFYTVETVSSGTDCRCSCTAPPSSLNPCENEWKMEKLKKQAPELLKSIKANLSRENEVVKDSVRHLSEQLRHYENHSAIMLGIKKELSRLGLQLLQKDAAAAPATPATGTGSKAQDTARGKGKDISKYGSVQKSFADRGLPKPPKEKLLQVEKLRKESGKGSFLQPTAKPRALAQQQAVIRGFTYYKAGKQEVTEAVADNTLQGTSWLEQLPPKVEGRSNSAEPNSAEQDEAEPRSSERVDLASGT

SEQ ID NO: 9799 - protein, 438 aa, Homo Sapiens
MSKRDKAGKDTARGKGKDISKYGSVQKSFADRGLPKPPKEKLLQVEKLRKESGKGSFLQPTAKPRALAQQQAVIRGFTYYKAGKQEVTEAVADNTLQGTSWLEQLPPKVEGRSNSAEPNSAEQDEAEPRSSERVDLASGTPTSIPATTTTATTTPTPTTSLLPTEPPSGPEVSSQGREASCEGTLRAVDPPVRHHSYGRHEGAWMKDPAARDDRIYVTNYYYGNSLVEFRNLENFKQGRWSNMYKLPYNWIGTGHVVYQGAFYYNRAFTKNIIKYDLRQRFVASWALLPDVVYEDTTPWKWRGHSDIDFAVDESGLWVIYPAVDDRDEAQPEVIVLSRLDPGDLSVHRETTWKTRLRRNSYGNCFLVCGILYAVDTYNQQEGQVAYAFDTHTGTDARPQLPFLNEHAYTTQIDYNPKERVLYAWDNGHQLTYTLHFVV

SEQ ID NO: 9800 - protein, 90 aa, Homo Sapiens
ETTWRTGLRRNFYGNCFVICGVLYAVDSYNQRNANISYAFDTHTNTQIVPRLLFENEYSYTTQIDYNPKDRLLYAWDNGHQVTYHVIFAY

SEQ ID NO: 9801 - protein, 751 aa, Homo Sapiens
MAKPRLLVLYFALIVVPAWVSSIVLTGTSEPPDAQTVAPAEDETLQNEADNQENVLSQLLGDYDKVKAMSEGSDCQCKCVVRPLGRDACQRINAGASRKEDFYTVETITSGSSCKCACVAPPSALNPCEGDFRLQKLREADSQDLKLSTIIDMLEGAFYGLDLLKLHSVTTKLVGRVDKLEEEVSKNLTKENEQIKEDMEEIRTEMNKRGKENCSENILDSMPDIRSALQRDAAAAYAHPEQYEERFLQEETVSQQINSIELLQTRPLALPEVVKSQRPLQRQVHLRGRPASQPTVIRGITYYKAKVSEEENDIEEQQDEFFSGDNGVDLLIEDQLLRHNGLMTSVTRRPAATRQGHSTAVTSDLNARTAPWSSALPQPSTSDPSIANHASVGPTLQTTSVSPDPTRESVLQPSPQVPATTVAHTATQQPAAPAPPAVSPREALMEAMHTVPVPPTTVRTDSLGKDAPAGWGTTPASPTLSPEEEDDIRNVIGRCKDTLSTITGPTTQNTYGRNEGAWMKDPLAKDERIYVTNYYYGNTLVEFRNLENFKQGRWSNSYKLPYSWIGTGHVVYNGAFYYNRAFTRNIIKYDLKQRYVAAWAMLHDVAYEEATPWRWQGHSDVDFAVDENGLWLIYPALDDEGFSQEVIVLSKLNAADLSTQKETTWRTGLRRNFYGNCFVICGVLYAVDSYNQRNANISYAFDTHTNTQIVPRLLFENEYSYTTQIDYNPKDRLLYAWDNGHQVTYHVIFAY

SEQ ID NO: 9802 - protein, 750 aa, Homo Sapiens
MAKPRLLVLYFALIVVPAWVSSIVLTGTSEPPDAQTVAPAEDETLQNEADNQENVLSQLLGDYDKVKAMSEGSDCQCKCVVRPLGRDACQRINAGASRKEDFYTVETITSGSSCKCACVAPPSALNPCEGDFRLQKLREADSQDLKLSTIIDMLEGAFYGLDLLKLHSVTTKLVGRVDKLEEEVSKNLTKENEQIKEDMEEIRTEMNKRGKENCSENILDSMPDIRSALQRDAAAAYAHPEYEERFLQEETVSQQINSIELLQTRPLALPEVVKSQRPLQRQVHLRGRPASQPTVIRGITYYKAKVSEEENDIEEQQDEFFSGDNGVDLLIEDQLLRHNGLMTSVTRRPAATRQGHSTAVTSDLNARTAPWSSALPQPSTSDPSIANHASVGPTLQTTSVSPDPTRESVLQPSPQVPATTVAHTATQQPAAPAPPAVSPREALMEAMHTVPVPPTTVRTDSLGKDAPAGWGTTPASPTLSPEEEDDIRNVIGRCKDTLSTITGPTTQNTYGRNEGAWMKDPLAKDERIYVTNYYYGNTLVEFRNLENFKQGRWSNSYKLPYSWIGTGHVVYNGAFYYNRAFTRNIIKYDLKQRYVAAWAMLHDVAYEEATPWRWQGHSDVDFAVDENGLWLIYPALDDEGFSQEVIVLSKLNAADLSTQKETTWRTGLRRNFYGNCFVICGVLYAVDSYNQRNANISYAFDTHTNTQIVPRLLFENEYSYTTQIDYNPKDRLLYAWDNGHQVTYHVIFAY

SEQ ID NO: 9803 - protein, 233 aa, Homo Sapiens
MKDPLAKDERIYVTNYYYGNTLVEFRNLENFKQGRWSNSYKLPYSWIGTGHVVYNGAFYYNRAFTRNIIKYDLKQRYVAAWAMLHDVAYEEATPWRWQGHSDVDFAVDENGLWLIYPALDDEGFSQEVIVLSKLNAADLSTQKETTWRTGLRRNFYGNCFVICGVLYAVDSYNQRNANISYAFDTHTNTQIVPRLLFENEYSYTTQIDYNPKDRLLYAWDNGHQVTYHVIFAY

SEQ ID NO: 9804 - protein, 88 aa, Homo Sapiens
TWRTGLRRNFYGNCFVICGVLYAVDSYNQRNANISYAFDTHTNTQIVPRLLFENEYSYTTQIDYNPKDRLLYAWDNGHQVTYHVIFAY

SEQ ID NO: 9805 - protein, 386 aa, Homo Sapiens
MAQWHCSQRTQAGGHGVGERLAQCQDQSSRHAAELRDFKNKMLPLLEVAEKEREALRTEADTISGRVDRLEREVDYLETQNPALPCVEFDEKVTGGPGTKGKGRRNEKYDMVTDCGYTISQVRSMKILKRFGGPAGLWTKDPLGQTEKIYVLDGTQNDTAFVFPRLRDFTLAMAARKASRVRVPFPWVGTGQLVYGGFLYFARRPPGRPGGGGEMENTLQLIKFHLANRTVVDSSVFPAEGLIPPYGLTADTYIDLAADEEGLWAVYATREDDRHLCLAKLDPQTLDTEQQWDTPCPRENAEAAFVICGTLYVVYNTRPASRARIQCSFDASGTLTPERAALPYFPRRYGAHASLRYNPRERQLYAWDDGYQIVYKLEMRKKEEEV

SEQ ID NO: 9806 - protein, 406 aa, Homo Sapiens
MGPSTPLLILFLLSWSGPLQGQQHHLVEYMERRLAALEERLAQCQDQSSRHAAELRDFKNKMLPLLEVAEKEREALRTEADTISGRVDRLEREVDYLETQNPALPCVEFDEKVTGGPGTKGKGRRNEKYDMVTDCGYTISQVRSMKILKRFGGPAGLWTKDPLGQTEKIYVLDGTQNDTAFVFPRLRDFTLAMAARKASRVRVPFPWVGTGQLVYGGFLYFARRPPGRPGGGGEMENTLQLIKFHLANRTVVDSSVFPAEGLIPPYGLTADTYIDLAADEEGLWAVYATREDDRHLCLAKLDPQTLDTEQQWDTPCPRENAEAAFVICGTLYVVYNTRPASRARIQCSFDASGTLTPERAALPYFPRRYGAHASLRYNPRERQLYAWDDGYQIVYKLEMRKKEEEV

SEQ ID NO: 9807 - protein, 345 aa, Homo Sapiens
MLPLLEVAEKEREALRTEADTISGRVDRLEREVDYLETQNPALPCVEFDEKVTGGPGTKGKGRRNEKYDMVTDCGYTISQVRSMKILKRFGGPAGLWTKDPLGQTEKIYVLDGTQNDTAFVFPRLRDFTLAMAARKASRVRVPFPWVGTGQLVYGGFLYFARRPPGRPGGGGEMENTLQLIKFHLANRTVVDSSVFPAEGLIPPYGLTADTYIDLAADEEGLWAVYATREDDRHLCLAKLDPQTLDTEQQWDTPCPRENAEAAFVICGTLYVVYNTRPASRARIQCSFDASGTLTPERAALPYFPRRYGAHASLRYNPRERQLYAWDDGYQIVYKLEMRKKEEEV

SEQ ID NO: 9808 - protein, 421 aa, Homo Sapiens
MGFLSPIYVIFFFFGVKVHCQYETYQWDEDYDQEPDDDYQTGFPFRQNVDYGVPFHQYTLGCVSECFCPTNFPSSMYCDNRKLKTIPNIPMHIQQLYLQFNEIEAVTANSFINATHLKEINLSHNKIKSQKIDYGVFAKLPNLLQLHLEHNNLEEFPFPLPKSLERLLLGYNEISKLQTNAMDGLVNLTMLDLCYNYLHDSLLKDKIFAKMEKLMQLNLCSNRLESMPPGLPSSLMYLSLENNSISSIPEKYFDKLPKLHTLRMSHNKLQDIPYNIFNLPNIVELSVGHNKLKQAFYIPRNLEHLYLQNNEIEKMNLTVMCPSIDPLHYHHLTYIRVDQNKLKEPISSYIFFCFPHIHTIYYGEQRSTNGQTIQLKTQVFRRFPDDDDESEDHDDPDNAHESPEQEGAEGHFDLHYYENQE

SEQ ID NO: 9809 - protein, 440 aa, Homo Sapiens
MEYQILKMSLCLFILLFLTPGILCICPLQCICTERHRHVDCSGRNLSTLPSGLQENIIHLNLSYNHFTDLHNQLTQYTNLRTLDISNNRLESLPAHLPRSLWNMSAANNNIKLLDKSDTAYQWNLKYLDVSKNMLEKVVLIKNTLRSLEVLNLSSNKLWTVPTNMPSKLHIVDLSNNSLTQILPGTLINLTNLTHLYLHNNKFTFIPDQSFDQLFQLQEITLYNNRWSCDHKQNITYLLKWMMETKAHVIGTPCSTQISSLKEHNMYPTPSGFTSSLFTVSGMQTVDTINSLSVVTQPKVTKIPKQYRTKETTFGATLSKDTTFTSTDKAFVPYPEDTSTETINSHEAAAATLTIHLQDGMVTNTSLTSSTKSSPTPMTLSITSGMPNNFSEMPQQSTTLNLWREETTTNVKTPLPSVANAWKVNASFLLLLNVVVMLAV

SEQ ID NO: 9810 - protein, 158 aa, Homo Sapiens
MALEVLMLLAVLIWTGAENLHVKISCSLDWLMVSVIPVAESRNLYIFADELHLGMGCPANRIHTYVYEFIYLVRDCGIRTRVVSEETLLFQTELYFTPRNIDHDPQEIHLECSTSRKSVWLTPVSTENEIKLDPSPFIADFQTTAEELGLLSSSPNLL

SEQ ID NO: 9811 - protein, 86 aa, Homo Sapiens
MVSVIPVAESRNLYIFADELHLGMGCPANRIHTYVYEFIYLVRDCGIRTRVVSEETLLFQTELYFTPRNIDHDPQEIHLECSTSSV

SEQ ID NO: 9812 - protein, 304 aa, Homo Sapiens
MDNVTVRQGESATLRCTIDDRVTRVAWLNRSTILYAGNDKWSIDPRVIILVNTPTQYSIMIQNVDVYDEGPYTCSVQTDNHPKTSRVHLIVQVPPQIMNISSDITVNEGSSVTLLCLAIGRPEPTVTWRHLSVKEGQGFVSEDEYLEISDIKRDQSGEYECSALNDVAAPDVRKVKITVNYPPYISKAKNTGVSVGQKGILSCEASAVPMAEFQWFKEETRLATGLDGMRIENKGRMSTLTFFNVSEKDYGNYTCVATNKLGNTNASITLYGPGAVIDGVNSASRALACLWLSGTLLAHFFIKF

SEQ ID NO: 9813 - protein, 345 aa, Homo Sapiens
MGVCGYLFLPWKCLVVVSLRLLFLVPTGVPVRSGDATFPKAMDNVTVRQGESATLRCTIDDRVTRVAWLNRSTILYAGNDKWSIDPRVIILVNTPTQYSIMIQNVDVYDEGPYTCSVQTDNHPKTSRVHLIVQVPPQIMNISSDITVNEGSSVTLLCLAIGRPEPTVTWRHLSVKEGQGFVSEDEYLEISDIKRDQSGEYECSALNDVAAPDVRKVKITVNYPPYISKAKNTGVSVGQKGILSCEASAVPMAEFQWFKEETRLATGLDGMRIENKGRMSTLTFFNVSEKDYGNYTCVATNKLGNTNASITLYGPGAVIDGVNSASRALACLWLSGTLLAHFFIKF

SEQ ID NO: 9814 - protein, 354 aa, Homo Sapiens
MGVCGYLFLPWKCLVVVSLRLLFLVPTGVPVRSGDATFPKAMDNVTVRQGESATLRCTIDDRVTRVAWLNRSTILYAGNDKWSIDPRVIILVNTPTQYSIMIQNVDVYDEGPYTCSVQTDNHPKTSRVHLIVQVPPQIMNISSDITVNEGSSVTLLCLAIGRPEPTVTWRHLSVKEGQGFVSEDEYLEISDIKRDQSGEYECSALNDVAAPDVRKVKITVNYPPYISKAKNTGVSVGQKGILSCEASAVPMAEFQWFKEETRLATGLDGMRIENKGRMSTLTFFNVSEKDYGNYTCVATNKLGNTNASITLYEISPSSAVAGPGAVIDGVNSASRALACLWLSGTLLAHFFIKF

SEQ ID NO: 9815 - protein, 345 aa, Homo Sapiens; identical to SEQ ID NO: 9813

SEQ ID NO: 9816 - protein, 338 aa, Homo Sapiens
MYHPAYWVVFSATTALLFIPGVPVRSGDATFPKAMDNVTVRQGESATLRCTIDDRVTRVAWLNRSTILYAGNDKWSIDPRVIILVNTPTQYSIMIQNVDVYDEGPYTCSVQTDNHPKTSRVHLIVQVPPQIMNISSDITVNEGSSVTLLCLAIGRPEPTVTWRHLSVKEGQGFVSEDEYLEISDIKRDQSGEYECSALNDVAAPDVRKVKITVNYPPYISKAKNTGVSVGQKGILSCEASAVPMAEFQWFKEETRLATGLDGMRIENKGRMSTLTFFNVSEKDYGNYTCVATNKLGNTNASITLYGPGAVIDGVNSASRALACLWLSGTLLAHFFIKF

SEQ ID NO: 9817 - protein, 248 aa, Homo Sapiens
MKLTFFLGLLALISCFTPSESQRFSRRPYLPGQLPPPPLYRPRWVPPSPPPPYDSRLNSPLSLPFVPGRVPPSSFSRFSQAVILSQLFPLESIRQPRLFPGYPNLHFPLRPYYVGPIRILKPPFPPIPFFLAIYLPISNPEPQINITTADTTITTNPPTTATATTSTSTKPTMTISSSTVPISSTPEPATSISAATPAASTENTTQILANRPHTVLLNATVQVTTSNQTILSSPAFKSFWQKLFAIFG

SEQ ID NO: 9818 - protein, 174 aa, Homo Sapiens
MRLLAFLSLLALVLQETGTASLPRKERKRREEQMPREGDSFEVLPLRNDVLNPDNYGEVIDLSNYEELTDYGDQLPEVKVTSLAPATSISPAKSTTAPGTPSSNPTMTRPTTAGLLLSSQPNHEDIPPLPRRTAYLYARFNRISRIRAEDFKGLTKLKRIDLSNNLISSIDNDA

SEQ ID NO: 9819 - protein, 332 aa, Homo Sapiens
MRLLAFLSLLALVLQETGTASLPRKERKRREEQMPREGDSFEVLPLRNDVLNPDNYGEVIDLSNYEELTDYGDQLPEVKVTSLAPATSISPAKSTTAPGTPSSNPTMTRPTTAGLLLSSQPNHGLPTCLVCVCLGSSVYCDDIDLEDIPPLPRRTAYLYARFNRISRIRAEDFKGLTKLKRIDLSNNLISSIDNDAFRLLHALQDLILPENQLEALPVLPSGIEFLDVRLNRLQSSGIQPAAFRAMEKLQFLYLSDNLLDSIPGPLPLSLRSVHLQNNLIETMQRDVFCDPEEHKHTRRQLEDIRLDGNPINLSLFPSAYFCLPRLPIGRFT

SEQ ID NO: 9820 - protein, 301 aa, Homo Sapiens
MHPEPAPPPSRSSPELPPSGGSTTSGSRRSRRRSGDGEPPGAPPPPPSAVTYPDWIGQSYSEVMSLNEHSMQALSWRKLYLSRAKLKASSRTSALLSGFAMVAMVEVQLDADHDYPPGLLIAFSACTTVLVAVHLFALMISTCILPNIEAVSNVHNLNSVKESPHERMHRHIELAWAFSTVIGTLLFLAEVVLLCWVKFLPLKKQPGQPRPTSKPPASGAAANVSTSGITPGQAAAIASTTIMVPFGLIFIVFAVHFYRSLVSHKTDRQFQELNELAEFARLQDQLDHRGDHPLTPGSHYA

SEQ ID NO: 9821 - protein, 201 aa, Homo Sapiens
MALSWVLTVLSLLPLLEAQIPLCANLVPVPITNATLDRITGKWFYIASAFRNEEYNKSVQEIQATFFYFTPNKTEDTIFLREYQTRQDQCIYNTTYLNVQRENGTISRYVGGQEHFAHLLILRDTKTYMLAFDVNDEKNWGLSVYADKPETTKEQLGEFYEALDCLRIPKSDVVYTDWKKDKCEPLEKQHEKERKQEEGES

SEQ ID NO: 9822 - protein, 201 aa, Homo Sapiens
MALSWVLTVLSLLPLLEAQIPLCANLVPVPITNATLDRITGKWFYIASAFRNEEYNKSVQEIQATFFYFTPNKTEDTIFLREYQTRQNQCFYNSSYLNVQRENGTVSRYEGGREHVAHLLFLRDTKTLMFGSYLDDEKNWGLSFYADKPETTKEQLGEFYEALDCLCIPRSDVMYTDWKKDKCEPLEKQHEKERKQEEGES

SEQ ID NO: 9823 - protein, 65 aa, Homo Sapiens
MDYGLQFTSSRKFLSISPIVLYLLASFYTKYDAAHFLINTASLLSVLLPKLPQFHGVRVFGINKY

SEQ ID NO: 9824 - protein, 153 aa, Homo Sapiens
MNVGVAHSEVNPNTRVMNSRGIWLAYIILVGLLHMVLLSIPFFSIPVVWTLTNVIHNLATYVFLHTVKGTPFETPDQGKARLLTHWEQMDYGLQFTSSRKFLSISPIVLYLLASFYTKYDAAHFLINTASLLSVLLPKLPQFHGVRVFGINKY

SEQ ID NO: 9825 - protein, 153 aa, Homo Sapiens; identical to SEQ ID NO: 9824

SEQ ID NO: 9826 - protein, 119 aa, Homo Sapiens
MVLLSIPFFSIPVVWTLTNVIHNLATYVFLHTVKGTPFETPDQGKARLLTHWEQMDYGLQFTSSRKFLSISPIVLYLLASFYTKYDAAHFLINTASLLSVLLPKLPQFHGVRVFGINKY

SEQ ID NO: 9827 - protein, 75 aa, Homo Sapiens
MAAETLLSSLLGLLLLGLLLPASLTGGVGSLNLEELSEMRYGIEILPLPVMGGQPFFASLPPDPPFFPRANLRTW

SEQ ID NO: 9828 - protein, 75 aa, Homo Sapiens; identical to SEQ ID NO: 9827

SEQ ID NO: 9829 - protein, 125 aa, Homo Sapiens
MAAETLLSSLLGLLLLGLLLPASLTGGVGSLNLEELSEMRYGIEILPLPVMGGQSQSSDVVIVSSKYKQRYECRLPAGAIHFQREREEETPAYQGPGIPELLSPMRDAPCLLKGGMERPQVENRL

SEQ ID NO: 9830 - protein, 406 aa, Homo Sapiens
MAAETLLSSLLGLLLLGLLLPASLTGGVGSLNLEELSEMRYGIEILPLPVMGGQSQSSDVVIVSSKYKQRYECRLPAGAIHFQREREEETPAYQGPGIPELLSPMRDAPCLLKTKDWWTYEFCYGRHIQQYHMEDSASGAPNDFQNNVQVKVIRSPADLIRFIEELKGGTKKGKPNIGQEQPVDDAAEVPQREPEKERGDPERQREMEEEEDEDEDEDEDEDERQLLGEFEKELEGILLPSDRDRLRSEVKAGMERELENIIQETEKELDPDGLKKESERDRAMLALTSTLNKLIKRLEEKQSPELVKKHKKKRVVPKKPPPSPQPTGKIEIKIVRPWAEGTEEGARWLTDEDTRNLKEIFFNILVPGAEEAQKERQRQKELESNYRRVWGSPGGEGTGDLDEFDF

SEQ ID NO: 9831 - protein, 560 aa, Homo Sapiens
MAAETLLSSLLGLLLLGLLLPASLTGGVGSLNLEELSEMRYGIEILPLPVMGGQSQSSDVVIVSSKYKQRYECRLPAGAIHFQREREEETPAYQGPGIPELLSPMRDAPCLLKTKDWWTYEFCYGRHIQQYHMEDSEIKGEFLCDEGAGISGDYIDRVDEPLSCSYVLTIRTPRLCPHPLLRPPPSAAPQAILCHPSLQPEEYMAYVQRQADSKQYGDKIIEELQDLGPQVWSETKSGVAPQKMAGASPTKDDSKDSDFWKMLNEPEDQAPGGEEVPAEEQDPSPEAADSASGAPNDFQNNVQVKVIRSPADLIRFIEELKGGTKKGKPNIGQEQPVDDAAEVPQREPEKERGDPERQREMEEEEDEDEDEDEDEDERQLLGEFEKELEGILLPSDRDRLRSEVKAGMERELENIIQETEKELDPDGLKKESERDRAMLALTSTLNKLIKRLEEKQSPELVKKHKKKRVVPKKPPPSPQPTGKIEIKIVRPWAEGTEEGARWLTDEDTRNLKEIFFNILVPGAEEAQKERQRQKELESNYRRVWGSPGGEGTGDLDEFDF

SEQ ID NO: 9832 - protein, 613 aa, Homo Sapiens
MAAETLLSSLLGLLLLGLLLPASLTGGVGSLNLEELSEMRYGIEILPLPVMGGQSQSSDVVIVSSKYKQRYECRLPAGAIHFQREREEETPAYQGPGIPELLSPMRDAPCLLKTKDWWTYEFCYGRHIQQYHMEDSEIKGEVLYLGYYQSAFDWDDETAKASKQHRLKRYHSQTYGNGSKCDLNGRPREAEVRFLCDEGAGISGDYIDRVDEPLSCSYVLTIRTPRLCPHPLLRPPPSAAPQAILCHPSLQPEEYMAYVQRQAVDSKQYGDKIIEELQDLGPQVWSETKSGVAPQKMAGASPTKDDSKDSDFWKMLNEPEDQAPGGEEVPAEEQDPSPEAADSASGAPNDFQNNVQVKVIRSPADLIRFIEELKGGTKKGKPNIGQEQPVDDAAEVPQREPEKERGDPERQREMEEEEDEDEDEDEDEDERQLLGEFEKELEGILLPSDRDRLRSEVKAGMERELENIIQETEKELDPDGLKKESERDRAMLALTSTLNKLIKRLEEKQSPELVKKHKKKRVVPKKPPPSPQPTGKIEIKIVRPWAEGTEEGARWLTDEDTRNLKEIFFNILVPGAEEAQKERQRQKELESNYRRVWGSPGGEGTGDLDEFDF

SEQ ID NO: 9833 - protein, 667 aa, Homo Sapiens
MAAETLLSSLLGLLLLGLLLPASLTGGVGSLNLEELSEMRYGIEILPLPVMGGQSQSSDVVIVSSKYKQRYECRLPAGAIHFQREREEETPAYQGPGIPELLSPMRDAPCLLKTKDWWTYEFCYGRHIQQYHMEDSEIKGEVLYLGYYQSAFDWDDETAKASKQHRLKRYHSQTYGNGSKCDLNGRPREAEVRFLCDEGAGISGDYIDRVDEPLSCSYVLTIRTPRLCPHPLLRPPPSAAPQAILCHPSLQPEEYMAYVQRQADSKQYGDKIIEELQDLGPQVWSETKSGVAPQKMAGASPTKDDSKDSDFWKMLNEPEDQAPGGEEVPAEEQDPSPEAADSASGAPNDFQNNVQVKVIRSPADLIRFIEELKGGTKKGKPNIGQEQPVDDAAEVPQREPEKERGDPERQREMEEEEDEDEDEDEDEDERQLLGEFEKELEGILLPSDRDRLRSEVKAGMERELENIIQETEKELDPDGLKKESERDRAMLALTSTLNKLIKRLEEKQSPELVKKHKKKRVVPKKPPPSPQPTEEDPEHRVRVRVTKLRLGGPNQDLTVLEMKRENPQLKQIEGLVKELLEREGLTAAGKIEIKIVRPWAEGTEEGARWLTDEDTRNLKEIFFNILVPGAEEAQKERQRQKELESNYRRVWGSPGGEGTGDLDEFDF

SEQ ID NO: 9834 - protein, 597 aa, Homo Sapiens
MAAETLLSSLLGLLLLGLLLPASLTGGVGSLNLEELSEMRYGIEILPLPVMGGQSQSSDVVIVSSKYKQRYECRLPAGAIHFQREREEETPAYQGPGIPELLSPMRDAPCLLKTKDWWTYEFCYGRHIQQYHMEDSEIKGEVLYLGYYQSAFDWDDETAKASKQHRLKRYHSQTYGNGSKCDLNGRPREAEVRFLCDEGAGISGDYIDRVDEPLSCSYVLTIRTPRLCPHPLLRPPPSAAPQAILCHPSLQPEEYMAYVQRQADSKQYGDKIIEELQDLGPQVWSETKSGVAPQKMAGASPTKDDSKDSDFWKMLNEPEDQAPGGEEVPAEEQDPSPEAADSASGAPNDFQNNVQVKVIRSPADLIRFIEELKGGTKKGKPNIGQEQPVDDAAEVPQREPEKERGDPERQREMEEEEDEDEDEDEDEDERQLLGEFEKELEGILLPSDRDRLRSETEKELDPDGLKKESERDRAMLALTSTLNKLIKRLEEKQSPELVKKHKKKRVVPKKPPPSPQPTGKIEIKIVRPWAEGTEEGARWLTDEDTRNLKEIFFNILVPGAEEAQKERQRQKELESNYRRVWGSPGGEGTGDLDEFDF

SEQ ID NO: 9835 - protein, 652 aa, Homo Sapiens
MAAETLLSSLLGLLLLGLLLPASLTGGVGSLNLEELSEMRYGIEILPLPVMGGQSQSSDVVIVSSKYKQRYECRLPAGAIHFQREREEETPAYQGPGIPELLSPMRDAPCLLKTKDWWTYEFCYGRHIQQYHMEDSEIKGEVLYLGYYQSAFDWDDETAKASKQHRLKRYHSQTYGNGSKCDLNGRPREAEVRFLCDEGAGISGDYIDRVDEPLSCSYVLTIRTPRLCPHPLLRPPPSAAPQAILCHPSLQPEEYMAYVQRQADSKQYGDKIIEELQDLGPQVWSETKSGVAPQKMAGASPTKDDSKDSDFWKMLNEPEDQAPGGEEVPAEEQDPSPEAADSASGAPNDFQNNVQVKVIRSPADLIRFIEELKGGTKKGKPNIGQEQPVDDAAEVPQREPEKERGDPERQREMEEEEDEDEDEDEDEDERQLLGEFEKELEGILLPSDRDRLRSETEKELDPDGLKKESERDRAMLALTSTLNKLIKRLEEKQSPELVKKHKKKRVVPKKPPPSPQPTEEDPEHRVRVRVTKLRLGGPNQDLTVLEMKRENPQLKQIEGLVKELLEREGLTAAGKIEIKIVRPWAEGTEEGARWLTDEDTRNLKEIFFNILVPGAEEAQKERQRQKELESNYRRVWGSPGGEGTGDLDEFDF

SEQ ID NO: 9836 - protein, 612 aa, Homo Sapiens
MAAETLLSSLLGLLLLGLLLPASLTGGVGSLNLEELSEMRYGIEILPLPVMGGQSQSSDVVIVSSKYKQRYECRLPAGAIHFQREREEETPAYQGPGIPELLSPMRDAPCLLKTKDWWTYEFCYGRHIQQYHMEDSEIKGEVLYLGYYQSAFDWDDETAKASKQHRLKRYHSQTYGNGSKCDLNGRPREAEVRFLCDEGAGISGDYIDRVDEPLSCSYVLTIRTPRLCPHPLLRPPPSAAPQAILCHPSLQPEEYMAYVQRQADSKQYGDKIIEELQDLGPQVWSETKSGVAPQKMAGASPTKDDSKDSDFWKMLNEPEDQAPGGEEVPAEEQDPSPEAADSASGAPNDFQNNVQVKVIRSPADLIRFIEELKGGTKKGKPNIGQEQPVDDAAEVPQREPEKERGDPERQREMEEEEDEDEDEDEDEDERQLLGEFEKELEGILLPSDRDRLRSEVKAGMERELENIIQETEKELDPDGLKKESERDRAMLALTSTLNKLIKRLEEKQSPELVKKHKKKRVVPKKPPPSPQPTGKIEIKIVRPWAEGTEEGARWLTDEDTRNLKEIFFNILVPGAEEAQKERQRQKELESNYRRVWGSPGGEGTGDLDEFDF

SEQ ID NO: 9837 - protein, 580 aa, Homo Sapiens
MAAETLLSSLLGLLLLGLLLPASLTGGVGSLNLEELSEMRYGIEILPLPVMGGQSQSSDVVIVSSKYKQRYECRLPAGAIHFQREREEETPAYQGPGIPELLSPMRDAPCLLKTKDWWTYEFCYGRHIQQYHMEDSEIKGEVLYLGYYQSAFDWDDETAKFLCDEGAGISGDYIDRVDEPLSCSYVLTIRTPRLCPHPLLRPPPSAAPQAILCHPSLQPEEYMAYVQRQAVDSKQYGDKIIEELQDLGPQVWSETKSGVAPQKMAGASPTKDDSKDSDFWKMLNEPEDQAPGGEEVPAEEQDPSPEAADSASGAPNDFQNNVQVKVIRSPADLIRFIEELKGGTKKGKPNIGQEQPVDDAAEVPQREPEKERGDPERQREMEEEEDEDEDEDEDEDERQLLGEFEKELEGILLPSDRDRLRSEVKAGMERELENIIQETEKELDPDGLKKESERDRAMLALTSTLNKLIKRLEEKQSPELVKKHKKKRVVPKKPPPSPQPTGKIEIKIVRPWAEGTEEGARWLTDEDTRNLKEIFFNILVPGAEEAQKERQRQKELESNYRRVWGSPGGEGTGDLDEFDF

SEQ ID NO: 9838 - protein, 146 aa, Homo Sapiens
MAAETLLSSLLGLLLLGLLLPASLTGGVGSLNLEELSEMRYGIEILPLPVMGGQSQSSDVVIVSSKYKQRYECRLPAGAIHFQREREEETPAYQGPGIPELLSPMRDAPCLLKTKDWWTYEFCYGRHIQQYHMEDSEIKGLQAASS

SEQ ID NO: 9839 - protein, 186 aa, Homo Sapiens
MAAETLLSSLLGLLLLGLLLPASLTGGVGSLNLEELSEMRYGIEILPLPVMGGQSQSSDVVIVSSKYKQRYECRLPAGAIHFQREREEETPAYQGPGIPELLSPMRDAPCLLKTKDWWTYEFCYGRHIQQYHMEGILLPSDRDRLRSEVKAGMERELENIIQETEKELDPDGLKKESERDRAMLAL

SEQ ID NO: 9840 - protein, 162 aa, Homo Sapiens
MAAETLLSSLLGLLLLGLLLPASLTGGVGSLNLEELSEMRYGIEILPLPVMGGQSQSSDVVIVSSKYKQRYECRLPAGAIHFQREREEETPAYQGPGIPELLSPMRDAPCLLKTYGNGSKCDLNGRPREAEVRFLCDEGAGISGDYIDRVDEPLSCSYVLTI

SEQ ID NO: 9841 - protein, 538 aa, Homo Sapiens
MAAETLLSSLLGLLLLGLLLPASLTGGVGSLNLEELSEMRYGIEILPLPVMGGQTKDWWTYEFCYGRHIQQYHMEDSEIKGEVLYLGYYQSAFDWDDETAKASKQHRLKRYHSQTYGNGSKCDLNGRPREAEVRFLCDEGAGISGDYIDRVDEPLSCSYVLTIRTPRLCPHPLLRPPPSAAPQAILCHPSLQPEEYMAYVQRQADSKQYGDKIIEELQDLGPQVWSETKSGVAPQKMAGASPTKDDSKDSDFWKMLNEPEDQAPGGEEVPAEEQDPSPEAADSASGAPNDFQNNVQVKVIRSPADLIRFIEELKGGTKKGKPNIGQEQPVDDAAEVPQREPEKERGDPERQREMEEEEDEDEDEDEDEDERQLLGEFEKELEGILLPSDRDRLRSETEKELDPDGLKKESERDRAMLALTSTLNKLIKRLEEKQSPELVKKHKKKRVVPKKPPPSPQPTGKIEIKIVRPWAEGTEEGARWLTDEDTRNLKEIFFNILVPGAEEAQKERQRQKELESNYRRVWGSPGGEGTGDLDEFDF

SEQ ID NO: 9842 - protein, 252 aa, Homo Sapiens
MALVLILQLLTLFPPASYHPKPWLGAQPATVVTPGVNVTLRCRAPQPAWRFGLFKPGEIAPLLFRDVSSELAEFFLEEVTPAQGGSYRCCYRRPDWGPGVWSQPSDVLELLVTEELPRPSLVALPGPVVGPGANVSLRCAGRLRNMSFVLYREGVAAPLQYRHSAQPWADFTLLGARAPGTYSCYYHTPSAPYVLSQRSEVLVISWEDSGSSDYTRGNLVRLGLAGLVLISLGALVTFDWRSQNRAPAGIRP

SEQ ID NO: 9843 - protein, 271 aa, Homo Sapiens
MALVLILQLLTLFPPASYHPKPWLGAQPATVVTPGVNVTLRCRAPQPAWRFGLFKPGEIAPLLFRDVSSELAEFFLEEVTPAQGGSYRCCYRRPDWGPGVWSQPSDVLELLVTEELPRPSLVALPGPVVGPGANVSLRCAGRLRNMSFVLYREGVAAPLQYRHSAQPWADFTLLGARAPGTYSCYYHTPSAPYVLSQRSEVLVISWEGEGPEARPASSAPGMQAPGPPPSDPGAQAPSLSSFRPRGLVLQPLLPQTQDSWDPAPPPSDPGV

SEQ ID NO: 9844 - protein, 271 aa, Homo Sapiens; identical to SEQ ID NO: 9843

SEQ ID NO: 9845 - protein, 268 aa, Homo Sapiens [sequence omitted]

SEQ ID NO: 9846 - protein, 161 aa, Homo Sapiens
MALVLILQLLTLWPLCHTDITPSAGRILSGGGDSSPRGKLPLLLPKARLGAGCLVPAQRCPGAAGDRGAAAAVAGGAARAGGGSWRQREPALRGPPAEHELRAVPRGRGGPAAVPPLRAALGRLHAAGRPRPRHLQLLLSHALRALRAVAAQRGAGHQLGR

SEQ ID NO: 9847 - protein, 267 aa, Homo Sapiens
MALVLILQLLTLWPLCHTDITPSVAIIVPPASYHPKPWLGAQPATVVTPGVNVTLRCRAPQPAWRFGLFKPGEIAPLLFRDVSSELAEFFLEEVTPAQGGSYRCCYRRPDWGPGVWSQPSDVLELLVTEELPRPSLVALPGPVVGPGANVSLRCAGRLRNMSFVLYREGVAAPLQYRHSAQPWADFTLLGARAPGTYSCYYHTPSAPYVLSQRSEVLVISWEDSGSSDYTRGNLVRLGLAGLVLISLGALVTFDWRSQNRAPAGIRP

SEQ ID NO: 9848 - protein, 267 aa, Homo Sapiens; identical to SEQ ID NO: 9847

SEQ ID NO: 9849 - protein, 286 aa, Homo Sapiens
MALVLILQLLTLWPLCHTDITPSVAIIVPPASYHPKPWLGAQPATVVTPGVNVTLRCRAPQPAWRFGLFKPGEIAPLLFRDVSSELAEFFLEEVTPAQGGSYRCCYRRPDWGPGVWSQPSDVLELLVTEELPRPSLVALPGPVVGPGANVSLRCAGRLRNMSFVLYREGVAAPLQYRHSAQPWADFTLLGARAPGTYSCYYHTPSAPYVLSQRSEVLVISWEGEGPEARPASSAPGMQAPGPPPSDPGAQAPSLSSFRPRGLVLQPLLPQTQDSWDPAPPPSDPGV

SEQ ID NO: 9850 - protein, 286 aa, Homo Sapiens; identical to SEQ ID NO: 9849

SEQ ID NO: 9851 - protein, 263 aa, Homo Sapiens
MALVLILQLLTLWPLCHTDITPSVPPASYHPKPWLGAQPATVVTPGVNVTLRCRAPQPAWRFGLFKPGEIAPLLFRDVSSELAEFFLEEVTPAQGGSYRCCYRRPDWGPGVWSQPSDVLELLVTEELPRPSLVALPGPVVGPGANVSLRCAGRLRNMSFVLYREGVAAPLQYRHSAQPWADFTLLGARAPGTYSCYYHTPSAPYVLSQRSEVLVISWEDSGSSDYTRGNLVRLGLAGLVLISLGALVTFDWRSQNRAPAGIRP

SEQ ID NO: 9852 - protein, 282 aa, Homo Sapiens
MALVLILQLLTLWPLCHTDITPSVPPASYHPKPWLGAQPATVVTPGVNVTLRCRAPQPAWRFGLFKPGEIAPLLFRDVSSELAEFFLEEVTPAQGGSYRCCYRRPDWGPGVWSQPSDVLELLVTEELPRPSLVALPGPVVGPGANVSLRCAGRLRNMSFVLYREGVAAPLQYRHSAQPWADFTLLGARAPGTYSCYYHTPSAPYVLSQRSEVLVISWEGEGPEARPASSAPGMQAPGPPPSDPGAQAPSLSSFRPRGLVLQPLLPQTQDSWDPAPPPSDPGV

SEQ ID NO: 9853 - protein, 231 aa, Homo Sapiens
MASMAAIGSCSKEYRVLLGQLQKQTDLMQDTSRLLDPYIRIQGLDVPKLREHCRERPGAFPSEETLRGLGRRGFLQTLNATLGCVLHRLADLEQRLPKAQDLERSGLNIEDLEKLQMARPNILGLRNNIYCMAQLLDNSDTAEPTKAGRGASQPPTPTPASDAFQRKLEGCRFLHGYHRFMHSVGRVFSKWGESPNRSRRHSPHQALRKGVRRTRPSRKGKRLMTRGQLPR

SEQ ID NO: 9854 - protein, 20 aa, Homo Sapiens
MGVLLTQRTLLNTYPRPGCS

SEQ ID NO: 9855 - protein, 252 aa, Homo Sapiens
MGVLLTQRTLLSLVLALLFPSMASMAAIGSCSKEYRVLLGQLQKQTDLMQDTSRLLDPYIRIQGLDVPKLREHCRERPGAFPSEETLRGLGRRGFLQTLNATLGCVLHRLADLEQRLPKAQDLERSGLNIEDLEKLQMARPNILGLRNNIYCMAQLLDNSDTAEPTKAGRGASQPPTPTPASDAFQRKLEGCRFLHGYHRFMHSVGRVFSKWGESPNRSRRHSPHQALRKGVRRTRPSRKGKRLMTRGQLPR

SEQ ID NO: 9856 - protein, 188 aa, Homo Sapiens
LEPATEYMARVRCADASHFWKWSEWSGQNFTTLEAAPSEAPDVWRIVSLEPGNHTVTLFWKPLSKLHANGKILFYNVVVENLDKPSSSELHSIPAPANSTKLILDRCSYQICVIANNSVGASPASVIVISADPENSVSTCFSGTVPSVWGEGDFSHGSGHFCPGDSSTYMGNYLKFIQVTATLTNSHH

SEQ ID NO: 9857 - protein, 979 aa, Homo Sapiens
MALFAVFQTTFFLTLLSLRTYQSEVLAERLPLTPVSLKVSTNSTRQSLHLQWTVHNLPYHQELKMVFQIQISRIETSNVIWVGNYSTTVKWNQVLHWSWESELPLECATHFVRIKSLVDDAKFPEPNFWSNWSSWEEVSVQDSTGQDILFVFPKDKLVEEGTNVTICYVSRNIQNNVSCYLEGKQIHGEQLDPHVTAFNLNSVPFIRNKGTNIYCEASQGNVSEGMKGIVLFVSKVLEEPKDFSCETEDFKTLHCTWDPGTDTALGWSKQPSQSYTLFESFSGEKKLCTHKNWCNWQITQDSQETYNFTLIAENYLRKRSVNILFNLTHRVYLMNPFSVNFENVNATNAIMTWKVHSIRNNFTYLCQIELHGEGKMMQYNVSIKVNGEYFLSELEPATEYMARVRCADASHFWKWSEWSGQNFTTLEAAPSEAPDVWRIVSLEPGNHTVTLFWKPLSKLHANGKILFYNVVVENLDKPSSSELHSIPAPANSTKLILDRCSYQICVIANNSVGASPASVIVISADPENKEVEEERIAGTEGGFSLSWKPQPGDVIGYVVDWCDHTQDVLGDFQWKNVGPNTTSTVISTDAFRPGVRYDFRIYGLSTKRIACLLEKKTGYSQELAPSDNPHVLVDTLTSHSFTLSWKDYSTESQPGFIQGYHVYLKSKARQCHPRFEKAVLSDGSECCKYKIDNPEEKALIVDNLKPESFYEFFITPFTSAGEGPSATFTKVTTPDEHSSMLIHILLPMVFCVLLIMVMCYLKSQWIKETCYPDIPDPYKSSILSLIKFKENPHLIIMNVSDCIPDAIEVVSKPEGTKIQFLGTRKSLTETELTKPNYLYLLPTEKNHSGPGPCICFENLTYNQAASDSGSCGHVPVSPKAPSMLGLMTSPENVLKALEKNYMNSLGEIPAGETSLNYVSQLASPMFGDKDSLPTNPVEAPHCSEYKMQMAVSLRLALPPPTENSSLSSITLLDPGEHYC

SEQ ID NO: 9858 - protein, 342 aa, Homo Sapiens
MALFAVFQTTFFLTLLSLRTYQSEVLAERLPLTPVSLKVSTNSTRQSLHLQWTVHNLPYHQELKMVFQIQISRIETSNVIWVGNYSTTVKWNQVLHWSWESELPLECATHFVRIKSLVDDAKFPEPNFWSNWSSWEEVSVQDSTGQDILFVFPKDKLVEEGTNVTICYVSRNIQNNVSCYLEGKQIHGEQLDPHVTAFNLNSVPFIRNKGTNIYCEASQGNVSEGMKGIVLFVSKVLEEPKDFSCETEDFKTLHCTWDPGTDTALGWSKQPSQSYTLFESFSGEKKLCTHKNWCNWQITQDSQETYNFTLIAENYLRKRSVNILFNLTHRGETRVVTAHRGH

SEQ ID NO: 9859 - protein, 35 aa, Homo Sapiens
  misc_feature (1)..(1): Xaa can be any naturally occurring amino acid
XIKETCYPDIPDPYKSSILSLIKFKISSKVWLNRR

SEQ ID NO: 9860 - protein, 62 aa, Homo Sapiens
  misc_feature (1)..(1): Xaa can be any naturally occurring amino acid
XSMLIHILLPMVFCVLLIMVMCYLKSQWIKETCYPDIPDPYKSSILSLIKFKISSKVWLNRR

SEQ ID NO: 9861 - protein, 111 aa, Homo Sapiens
MLDWRLASAHFILAVTLTLWSSGKVLSVDVTTTEAFDSGVIDVQSTPTVREEKSATDLTAKLLLLDELVSLENDVIETKKKRSFSGFGSPLDRLSAGSVDHKGKQRCNFLG

SEQ ID NO: 9862 - protein, 133 aa, Homo Sapiens
MLDWRLASAHFILAVTLTLWSSGKVLSVDVTTTEAFDSGVIDVQSTPTVREEKSATDLTAKLLLLDELVSLENDVIETKKKRSFSGFGSPLDRLSAGSVDHKGKQRKVVDHPKRRFGIPMDRIGRNRLSNSRG

SEQ ID NO: 9863 - protein, 815 aa, Homo Sapiens
MFRLGLLVCFYNDLELLDATVAQVLLYQMIKCSHLRGFQAGVQKLKAELLDIAMENQTLNETLGSLSDAVVGLTYSQLESLSPEAVHGAISTLNQVSGWAKSQVIILSAKYLAHEKVLSFYNVSQMGALLAGVSTQAFCSMKRKDISQVLRSAVSQYVSDLSPAQQQGILSKMVQAEDTAPGIVEIQGAFFKEVSLFDLRRQPGFNSTVLKDKELGRSQALFLYELLLKTTRRPEELLSAGQLVKGVTCSHIDAMSTDFFLAHFQDFQNNFALLSPYQVNCLAWKYWEVSRLSMPPFLLAALPARYLASVPASQCVPFLISLGKSWLDSLVLDSHKKTSVLRKVQQCLDDSIADEYTVDIMGNLLCHLPAAIIDRGISPRAWATALHGLRDCPDLNPEQKAAVRLKLLGQYGLPQHWTAETTKDLGPFLVLFSGDELSSIATKFPEILLQAASKMARTLPTKEFLWAVFQSVRNSSDKIPSYDPMPGCHGVVAPSSDDIFKLAEANACWALEDLRCMEEDTFIRTVELLGAVQGFSRPQLMTLKEKAIQVWDMPSYWREHHIVSLGRIALALNESELEQLDLSSIDTVASLSWQTEWTPGQAESILQGYLDDSGYSIQDLKSFHLVGLGATLCAINITEIPLIKISEFRVVVARIGTLLCSTHVLAEFKRKAEVVFGDPTEWTSSVLQELGTIAAGLTKAELRMLDKDLMPYFQPSAIKCLPDEIFKELSAEQIASLGPENAAAVTHAQRRRLSPLQLQSLQQALDGAKTHSWQDAPASAGPTRTSSSRSPAGALQSWGLWLGCPLLVLMAKLLW

SEQ ID NO: 9864 - protein, 1060 aa, Homo Sapiens
MGNSITYRDQAAVENHLEQRLHQPQKLLEDLRKTDAQQFRTAMKCLLEDKKDGLDLKDIIIDLGEIRERALQSPGVNRSLFLITLERCFQMLNSLECVEILGKVLRGSSGSFLQPDITERLPRDLREDAFKNLSAVFKDLYDKTSAHSQRALYSWMTGILQTSSNATDDSASWVSAEHLWVLGRYMVHLSFEEITKISPIEIGLFISYDNATKQLDMVYDITPELAQAFLERISSSNFNMRNTSTIHRLGLLVCFYNDLELLDATVAQVLLYQMIKCSHLRGFQAGVQKLKAELLDIAMENQTLNETLGSLSDAVVGLTYSQLESLSPEAVHGAISTLNQVSGWAKSQVIILSAKYLAHEKVLSFYNVSQMGALLAGVSTQAFCSMKRKDISQVLRSAVSQYVSDLSPAQQQGILSKMVQAEDTAPGIVEIQGAFFKEVSLFDLRRQPGFNSTVLKDKELGRSQALFLYELLLKTTRRPEELLSAGQLVKGVTCSHIDAMSTDFFLAHFQDFQNNFALLSPYQVNCLAWKYWEVSRLSMPPFLLAALPARYLASVPASQCVPFLISLGKSWLDSLVLDSHKKTSVLRKVQQCLDDSIADEYTVDIMGNLLCHLPAAIIDRGISPRAWATALHGLRDCPDLNPEQKAAVRLKLLGQYGLPQHWTAETTKDLGPFLVLFSGDELSSIATKFPEILLQAASKMARTLPTKEFLWAVFQSVRNSSDKIPSYDPMPGCHGVVAPSSDDIFKLAEANACWALEDLRCMEEDTFIRTVELLGAVQGFSRPQLMTLKEKAIQVWDMPSYWREHHIVSLGRIALALNESELEQLDLSSIDTVASLSWQTEWTPGQAESILQGYLDDSGYSIQDLKSFHLVGLGATLCAINITEIPLIKISEFRVVVARIGTLLCSTHVLAEFKRKAEVVFGDPTEWTSSVLQELGTIAAGLTKAELRMLDKDLMPYFQPSAIKCLPDEIFKELSAEQIASLGPENAAAVTHAQRRRLSPLQLQSLQQALDGAKTHSWQDAPASAGPTRTSSSRSPAGALQSWGLWLGCPLLVLMAKLLW

SEQ ID NO: 9865 - protein, 1153 aa, Homo Sapiens
MSQEPTTYSLFLFLFLSHGVSSYTVPNSRQDLHPLLQNMAEEIIDGSYLNALLDLIQFQSSHVWTDDLSHRVLAYLNSRNVAFTIPSLQAAVENHLEQRLHQPQKLLEDLRKTDAQQFRTAMKCLLEDKKDGLDLKDIIIDLGEIRERALQSPGVNRSLFLITLERCFQMLNSLECVEILGKVLRGSSGSFLQPDITERLPRDLREDAFKNLSAVFKDLYDKTSAHSQRALYSWMTGILQTSSNATDDSASWVSAEHLWVLGRYMVHLSFEEITKISPIEIGLFISYDNATKQLDMVYDITPELAQAFLERISSSNFNMRNTSTIHRQAHELWALEPFPKMLGLLVCFYNDLELLDATVAQVLLYQMIKCSHLRGFQAGVQKLKAELLDIAMENQTLNETLGSLSDAVVGLTYSQLESLSPEAVHGAISTLNQVSGWAKSQVIILSAKYLAHEKVLSFYNVSQMGALLAGVSTQAFCSMKRKDISQVLRSAVSQYVSDLSPAQQQGILSKMVQAEDTAPGIVEIQGAFFKEVSLFDLRRQPGFNSTVLKDKELGRSQALFLYELLLKTTRRPEELLSAGQLVKGVTCSHIDAMSTDFFLAHFQDFQNNFALLSPYQVNCLAWKYWEVSRLSMPPFLLAALPARYLASVPASQCVPFLISLGKSWLDSLVLDSHKKTSVLRKVQQCLDDSIADEYTVDIMGNLLCHLPAAIIDRGISPRAWATALHGLRDCPDLNPEQKAAVRLKLLGQYGLPQHWTAETTKDLGPFLVLFSGDELSSIATKFPEILLQAASKMARTLPTKEFLWAVFQSVRNSSDKIPSYDPMPGCHGVVAPSSDDIFKLAEANACWALEDLRCMEEDTFIRTVELLGAVQGFSRPQLMTLKEKAIQVWDMPSYWREHHIVSLGRIALALNESELEQLDLSSIDTVASLSWQTEWTPGQAESILQGYLDDSGYSIQDLKSFHLVGLGATLCAINITEIPLIKISEFRVVVARIGTLLCSTHVLAEFKRKAEVVFGDPTEWTSSVLQELGTIAAGLTKAELRMLDKDLMPYFQPSAIKCLPDEIFKELSAEQIASLGPENAAAVTHAQRRRLSPLQLQSLQQALDGAKTHSWQDAPASAGPTRTSSSRSPAGALQSWGLWLGCPLLVLMAKLLW

SEQ ID NO: 9866 - protein, 1139 aa, Homo Sapiens
MSQEPTTYSLFLFLFLSHGVSSYTVPNSRQDLHPLLQNMAEEIIDGSYLNALLDLIQFQSSHVWTDDLSHRVLAYLNSRNVAFTIPSLQAAVENHLEQRLHQPQKLLEDLRKTDAQQFRTAMKCLLEDKKDGLDLKDIIIDLGEIRERALQSPGVNRSLFLITLERCFQMLNSLECVEILGKVLRGSSGSFLQPDITERLPRDLREDAFKNLSAVFKDLYDKTSAHSQRALYSWMTGILQTSSNATDDSASWVSAEHLWVLGRYMVHLSFEEITKISPIEIGLFISYDNATKQLDMVYDITPELAQAFLERISSSNFNMRNTSTIHRLGLLVCFYNDLELLDATVAQVLLYQMIKCSHLRGFQAGVQKLKAELLDIAMENQTLNETLGSLSDAVVGLTYSQLESLSPEAVHGAISTLNQVSGWAKSQVIILSAKYLAHEKVLSFYNVSQMGALLAGVSTQAFCSMKRKDISQVLRSAVSQYVSDLSPAQQQGILSKMVQAEDTAPGIVEIQGAFFKEVSLFDLRRQPGFNSTVLKDKELGRSQALFLYELLLKTTRRPEELLSAGQLVKGVTCSHIDAMSTDFFLAHFQDFQNNFALLSPYQVNCLAWKYWEVSRLSMPPFLLAALPARYLASVPASQCVPFLISLGKSWLDSLVLDSHKKTSVLRKVQQCLDDSIADEYTVDIMGNLLCHLPAAIIDRGISPRAWATALHGLRDCPDLNPEQKAAVRLKLLGQYGLPQHWTAETTKDLGPFLVLFSGDELSSIATKFPEILLQAASKMARTLPTKEFLWAVFQSVRNSSDKIPSYDPMPGCHGVVAPSSDDIFKLAEANACWALEDLRCMEEDTFIRTVELLGAVQGFSRPQLMTLKEKAIQVWDMPSYWREHHIVSLGRIALALNESELEQLDLSSIDTVASLSWQTEWTPGQAESILQGYLDDSGYSIQDLKSFHLVGLGATLCAINITEIPLIKISEFRVVVARIGTLLCSTHVLAEFKRKAEVVFGDPTEWTSSVLQELGTIAAGLTKAELRMLDKDLMPYFQPSAIKCLPDEIFKELSAEQIASLGPENAAAVTHAQRRRLSPLQLQSLQQALDGAKTHSWQDAPASAGPTRTSSSRSPAGALQSWGLWLGCPLLVLMAKLLW

SEQ ID NO: 9867 - protein, 1139 aa, Homo Sapiens; identical to SEQ ID NO: 9866

SEQ ID NO: 9868 - protein, 353 aa, Homo Sapiens
MSQEPTTYSLFLFLFLSHGVSSYTVPNSRQDLHPLLQNMAEEIIDGSYLNALLDLIQFQSSHVWTDDLSHRVLAYLNSRNVAFTIPSLQAAVENHLEQRLHQPQKLLEDLRKTDAQQFRTAMKCLLEDKKDGLDLKDIIIDLGEIRERALQSPGVNRSLFLITLERCFQMLNSLECVEILGKVLRGSSGSFLQPDITERLPRDLREDAFKNLSAVFKDLYDKTSAHSQRALYSWMTGILQTSSNATDDSASWVSAEHLWVLGRYMVHLSFEEITKISPIEIGLFISYDNATKQLDMVYDITPELAQAFLERISSSNFNMRNTSTIHSSKQNSWTLPWRTRPSMRPWVLCRMQL

SEQ ID NO: 9869 - protein, 94 aa, Homo Sapiens
AMGDKATVVGGQAEAPDSVAMSSWERRLHRAKCAPSYLFSCFNGGECVHPAFCDCRRFNATGPRCQMVYNAGPERDSICRAWGQHHVETFDGLY

SEQ ID NO: 9870 - protein, 2913 aa, Homo Sapiens
MGVLASALCWLLCVWLPWGEQAAESLRVQRLAAAPVLWGSAEPQPEPAGQPSSSHQEATLAMGDKATVVGGQQAEAPDSVAMSSWERRLHRAKCAPSYLFSCFNGGECVHPAFCDCRRFNATGPRCQMVYNAGPERDSICRAWGQHHVETFDGLYYYLSGKGSYTLVGRHEPEGQSFSIQVHNDPQCGSSPYTCSRAVSLFFVGEQEIHLAKEVTHGGMRVQLPHVMGSARLQQLAGYVIVRHQSAFTLAWDGASAVYIKMSPELLGWTHGLCGNNNADPKDDLVTSSGKLTDDVVEFVHSWQEQAPNQPPGPTTSSLPRPPCLQQNPGTMQGVYEQCEALLRPPFDACHAYVSPLPFTASCTSDLCQSMGDVATWCRALAEYARACAQAGRPLQGWRTQLRQCTVHCKEKAFTYNECIACCPASCHPRASCVDSEIACVDGCYCPNGLIFEDGGCVAPAECPCEFHGTLYPPGSVVKEDCNTCTCTSGKWECSTAVCPAECSVTGDIHFTTFDGRRYTFPATCQYILAKSRSSGTFTVTLQNAPCGLNQDGACVQSVSVILHQDPRRQVTLTQAGDVLLFDQYKIIPPYTDDAFEIRRLSSVFLRVRTNVGVRVLYDREGLRLYLQVDQRWVEDTVGLCGTFNGNTQDDFLSPVGVPESTPQLFGNSWKTLSACSPLVSGSPLDPCDVHLQAASYSVQACSVLTGEMFAPCSAFLSPVPYFEQCRRDACRCGQPCLCATLAHYAHLCRRHGLPVDFRARLPACALSCEASKEYSPCVAPCGRTCQDLASPEACGVDGGDDLSRDECVEGCACPPDTYLDTQADLCVPRNQCSCHFQGVDYPPGDSDIPSLGHCHCKDGVMSCDSRAPAAACPAGQVFVNCSDLHTDLELSRERTCEQQLLNLSVSARGPCLSGCACPQGLLRHGDACFLPEECPCTWKGKEYFPGDQVMSPCHTCVCQRGSFQCTLHPCASTCTAYGDRHYRTFDGLPFDFVGACKVHLVKSTSDVSFSVIVENVNCYSSGMICRKFISINVGNSLIVFDDDSGNPSPESFLDDKQEVHTWRVGFFTLVHFPQEHITLLWDQRTTVHVQAGPQWQGQLAGLCGNFDLKTINEMRTPENLELTNPQEFGSSWAAVECPDTLDPRDMCVLNPLREPFAKKECSILLSEVFEICHPVVDVTWFYSNCLTDTCGCSQGGDCECFCASVSAYAHQCCQHGVAVDWRTPRLCPYDCDFFNKVLGKGPYQLSSLAAGGALVGMKAVGDDIVLVRTEDVAPADIVSFLLTAALYKAKAHDPDVVSLEAADRPNFFLHVTANGSLELAKWQGRDTFQQHASFLLHRGTRQAGLVALESLAKPSSFLYVSGAVLALRLYEHTEVFRRGTLFRLLDAKPSGAAYPICEWRYDACASPCFQTCRDPRAASCRDVPRVEGCVPVCPTPQVLDEVTQRCVYLEDCVEPAVWVPTEALGNETLPPSQGLPTPSDEEPQLSQESPRTPTHRPALTPAAPLTTALNPPVTATEEPVVSPGPTQTTLQQPLELTASQLPAGPTESPASKGVTASLLAIPHTPESSSLPVALQTPTPGMVSGAMETTRVTVIFAGSPNITVSSRSPPAPRFPLMTKAVTVRGHGSLPVRTTPPQPSLTASPSSRPVASPGAISRSPTSSGSHKAVLTPAVTKVISRTGVPQPTQAQSASSPSTPLTVAGTAAEQVPVSPLATRSLEIVLSTEKGEAGHSQPMGSPASPQPHPLPSAPPRPAQHTTMATRSPALPPETPAAASLSTATDGLAATPFMSLESTRPSQLLSGLPPDTSLPLAKVGTSAPVATPGPKASVITTPLQPQATTLPAQTLSPVLPFTPAAMTQAHPPTHIAPPAAGTAPGLLLGATLPTSGVLPVAEGTASMVSVVPRKSTTGKVAILSKQVSLPTSMYGSAEGGPTELTPATSHPLTPLVAEPEGAQAGTALPVPTSYALSRVSARTAPQDSMLVLLPQLAEAHGTSAGPHLAAEPVDEATTEPSGRSAPALSIVEGLAEALATTTEANTSTTCVPIAEQDCVRHICLEGQLIRVNQSQHCPQGAAPPRCGILGLAVRVGGDRCCPLWECACRCSIFPDLSFVTFDGSHVALFKEAIYILSQSPDEMLTVHVLDCKSANLGHLNWPPFCLVMLNMTHLAHQVTIDRFNRKVTVDLQPVWPPVSRYGFRIEDTGHMYMILTPSDIQIQWLHSSGLMIVEASKTSKAQGHGLCGICDGDAANDLTLKDGSVVGGAEDPAPFLDSWQVPSSLTSVGQTRFRPDSCATTDCSPCLRMVSNRTFSACHRFVPPESFCELWIRDTKYVQQPCVALTVYVAMCHKFHVCIEWRRSDYCPFLCSSDSTYQACVTACEPPKTCQDGILGPLDPEHCQVLGEGCVCSEGTILHRRHSALCIPEAKCACTDSMGVPRALGETWNSSLSGCCQHQCQAPDTIVPVDLGCPSPRPESCLRFGEVALLLPTKDPCCLGTVCVCNQTLCEGLAPTCRPGHRLLTHFQEDSCCPSYSCECDPDLCEAELVPSCRQDQILITGRLGDSCCTSYFCACGDCPDSIPECQEGEALTVHRNTTELCCPLYQCVCENFRCPQVQCGLGTALVEVWSPDRCCPYKSCECDCDTIPVPRCHLWEKSQLDEEFMHSVENVCGCAKYECVKAPVCLSRELGVMQPGQTVVELSADGVCHTSRCTTVLDPLTNFYQINTTSVLCDIHCEANQEYEHPRDLAACCGSCRNVSCLFTFPNGTTSLFLPGASWIADCARHHCSSTPLGAVLVRSPISCPPLNETECAKVGGSVVPSLEGCCRTCKEDGRSCKKVTIRMTIRKNECRSSTPVNLVSCDGRCPSASIYNYNINTYARFCKCCREVGLQRRSVQLFCATNATWVPYTVQEPTDCACQWS

SEQ ID NO: 9871 - protein, 2925 aa, Homo Sapiens
MGVLASALCWLLCVWLPWGEQAAESLRVQRLGERVVDSGRSGARGMRNVKGMRNGPAQTRVSSSSSHQEATLAMGDKATVVGGQQAEAPDSVAMSSWERRLHRAKCAPSYLFSCFNGGECVHPAFCDCRRFNATGPRCQMVYNAGPERDSICRAWGQHHVETFDGLYYYLSGKGSYTLVGRHEPEGQSFSIQVHNDPQCGSSPYTCSRAVSLFFVGEQEIHLAKEVTHGGMRVQLPHVMGSARLQQLAGYVIVRHQSAFTLAWDGASAVYIKMSPELLGWTHGLCGNNNADPKDDLVTSSGKLTDDVVEFVHSWQEQAPNQPPGPTTSSLPRPPCLQQNPGTMQGVYEQCEALLRPPFDACHAYVSPLPFTASCTSDLCQSMGDVATWCRALAEYARACAQAGRPLQGWRTQLRQCTVHCKEKAFTYNECIACCPASCHPRASCVDSEIACVDGCYCPNGLIFEDGGCVAPAECPCEFHGTLYPPGSVVKEDCNTCTCTSGKWECSTAVCPAECSVTGDIHFTTFDGRRYTFPATCQYILAKSRSSGTFTVTLQNAPCGLNQDGACVQSVSVILHQDPRRQVTLTQAGDVLLFDQYKIIPPYTDDAFEIRRLSSVFLRVRTNVGVRVLYDREGLRLYLQVDQRWVEDTVGLCGTFNGNTQDDFLSPVGVPESTPQLFGNSWKTLSACSPLVSGSPLDPCDVHLQAASYSVQACSVLTGEMFAPCSAFLSPVPYFEQCRRDACRCGQPCLCATLAHYAHLCRRHGLPVDFRARLPACALSCEASKEYSPCVAPCGRTCQDLASPEACGVDGGDDLSRDECVEGCACPPDTYLDTQADLCVPRNQCSCHFQGVDYPPGDSDIPSLGHCHCKDGVMSCDSRAPAAACPAGQVFVNCSDLHTDLELSRERTCEQQLLNLSVSARGPCLSGCACPQGLLRHGDACFLPEECPCTWKGKEYFPGDQVMSPCHTCVCQRGSFQCTLHPCASTCTAYGDRHYRTFDGLPFDFVGACKVHLVKSTSDVSFSVIVENVNCYSSGMICRKFISINVGNSLIVFDDDSGNPSPESFLDDKQEVHTWRVGFFTLVHFPQEHITLLWDQRTTVHVQAGPQWQGQLAGLCGNFDLKTINEMRTPENLELTNPQEFGSSWAAVECPDTLDPRDMCVLNPLREPFAKKECSILLSEVFEICHPVVDVTWFYSNCLTDTCGCSQGGDCECFCASVSAYAHQCCQHGVAVDWRTPRLCPYDCDFFNKVLGKGPYQLSSLAAGGALVGMKAVGDDIVLVRTEDVAPADIVSFLLTAALYKAKAHDPDVVSLEAADRPNFFLHVTANGSLELAKWQGRDTFQQHASFLLHRGTRQAGLVALESLAKPSSFLYVSGAVLALRLYEHTEVFRRGTLFRLLDAKPSGAAYPICEWRYDACASPCFQTCRDPRAASCRDVPRVEGCVPVCPTPQVLDEVTQRCVYLEDCVEPAVWVPTEALGNETLPPSQGLPTPSDEEPQLSQESPRTPTHRPALTPAAPLTTALNPPVTATEEPVVSPGPTQTTLQQPLELTASQLPAGPTESPASKGVTASLLAIPHTPESSSLPVALQTPTPGMVSGAMETTRVTVIFAGSPNITVSSRSPPAPRFPLMTKAVTVRGHGSLPVRTTPPQPSLTASPSSRPVASPGAISRSPTSSGSHKAVLTPAVTKVISRTGVPQPTQAQSASSPSTPLTVAGTAAEQVPVSPLATRSLEIVLSTEKGEAGHSQPMGSPASPQPHPLPSAPPRPAQHTTMATRSPALPPETPAAASLSTATDGLAATPFMSLESTRPSQLLSGLPPDTSLPLAKVGTSAPVATPGPKASVITTPLQPQATTLPAQTLSPVLPFTPAAMTQAHPPTHIAPPAAGTAPGLLLGATLPTSGVLPVAEGTASMVSVVPRKSTTGKVAILSKQVSLPTSMYGSAEGGPTELTPATSHPLTPLVAEPEGAQAGTALPVPTSYALSRVSARTAPQDSMLVLLPQLAEAHGTSAGPHLAAEPVDEATTEPSGRSAPALSIVEGLAEALATTTEANTSTTCVPIAEQDCVRHICLEGQLIRVNQSQHCPQGAAPPRCGILGLAVRVGGDRCCPLWECACRCSIFPDLSFVTFDGSHVALFKEAIYILSQSPDEMLTVHVLDCKSANLGHLNWPPFCLVMLNMTHLAHQVTIDRFNRKVTVDLQPVWPPVSRYGFRIEDTGHMYMILTPSDIQIQWLHSSGLMIVEASKTSKAQGHGLCGICDGDAANDLTLKDGSVVGGAEDPAPFLDSWQVPSSLTSVGQTRFRPDSCATTDCSPCLRMVSNRTFSACHRFVPPESFCELWIRDTKYVQQPCVALTVYVAMCHKFHVCIEWRRSDYCPFLCSSDSTYQACVTACEPPKTCQDGILGPLDPEHCQVLGEGCVCSEGTILHRRHSALCIPEAKCACTDSMGVPRALGETWNSSLSGCCQHQCQAPDTIVPVDLGCPSPRPESCLRFGEVALLLPTKDPCCLGTVCVCNQTLCEGLAPTCRPGHRLLTHFQEDSCCPSYSCECDPDLCEAELVPSCRQDQILITGRLGDSCCTSYFCACGDCPDSIPECQEGEALTVHRNTTELCCPLYQCVCENFRCPQVQCGLGTALVEVWSPDRCCPYKSCECDCDTIPVPRCHLWEKSQLDEEFMHSVENVCGCAKYECVKAPVCLSRELGVMQPGQTVVELSADGVCHTSRCTTVLDPLTNFYQINTTSVLCDIHCEANQEYEHPRDLAACCGSCRNVSCLFTFPNGTTSLFLPGASWIADCARHHCSSTPLGAVLVRSPISCPPLNETECAKVGGSVVPSLEGCCRTCKEDGRSCKKVTIRMTIRKNECRSSTPVNLVSCDGRCPSASIYNYNINTYARFCKCCREVGLQRRSVQLFCATNATWVPYTVQEPTDCACQWS

SEQ ID NO: 9872 - protein, 71 aa, Homo Sapiens
GEFLTVDLNSTHFCCPQYYCVCEPNLCPMPLLNCAEDMNLVKENVSGQCCPTWHCECNCENLIMPTCEVIS

SEQ ID NO: 9873 - protein, 2344 aa, Homo Sapiens
MIPWSIFLLHVLLFSLQEYICASSILMGTSKNGFNENRQKRALLAAQFEATSPRYFFHDAINWGESKIKGSCPYECLNGAFCSKTGTCDCQIFQALGTRCQIIPNMGNGRDGICKTWGQYHFETFDGIYYYFPGNCSYIFAKDCGDLEPRYTVWVHNSPKCLGSVYSCYRSISLFFSNQEEIRIYGHEIKKNGISLTLPQTIGQIFIEKLADYILVKTTFGFSLAWDGISGIYLKLSEDHKGKSCGLCGNYNDIQSDDFIILQEDYTEDIAMFANSWSVQTPDDTKCVLTPSDFPNPCSSGMPAFEAIFFKCQILLQFPFLSCHEYIDPYLYIASCVNDLCKTDDDETYCRAATEYARACSHAGYPIQDWRDDFPACTDKCDDSFVHRDCISCCPPTCTFEKQCLGSNLHCLDGCYCPDGLVMDNGTCISLENCPCGFHGLAYSVGSKIEQECTECVCVGGVWNCTEQDCPVQCSVVGDSHFTTFDGRHYSFIGMCQYILVKGTGKDKFTITLQKAPCEQNLGLVCLQSITLILEDDFNKQVTLGRGGQILTSPNQGFNLNGIVEIQTLSSLFILLKTTFGLKILFAIDGERIYIQLTSAWKRRTLGLCGTFNGNIRDDFLSPSGMIEGTPQLHANAWRVSSTCFAPVHVPVVDPCNINQQNIGYAAHCDVIHQELFAPCHIYISPGLYYQLCRHDACKCGSSCLCNALAHYAYLCGQHGVPIDFRTQISFCAVVCQKGMLYHHCSSFCLHSCISLSSPEQCSDDCAEGCNCPEGKFYEDTLNFCVPIFHCRCHYRGSVYQPGELIPTPSGLCQCSNGTVKCDELATPSAVHICPEGKEYFDCRFPDPELPAGGVNCETTCANLAMNFTCTPSSPCISGCVCAPGMAEHRGKCYVPESCPCIWKDWEYLSGEVIATPCYTCVCRRGMFNCTYYPCPAVCTIYGDRHYYSFDGLEYDYISDCQVFLIKSADDSDISVIAQNKKCFDNDIVCSKSVLISVGDTEIYLNDTPYKQKQSGFFLENKSTYQLWKAGYYIVVYFPEKDITILWDRKTTIHIKVGPQWKNKLSGLCGNFDKCTSNDMTTSNNLEVRNARVFGDSWALGQCESPDETIKPCEAHQNKFPYAKKECSILYSDIFASCRNVIDVTSFAKNCHEDTCNCNLGGDCECLCTSIAAYAYKCCQEGISIHWRSSTVCSLDCEYYNEGLGEGPYMLASYGQSGLVLGANMTSRSVFCLPRSSVHTSLFFYFMITPGLFKEKVSSLALVSLESAERPNYFLYVHDNDTLSLELWEANSAFHRRATFFHHQGLWIPGYSAFELYSKKGFFIIFTDSSVKASKYDDSEEFKHSSSFSIEEIQAAVPYRKMCEWRYEPCATPCFKTCSDPEALACKFLPPVEGCLPYCPKNMILDEVTLKCVYPRDCIPVIPTEPTLMPPAKPTVPMFTVWEMITPSDITVFDMLTPTTGLECEPQKFDPVYDCSQYICLNMEWQLYNWSLNCPKDVEMPDCGFRGRPVQVNSDICCPEWECPCRCSMLSELSIITFDGNNAALYSMASYILVRIPGEIIVAHIEKCSMNQNGNSLKKLAPSGRISGLCFKKLNVTTPIHKIIVNRLARKVEVDSIVVPLPFSSQELSIEDSGSMYVITTPAGLIIKWSHLTGIIDIHFGFRFNLSSYTEGLCGICNEDPDDDLRMQNGTIITNMEDIGLFIESWEIEKSFEVTMRRPVRNCTEHDCSQCIDLLNRRIFIPCHDKVSPEDFCEKMWINYTYFWNYECDALSAYVALCNKFDICIQWRTPDYCSLSCPEGKEYQPCVRPCEARTCLNQWFYGHTSCLNLREDCVCKVGTILHRPHSAQCIPEKECACTDSEDQPRTAGEIWNGGIDECTLYKCLENGSIIPIEPDCDEEPTPVCEREAEVVMGIIDKWTCCSKEVCGCDTTLCETSIPTCTNSQKLIVGHSPLSCCPQYKCECDPLKCPSISTPECREDQFMIQVRQEEPCCFSPFCVCESCTKPVPLCHDGEFLTVDLNSTHFCCPQYYCVCEPNLCPMPLLNCAEDMNLVKENVSGQCCPTWHCECNCENLIMPTCEVGEFTAIDHNFQSDCGCIQYLCEKDDVCVFQEVSVLNPGQSMIKYLEEDFCYAIECLEEKDNHTGFHTLNFTLVNCSKKCDVHQVYTPSPSDYGCCGTCKNVSCKFHMENGTSVVYAVGSTWHYNCTTYECVKTDEGAIILNYTMVCPPFNETECKMNEGIVKLYNEGCCKICKREERICQKVIIKSVIRKQDCMSQSPINVASCDGKCPSATIYNINIESHLRFCKCCRENGVRNLSVPLYCSGNGTEIMYTLQEPIDCTCQWN

SEQ ID NO: 9874 - protein, 2353 aa, Homo Sapiens
MNIVRKLNLMIPWSIFLLHVLLFSLQEYICASSILMGTSKNGFNENRQKRALLAAQFEATSPRYFFHDAINWGESKIKGSCPYECLNGAFCSKTGTCDCQIFQALGTRCQIIPNMGNGRDGICKTWGQYHFETFDGIYYYFPGNCSYIFAKDCGDLEPRYTVWVHNSPKCLGSVYSCYRSISLFFSNQEEIRIYGHEIKKNGISLTLPQTIGQIFIEKLADYILVKTTFGFSLAWDGISGIYLKLSEDHKGKSCGLCGNYNDIQSDDFIILQEDYTEDIAMFANSWSVQTPDDTKCVLTPSDFPNPCSSGMPAFEAIFFKCQILLQFPFLSCHEYIDPYLYIASCVNDLCKTDDDETYCRAATEYARACSHAGYPIQDWRDDFPACTDKCDDSFVHRDCISCCPPTCTFEKQCLGSNLHCLDGCYCPDGLVMDNGTCISLENCPCGFHGLAYSVGSKIEQECTECVCVGGVWNCTEQDCPVQCSVVGDSHFTTFDGRHYSFIGMCQYILVKGTGKDKFTITLQKAPCEQNLGLVCLQSITLILEDDFNKQVTLGRGGQILTSPNQGFNLNGIVEIQTLSSLFILLKTTFGLKILFAIDGERIYIQLTSAWKRRTLGLCGTFNGNIRDDFLSPSGMIEGTPQLHANAWRVSSTCFAPVHVPVVDPCNINQQNIGYAAHCDVIHQELFAPCHIYISPGLYYQLCRHDACKCGSSCLCNALAHYAYLCGQHGVPIDFRTQISFCAVVCQKGMLYHHCSSFCLHSCISLSSPEQCSDDCAEGCNCPEGKFYEDTLNFCVPIFHCRCHYRGSVYQPGELIPTPSGLCQCSNGTVKCDELATPSAVHICPEGKEYFDCRFPDPELPAGGVNCETTCANLAMNFTCTPSSPCISGCVCAPGMAEHRGKCYVPESCPCIWKDWEYLSGEVIATPCYTCVCRRGMFNCTYYPCPAVCTIYGDRHYYSFDGLEYDYISDCQVFLIKSADDSDISVIAQNKKCFDNDIVCSKSVLISVGDTEIYLNDTPYKQKQSGFFLENKSTYQLWKAGYYIVVYFPEKDITILWDRKTTIHIKVGPQWKNKLSGLCGNFDKCTSNDMTTSNNLEVRNARVFGDSWALGQCESPDETIKPCEAHQNKFPYAKKECSILYSDIFASCRNVIDVTSFAKNCHEDTCNCNLGGDCECLCTSIAAYAYKCCQEGISIHWRSSTVCSLDCEYYNEGLGEGPYMLASYGQSGLVLGANMTSRSVFCLPRSSVHTSLFFYFMITPGLFKEKVSSLALVSLESAERPNYFLYVHDNDTLSLELWEANSAFHRRATFFHHQGLWIPGYSAFELYSKKGFFIIFTDSSVKASKYDDSEEFKHSSSFSIEEIQAAVPYRKMCEWRYEPCATPCFKTCSDPEALACKFLPPVEGCLPYCPKNMILDEVTLKCVYPRDCIPVIPTEPTLMPPAKPTVPMFTVWEMITPSDITVFDMLTPTTGLECEPQKFDPVYDCSQYICLNMEWQLYNWSLNCPKDVEMPDCGFRGRPVQVNSDICCPEWECPCRCSMLSELSIITFDGNNAALYSMASYILVRIPGEIIVAHIEKCSMNQNGNSLKKLAPSGRISGLCFKKLNVTTPIHKIIVNRLARKVEVDSIVVPLPFSSQELSIEDSGSMYVITTPAGLIIKWSHLTGIIDIHFGFRFNLSSYTEGLCGICNEDPDDDLRMQNGTIITNMEDIGLFIESWEIEKSFEVTMRRPVRNCTEHDCSQCIDLLNRRIFIPCHDKVSPEDFCEKMWINYTYFWNYECDALSAYVALCNKFDICIQWRTPDYCSLSCPEGKEYQPCVRPCEARTCLNQWFYGHTSCLNLREDCVCKVGTILHRPHSAQCIPEKECACTDSEDQPRTAGEIWNGGIDECTLYKCLENGSIIPIEPDCDEEPTPVCEREAEVVMGIIDKWTCCSKEVCGCDTTLCETSIPTCTNSQKLIVGHSPLSCCPQYKCECDPLKCPSISTPECREDQFMIQVRQEEPCCFSPFCVCESCTKPVPLCHDGEFLTVDLNSTHFCCPQYYCVCEPNLCPMPLLNCAEDMNLVKENVSGQCCPTWHCECNCENLIMPTCEVGEFTAIDHNFQSDCGCIQYLCEKDDVCVFQEVSVLNPGQSMIKYLEEDFCYAIECLEEKDNHTGFHTLNFTLVNCSKKCDVHQVYTPSPSDYGCCGTCKNVSCKFHMENGTSVVYAVGSTWHYNCTTYECVKTDEGAIILNYTMVCPPFNETECKMNEGIVKLYNEGCCKICKREERICQKVIIKSVIRKQDCMSQSPINVASCDGKCPSATIYNINIESHLRFCKCCRENGVRNLSVPLYCSGNGTEIMYTLQEPIDCTCQWN

SEQ ID NO: 9875 - protein, 2308 aa, Homo Sapiens
MNIVRKLNLMIPWSIFLLHVLLFSLQEYICASSILMGTSKNGFNENRQKRALLAAQFEATSPRYFFHDAINWGESKIKGSCPYECLNGAFCSKTGTCDCQIFQALGTRCQIIPNMGNGRDGICKTWGQYHFETFDGIYYYFPGNCSYIFAKDCGDLEPRYTVWVHNSPKCLGSVYSCYRSISLFFSNQEEIRIYGHEIKKNGISLTLPQTIGQIFIEKLADYILVKTTFGFSLAWDGISGIYLKLSEDHKGKSCGLCGNYNDIQSDDFIILQEDYTEDIAMFANSWSVQTPDDTKCVLTPSDFPNPCSSGMPAFEAIFFKCQILLQFPFLSCHEYIDPYLYIASCVNDLCKTDDDETYCRAATEYARACSHAGYPIQDWRDDFPACTDKCDDSFVHRDCISCCPPTCTFEKQCLGSNLHCLDGCYCPDGLVMDNGTCISLENCPCGFHGLAYSVGSKIEQECTECVCVGGVWNCTEQDCPVQCSVVGDSHFTTFDGRHYSFIGMCQYILVKGTGKDKFTITLQKAPCEQNLGLVCLQSITLILEDDFNKQVTLGRGGQILTSPNQGFNLNGIVEIQTLSSLFILLKTTFGLKILFAIDGERIYIQLTSAWKRRTLGLCGTFNGNIRDDFLSPSGMIEGTPQLHANAWRVSSTCFAPVHVPVVDPCNINQQNIGYAAHCDVIHQELFAPCHIYISPGLYYQLCRHDACKCGSSCLCNALAHYAYLCGQHGVPIDFRTQISFCAVVCQKGMLYHHCSSFCLHSCISLSSPEQCSDDCAEGCNCPEGKFYEDTLNFCVPIFHCRCHYRGSVYQPGELIPTPSGLCQCSNGTVKCDELATPSAVHICPEGKEYFDCRFPDPELPAGGVNCETTCANLAMNFTCTPSSPCISGCVCAPGMAEHRGKCYVPESCPCIWKDWEYLSGEVIATPCYTCVCRRGMFNCTYYPCPAVCTIYGDRHYYSFDGLEYDYISDCQVFLIKKQSGFFLENKSTYQLWKAGYYIVVYFPEKDITILWDRKTTIHIKVGPQWKNKLSGLCGNFDKCTSNDMTTSNNLEVRNARVFGDSWALGQCESPDETIKPCEAHQNKFPYAKKECSILYSDIFASCRNVIDVTSFAKNCHEDTCNCNLGGDCECLCTSIAAYAYKCCQEGISIHWRSSTVCSLDCEYYNEGLGEGPYMLASYGQSGLVLGANMTSRSVFCLPRSSVHTSLFFYFMITPGLFKEKVSSLALVSLESAERPNYFLYVHDNDTLSLELWEANSAFHRRATFFHHQGLWIPGYSAFELYSKKGFFIIFTDSSVKASKYDDSEEFKHSSSFSIEEIQAAVPYRKMCEWRYEPCATPCFKTCSDPEALACKFLPPVEGCLPYCPKNMILDEVTLKCVYPRDCIPVIPTEPTLMPPAKPTVPMFTVWEMITPSDITVFDMLTPTTGLECEPQKFDPVYDCSQYICLNMEWQLYNWSLNCPKDVEMPDCGFRGRPVQVNSDICCPEWECPCRCSMLSELSIITFDGNNAALYSMASYILVRIPGEIIVAHIEKCSMNQNGNSLKKLAPSGRISGLCFKKLNVTTPIHKIIVNRLARKVEVDSIVVPLPFSSQELSIEDSGSMYVITTPAGLIIKWSHLTGIIDIHFGFRFNLSSYTEGLCGICNEDPDDDLRMQNGTIITNMEDIGLFIESWEIEKSFEVTMRRPVRNCTEHDCSQCIDLLNRRIFIPCHDKVSPEDFCEKMWINYTYFWNYECDALSAYVALCNKFDICIQWRTPDYCSLSCPEGKEYQPCVRPCEARTCLNQWFYGHTSCLNLREDCVCKVGTILHRPHSAQCIPEKECACTDSEDQPRTAGEIWNGGIDECTLYKCLENGSIIPIEPDCDEEPTPVCEREAEVVMGIIDKWTCCSKEVCGCDTTLCETSIPTCTNSQKLIVGHSPLSCCPQYKCECDPLKCPSISTPECREDQFMIQVRQEEPCCFSPFCVCESCTKPVPLCHDGEFLTVDLNSTHFCCPQYYCVCEPNLCPMPLLNCAEDMNLVKENVSGQCCPTWHCECNCENLIMPTCEVGEFTAIDHNFQSDCGCIQYLCEKDDVCVFQEVSVLNPGQSMIKYLEEDFCYAIECLEEKDNHTGFHTLNFTLVNCSKKCDVHQVYTPSPSDYGCCGTCKNVSCKFHMENGTSVVYAVGSTWHYNCTTYECVKTDEGAIILNYTMVCPPFNETECKMNEGIVKLYNEGCCKICKREERICQKVIIKSVIRKQDCMSQSPINVASCDGKCPSATIYNINIESHLRFCKCCRENGVRNLSVPLYCSGNGTEIMYTLQEPIDCTCQWN

SEQ ID NO: 9876 - protein, 101 aa, Homo Sapiens
NFTLVNCSKKCDVHQVYTPSPSDYGCCGTCKNVSCKFHMENGTSVVYAVGSTWHYNCTTYECVKTDEGAIILNYTMVCPPFNETECKMVCTLLYLRKFIII

SEQ ID NO: 9877 - protein, 752 aa, Homo Sapiens
  misc_feature (1)..(1): Xaa can be any naturally occurring amino acid
XEIIVAHIEKCSMNQNGNSLKKLAPSGRISGLCFKKLNVTTPIHKIIVNRLARKVEVDSIVVPLPFSSQELSIEDSGSMYVITTPAGLIIKWSHLTGIIDIHFGFRFNLSSYTEGLCGICNEDPDDDLRMQNGTIITNMEDIGLFIESWEIEKSFEVTMRRPVRNCTEHDCSQCIDLLNRRIFIPCHDKVSPEDFCEKMWINYTYFWNYECDALSAYVALCNKFDICIQWRTPDYCSLSCPEGKEYQPCVRPCEARTCLNQWFYGHTSCLNLREDCVCKVGTILHRPHSAQCIPEKECACTDSEDQPRTAGEIWNGGIDECTLYKCLENGSIIPIEPDCDEEPTPVCEREAEVVMGIIDKWTCCSKEVCGCDTTLCETSIPTCTNSQKLIVGHSPLSCCPQYKCECDPLKCPSISTPECREDQFMIQVRQEEPCCFSPFCVCESCTKPVPLCHDGEFLTVDLNSTHFCCPQYYCVCEPNLCPMPLLNCAEDMNLVKENVSGQCCPTWHCEKDDVCVFQEVSVLNPGQSMIKYLEEDFCYAIECLEEKDNHTGFHTLNFTLVNCSKKCDVHQVYTPSPSDYGCCGTCKNVSCKFHMENGTSVVYAVGSTWHYNCTTYECVKTDEGAIILNYTMVCPPFNETECKMNEGIVKLYNEGCCKICKREERICQKVIIKSVIRKQDCMSQSPINVASCDGKCPSATIYNINIESHLRFCKCCRENGVRNLSVPLYCSGNGTEIMYTLQEPIDCTCQWN

SEQ ID NO: 9878 - protein, 166 aa, Homo Sapiens
  misc_feature (1)..(1): Xaa can be any naturally occurring amino acid
XHSPLSCCPQYKCECDPLKCPSISTPECREDQFMIQVRQEEPCCFSPFCVCESCTKPVPLCHDGEFLTVDLNSTHFCCPQYYCVCEPNLCPMPLLNCAEDMNLVKENVSGQCCPTWHCECNCENLIMPTCEVQPCADADIRTLGCLGRADQEHFHEAKFLRENLLQ

SEQ ID NO: 9879 - protein, 477 aa, Homo Sapiens
MWMFSWLCAILIILAIAGMNTIAKTTPHTKFTKKSEEREMPKGLKPSSGPPPEEEETLFTEMAEMAEPITKPSALDSVFGTATLSPFENFTLDPADFFLNCCDCCSPVPGQKGEPGETGQPGPKGEAGNLGIPGPPGVVGPQGPRGYKGEKGLKGERGDQGVPGYPGKPGAQGEPGPKGDKGNIGLGGVKGQKGSKGDTCGNCTKGEKGDQGAMGSPGLHGGPGAKGEKGEMGEKGEMGDKGCCGDSGERGGKGQKGEGGMKGEKGSKGDSGMEGKSGRNGLPGAKGDPGIKGEKGELGPPGLLGPTGPKGDIGNKGVRGPTGKKGSRGFKGSKGELARVPRSAFSAGLSKPFPPPNIPIKFEKILYNDQGNYSPVTGKFNCSIPGTYVFSYHITVRGRPARISLVAQNKKQFKSRETLYGQEIDQASLLVILKLSAGDQVWLEVSKDWNGVYVSAEDDSIFTGFLLYPEETSGISP

SEQ ID NO: 9880 - protein, 128 aa, Homo Sapiens
MARILLLFLPGLVAVCAVHGIFMDRLASKKLCADDECVYTISLASAQEDYNAPDCRFINVKKGQQIYVYSKLVKENGAGEFWAGSVYGDGQDEMGVVGYFPRNLVKEQRVYQEATKEVPTTDIDFFCE

SEQ ID NO: 9881 - protein, 89 aa, Homo Sapiens
MQACMVPGLALCLLLGPLAGAKPVQEEGDPYAELPAMPYWPFSTSDFWNYVQHFQALGAYPQIEDMARTFFAHFPLGSTLGFHVPYQED

SEQ ID NO: 9882 - protein, 89 aa, Homo Sapiens; identical to SEQ ID NO: 9881

SEQ ID NO: 9883 - protein, 1134 aa, Homo Sapiens
MGLLASAGLLLLLVIGHPRSLGLKCGIRMVNMKSKEPAVGSRFFSRISSWRNSTVTGHPWQVSLKSDEHHFCGGSLIQEDRVVTAAHCLDSLSEKQLKNITVTSGEYSLFQKDKQEQNIPVSKIITHPEYNSREYMSPDIALLYLKHKVKFGNAVQPICLPDSDDKVEPGILCLSSGWGKISKTSEYSNVLQEMELPIMDDRACNTVLKSMNLPPLGRTMLCAGFPDWGMDACQGDSGGPLVCRRGGGIWILAGITSWVAGCAGGSVPVRNNHVKASLGIFSKVSELMDFITQNLFTGLDRGQPLSKVGSRYITKALSSVQEVNGSQRGKGILDMEKQVGCDHDYVSLRSSSGVLFNQRSLMEDDGKQNKRVCGKILPSPLLAETSEAMVPFVSDTEDSGSGFELTVTAVQKSEAGSGCGSLAILVEEGTNHSAKYPDLYPSNTRCHWFICAPEKHIIKLTFEDFAVKFSPNCIYDAVVIYGDSEEKHKLAKLCGMLTITSIFSSSNMTVIYFKSDGKNRLQGFKARFTILPSESLNKFEPKLPPQNNPVSTVKAILHDVCGIPPFSPQWLSRRIAGGEEACPHCWPWQVGLRFLGDYQCGGAIINPVWILTAAHCVQLKNNPLSWTIIAGDHDRNLKESTEQVRRAKHIIVHEDFNTLSYDSDIALIQLSSPLEYNSVVRPVCLPHSAEPLFSSEICAVTGWGSISADGGLASRLQQIQVHVLEREVCEHTYYSAHPGGITEKMICAGFAASGEKDFCQGDSGGPLVCRHENGPFVLYGIVSWGAGCVQPWKPGVFARVMIFLDWIQSKINGPASLQTNNKCKTLKQQLPPPTPSPDSASWPGCCSEAELEKPRGFFPTPRYLLDYRGRLECSWVLRVSASSMAKFTIEYLSLLGSPVCQDSVLIIYEERHSKRKTAGGLHGRRLYSMTFMSPGPLVRVTFHALVRGAFGISYIVLKVLGPKDSKITRLSQSSNREHLVPCEDVLLTKPEGIMQIPRNSHRTTMGCQWRLVAPLNHIIQLNIINFPMKPTTFVCHGHLRVYEGFGPGKKLIASFAGTLAMILTKDILKREKLNFINTYIMHIWENSVYDNVRSVGKRKQKKFASNLSYSMEAEKSRIQVPADLVPAKGSLSGS

SEQ ID NO: 9884 - protein, 80 aa, Homo Sapiens
REHLVPCEDVLLTKPEGIMQIPRNSHRTTMGCQWRLVAPLNHIIQLNIINFPMKPTTFVCHGHLRVYEGFGPGKKLIGEC

SEQ ID NO: 9885 - protein, 121 aa, Homo Sapiens
  misc_feature (1)..(1): Xaa can be any naturally occurring amino acid
XKITRLSQSSNREHLVPCEDVLLTKPEGIMQIPRNSHRTTMGCQWRLVAPLNHIIQLNIINFPMKPTTFVCHGHLRVYEGFGPGKKLIAHLHGSKKEFILISSAAYLTVHFKTDESERKRF

SEQ ID NO: 9886 - protein, 565 aa, Homo Sapiens
MLISRNKLILLLGIVFFERGKSATLSLPKAPSCGQSLVKVQPWNYFNIFSRILGGSQVEKGSYPWQVSLKQRQKHICGGSIVSPQWVITAAHCIANRNIVSTLNVTAGEYDLSQTDPGEQTLTIETVIIHPHFSTKKPMDYDIALLKMAGAFQFGHFVGPICLPELREQFEAGFICTTAGWGRLTEGGVLSQVLQEVNLPILTWEECVAALLTLKRPISGKTFLCTGFPDGGRDACQGDSGGSLMCRNKKGAWTLAGVTSWGLGCGRGWRNNVRKSDQGSPGIFTDISKVLPWIHEHIQTGNRRKSSRAWCSEQDVIVSGAEGKLHFPESLHLYYESKQRCVWTLLVPEEMHVLLSFSHLDVESCHHSYLSMYSLEDRPIGKFCGESLPSSILIGSNSLRLKFVSDATDNAAGFNLTYKALKPNYIPDSGCSYLTVLFEEGLIQSLNYPENYSDKANCDWIFQASKHHLIKLSFQSLEIEESGDCTSDYVTVHSDVERKKEIARLCGYDVPTPVLSPSSIMLISFQSDENGTCRGFQATVSFIPKAVYPDLNISISEDESMFLET

SEQ ID NO: 9887 - protein, 565 aa, Homo Sapiens; identical to SEQ ID NO: 9886

SEQ ID NO: 9888 - protein, 678 aa, Homo Sapiens
MWKLLLWVGLVLVLKHHDGAAHKLVCYFTNWAHSRPGPASILPHDLDPFLCTHLIFAFASMNNNQIVAKDLQDEKILYPEFNKLKERNRELKTLLSIGGWNFGTSRFTTMLSTFANREKFIASVISLLRTHDFDGLDLFFLYPGLRGSPMHDRWTFLFLIEELLFAFRKEALLTMRPRLLLSAAVSGVPHIVQTSYDVRFLGRLLDFINVLSYDLHGSWERFTGHNSPLFSLPEDPKSSAYAMNYWRKLGAPSEKLIMGIPTYGRTFRLLKASKNGLQARAIGPASPGKYTKQEGFLAYFEICSFVWGAKKHWIDYQYVPYANKGKEWVGYDNAISFSYKAWFIRREHFGGAMVWTLDMDDVRGTFCGTGPFPLVYVLNDILVRAEFSSTSLPQFWLSSAVNSSSTDPERLAVTTAWTTDSKILPPGGEAGVTEIHGKCENMTITPRGTTVTPTKETVSLGKHTVALGEKTEITGAMTMTSVGHQSMTPGEKALTPVGHQSVTTGQKTLTSVGYQSVTPGEKTLTPVGHQSVTPVSHQSVSPGGTTMTPVHFQTETLRQNTVAPRRKAVAREKVTVPSRNISVTPEGQTMPLRGENLTSEVGTHPRMGNLGLQMEAENRMMLSSSPVIQLPEQTPLAFDNRFVPIYGNHSSVNSVTPQTSPLSLKKEIPENSAVDEEA

SEQ ID NO: 9889 - protein, 520 aa, Homo Sapiens
MAALKLLSSGLRLCASARGSGATWYKGCVCSFSTSAHRHTKFYTDPVEAVKDIPDGATVLVGGFGLCGIPENLIDALLKTGVKGLTAVSNNAGVDNFGLGLLLRSKQIKRMVSSYVGENAEFERQYLSGELEVELTPQGTLAERIRAGGAGVPAFYTPTGYGTLVQEGGSPIKYNKDGSVAIASKPREVREFNGQHFILEEAITGDFALVKAWKADRAGNVIFRKSARNFNLPMCKAAETTVVEVEEIVDIGAFAPEDIHIPQIYVHRLIKGEKYEKRIERLSIRKEGDGEAKSAKPGDDVRERIIKRAALEFEDGMYANLGIGIPLLASNFISPNITVHLQSENGVLGLGPYPRQHEADADLINAGKETVTILPGASFFSSDESFAMIRGGHVDLTMLGAMQVSKYGDLANWMIPGKMVKGMGGAMDLVSSAKTKVVVTMEHSAKGNAHKIMEKCTLPLTGKQCVNRIITEKAVFDVDKKKGLTLIELWEGLTVDDVQKSTGCDFAVSPKLMPMQQIAN

SEQ ID NO: 9890 - protein, 123 aa, Homo Sapiens
MLGAMQVSKYGDLANWMIPGKMVKGMGGAMDLVSSAKTKVVVTMEHSAKGNAHKIMEKCTLPLTGKQCVNRIITEKAVFDVDKKKGLTLIELWEGLTVDDVQKSTGCDFAVSPKLMPMQQIAN

SEQ ID NO: 9891 - protein, 123 aa, Homo Sapiens; identical to SEQ ID NO: 9890

SEQ ID NO: 9892 - protein, 334 aa, Homo Sapiens
MMVREFNGQHFILEEAITGDFALVKAWKADRAGNVIFRKSARNFNLPMCKAAETTVVEVEEIVDIGAFAPEDIHIPQIYVHRLIKGEKYEKRIERLSIRKEGDGEAKSAKPGDDVRERIIKRAALEFEDGMYANLGIGIPLLASNFISPNITVHLQSENGVLGLGPYPRQHEADADLINAGKETVTILPGASFFSSDESFAMIRGGHVDLTMLGAMQVSKYGDLANWMIPGKMVKGMGGAMDLVSSAKTKVVVTMEHSAKGNAHKIMEKCTLPLTGKQCVNRIITEKAVFDVDKKKGLTLIELWEGLTVDDVQKSTGCDFAVSPKLMPMQQIAN

SEQ ID NO: 9893 - protein, 517 aa, Homo Sapiens
MAALRLLASVLGRGVPAGGSGLALSQGCARCFATSPRLRAKFYADPVEMVKDISDGATVMIGGFGLCGIPENLIAALLRTRVKDLQVVSSNVGVEDFGLGLLLAARQVRRIVCSYVGENTLCESQYLAGELELELTPQGTLAERIRAGGAGVPAFYTPTGYGTLVQEGGAPIRYTPDGHLALMSQPREVREFNGDHFLLERAIRADFALVKGWKADRAGNVVFRRSARNFNVPMCKAADVTAVEVEEIVEVGAFPPEDIHVPNIYVDRVIKGQKYEKRIERLTILKEEDGDAGKEEDARTRIIRRAALEFEDGMYANLGIGIPLLASNFISPSMTVHLHSENGILGLGPFPTEDEVDADLINAGKQTVTVLPGGCFFASDDSFAMIRGGHIQLTMLGAMQVSKYGDLANWMIPGKKVKGMGGAMDLVSSQKTRVVVTMQHCTKDNTPKIMEKCTMPLTGKRCVDRIITEKAVFDVHRKKELTLRELWEGLTVDDIKKSTGCAFAVSPNLRPMQQVAP

SEQ ID NO: 9894 - protein, 56 aa, Homo Sapiens
MACAAVMIPGLLRCSVGAIRIEAASLRLTLSTLRHLTLTRLCQQLRCVELPVSHRQ

SEQ ID NO: 9895 - protein, 312 aa, Homo Sapiens
MACAAVMIPGLLRCSVGAIRIEAASLRLTLSTLRHLTLTSIMKSKRKTDHMERTASVLRREIVSAAKVCGAASESPSVKSLRLLVADQDFSFKAGQWVDFFIPGVSVVGGFSICSSPRLLEQERVIELAVKYTNHPPALWVHNTCTLDCEVAVRVGGEFFFDPQPADASRNLVLIAGGVGINPLLSILRHAADLLREQANKRNGYEIGTIKLFYSAKNTSELLFKKNILDLVNEFPEKIACSLHVTKQTTQINAELKPYITEGRITEKEIRDHISKETLFYICGPPPMTDFFSKQLENNHVPKEHICFEKWW

SEQ ID NO: 9896 - protein, 312 aa, Homo Sapiens; identical to SEQ ID NO: 9895

SEQ ID NO: 9897 - protein, 311 aa, Homo Sapiens
MACAAVMIPGLLRCSVGAIRIEAASLRLTLSTLRHLTLTSIMKSKRKTDHMERTASVLRREIVSAAKVCGAASESPSVKSLRLLVADQDFSFKAGQWVDFFIPGVSVVGGFSICSSPRLLEQERVIELAVKYTNHPPALWVHNTCTLDCEVAVRVGGEFFFDPQPADASRNLVLIAGGVGINPLLSILRHAADLLREQANKRNGYEIGTIKLFYSAKNTSELLFKKNILDLVNEFPEKIACSLHVTKQTTQINAELKPYITGRITEKEIRDHISKETLFYICGPPPMTDFFSKQLENNHVPKEHICFEKWW

SEQ ID NO: 9898 - protein, 71 aa, Homo Sapiens
MACAAVMIPGLLRCSVGAIRIEAASLRLTLSTLRHLTLTSIMKSKRKTDHMERTASVLRRESNLFHQGRKH

SEQ ID NO: 9899 - protein, 330 aa, Homo Sapiens
MTPKISWTSKFSVCPESAMACAAVMIPGLLRCSVGAIRIEAASLRLTLSTLRHLTLTSIMKSKRKTDHMERTASVLRREIVSAAKVCGAASESPSVKSLRLLVADQDFSFKAGQWVDFFIPGVSVVGGFSICSSPRLLEQERVIELAVKYTNHPPALWVHNTCTLDCEVAVRVGGEFFFDPQPADASRNLVLIAGGVGINPLLSILRHAADLLREQANKRNGYEIGTIKLFYSAKNTSELLFKKNILDLVNEFPEKIACSLHVTKQTTQINAELKPYITEGRITEKEIRDHISKETLFYICGPPPMTDFFSKQLENNHVPKEHICFEKWW

SEQ ID NO: 9900 - protein, 330 aa, Homo Sapiens; identical to SEQ ID NO: 9899

SEQ ID NO: 9901 - protein, 125 aa, Homo Sapiens
MAGPSLACCLLGLLALTSACYIQNCPLGGKRAAPDLDVRKCLPCGPGGKGRCFGPNICCAEELGCFVGTAEALRCQEENYLPSPCQSGQKACGSGGRCAVLGLCCSPDGCHADPACDAEATFSQR

SEQ ID NO: 9902 - protein, 207 aa, Homo Sapiens
MAVRALKLLTTLLAVVAAASQAEVESEAGWGMVTPDLLFAEGTAAYARGDWPGVVLSMERALRSRAALRALRLRCRTQCAADFPWELDPDWSPSPAQASGAAALRDLSFFGGLLRRAACLRRCLGPPAAHSLSEEMELEFRKRSPYNYLQVAYFKDLETQPHMQEFRLGVRLYSEEQPQEAVPHLEAALQEYFVAYEECRALCEGPY

SEQ ID NO: 9903 - protein, 804 aa, Homo Sapiens
MAVRALKLLTTLLAVVAAASQAEVESEAGWGMVTPDLLFAEGTAAYARGDWPGVVLSMERALRSRAALRALRLRCRTQCAADFPWELDPDWSPSPAQASGAAALRDLSFFGGLLRRAACLRRCLGPPAAHSLSEEMELEFRKRSPYNYLQVAYFKINKLEKAVAAAHTFFVGNPEHMEMQQNLDYYQTMSGVKEADFKDLETQPHMQEFRLGVRLYSEEQPQEAVPHLEAALQEYFVAYEECRALCEGPYDYDGYNYLEYNADLFQAITDHYIQVLNCKQNCVTELASHPSREKPFEDFLPSHYNYLQFAYYNIGNYTQAVECAKTYLLFFPNDEVMNQNLAYYAAMLGEEHTRSIGPRESAKEYRQRSLLEKELLFFAYDVFGIPFVDPDSWTPEEVIPKRLQEKQKSERETAVRISQEIGNLMKEIETLVEEKTKESLDVSRLTREGGPLLYEGISLTMNSKLLNGSQRVVMDGVISDHECQELQRLTNVAATSGDGYRGQTSPHTPNEKFYGVTVFKALKLGQEGKVPLQSAHLYYNVTEKVRRIMESYFRLDTPLYFSYSHLVCRTAIEEVQAERKDDSHPVHVDNCILNAETLVCVKEPPAYTFRDYSAILYLNGDFDGGNFYFTELDAKTVTAEVQPQCGRAVGFSSGTENPHGVKAVTRGQRCAIALWFTLDPRHSERVRAARAGESSWCCGDPFPERPWFAFLFPKSHCQWLRHERSTWDTSSNALSLWSHCLVLPGPAVNGIQVGKEVKTGSDAEFLVPSLGPTSAVLFQRVGPAGKEMSLGPLRNLPCPLGSSS

SEQ ID NO: 9904 - protein, 736 aa, Homo Sapiens
MAVRALKLLTTLLAVVAAASQAEVESEAGWGMVTPDLLFAEGTAAYARGDWPGVVLSMERALRSRAALRALRLRCRTQCAADFPWELDPDWSPSPAQASGAAALRDLSFFGGLLRRAACLRRCLGPPAAHSLSEEMELEFRKRSPYNYLQVAYFKINKLEKAVAAAHTFFVGNPEHMEMQQNLDYYQTMSGVKEADFKDLETQPHMQEFRLGVRLYSEEQPQEAVPHLEAALQEYFVAYEECRALCEGPYDYDGYNYLEYNADLFQAITDHYIQVLNCKQNCVTELASHPSREKPFEDFLPSHYNYLQFAYYNIGNYTQAVECAKTYLLFFPNDEVMNQNLAYYAAMLGEEHTRSIGPRESAKEYRQRSLLEKELLFFAYDVFGIPFVDPDSWTPEEVIPKRLQEKQKSERETAVRISQEIGNLMKEIETLVEEKTKESLDVSRLTREGGPLLYEGISLTMNSKLLNGSQRVVMDGVISDHECQELQRLTNVAATSGDGYRGQTSPHTPNEKFYGVTVFKALKLGQEGKVPLQSAHLYYNVTEKVRRIMESYFRLDTPLYFSYSHLVCRTAIEEVQAERKDDSHPVHVDNCILNAETLVCVKEPPAYTFRDYSAILYLNGDFDGGNFYFTELDAKTVTAEVQPQCGRAVGFSSGTENPHGVKAVTRGQRCAIALWFTLDPRHSERDRVQADDLVKMLFSPEEMDLSQEQPLDAQQGPPEPAQESLSGSESKPKDEL

SEQ ID NO: 9905 - protein, 697 aa, Homo Sapiens
MAVRALKLLTTLLAVVAAASQAEVESEAGWGMVTPDLLFAEGTAAYARGDWPGVVLSMERALRSRAALRALRLRCRTQCAADFPWELDPDWSPSPAQASGAAALRDLSFFGGLLRRAACLRRCLGPPAAHSLSEEMELEFRKRSPYNYLQVAYFKINKLEKAVAAAHTFFVGNPEHMEMQQNLDYYQTMSGVKEADFKDLETQPHMQEFRLGVRLYSEEQPQEAVPHLEAALQEYFVAYEECRALCEGPYDYDGYNYLEYNADLFQAITDHYIQVLNCKQNCVTELASHPSREKPFEDFLPSHYNYLQFAYYNIGNYTQAVECAKTYLLFFPNDEVMNQNLAYYAAMLGEEHTRSIGPRESAKEYRQRSLLEKELLFFAYDVFGIPFVDPDSWTPEEVIPKRLQEKQKSERETAVRISQEIGNLMKEIETLVEEKTKESLDVSRLTREGGPLLYEGISLTMNSKLLNGSQRVVMDGVISDHECQELQRLTNVAATSGDGYRGQTSPHTPNEKFYGVTVFKALKLGQEGKVPLQSAHLYYNVTEKVRRIMESYFRLDTPLYFSYSHLVCRTAIEEVQAERKDDSHPVHVDNCILNAETLVCVKEPPAYTFRDYSAILYLNGDFDGGNFYFTELDAKTVTAEVQPQCGRAVGFSSGTENPHGVKAVTRGQRCAIALWFTLDPRHSERVRAARAGQGAGR

SEQ ID NO: 9906 - protein, 222 aa, Homo Sapiens
  misc_feature (1)..(1): Xaa can be any naturally occurring amino acid
XTPEEVIPKRLQEKQKSERETAVRISQEIGNLMKEIETLVEEKTKESLDVSRLTREGGPLLYEGISLTMNSKLLNGSQRVVMDGVISDHECQELQRLTNVAATSGDGYRGQTSPHTPNEKFYGVTVFKALKFHVAGEASQSWWKAKRSKSHLTWMAAGKERTSAAGARRQSSSAECPPVLQRDGEGAAHHGVLLPPGYAPLLFLLSSGVPHCHRRGPGREEG

SEQ ID NO: 9907 - protein, 134 aa, Homo Sapiens
MEMQQNIENYRATAGVEALQLVDREAKPHMESYNAGVKHYEADDFEMAIRHFEQALREYFVEDTECRTLCEGPQRFEEYEYLGYKAGLYEAIADHYMQVLVCQHECVRELATRPGRLSPIENFLPLHYDYLQFA

SEQ ID NO: 9908 - protein, 137 aa, Homo Sapiens
MEMQQNIENYRATAGVEALQLVDREAKPHMESYNAGVKHYEADDFEMAIRHFEQALREYFVEDTECRTLCEGPQRFEEYEYLGYKAGLYEAIADHYMQVLVCQHECVRELATRPGRLSPIENFLPLHYDYLQFAYYR

SEQ ID NO: 9909 - protein, 527 aa, Homo Sapiens
MEMQQNIENYRATAGVEALQLVDREAKPHMESYNAGVKHYEADDFEMAIRHFEQALREYFVEDTECRTLCEGPQRFEEYEYLGYKAGLYEAIADHYMQVLVCQHECVRELATRPGRLSPIENFLPLHYDYLQFAYYRVGEYVKALECAKAYLLCHPDDEDVLDNVDYYESLLDDSIDPASIEAREDLTMFVKRHKLESELIKSAAEGLGFSYTEPNYWIRYGGRQDENRVPSGVNVEGAEVHGFSMGKKLSPKIDRDLREGGPLLYENITFVYNSEQLNGTQRVLLDNVLSEEQCRELHSVASGIMLVGDGYRGKTSPHTPNEKFEGATVLKALKSGYEGRVPLKSARLFYDISEKARRIVESYFMLNSTLYFSYTHMVCRTALSGQQDRRNDLSHPIHADNCLLDPEANECWKEPPAYTFRDYSALLYMNDDFEGGEFIFTEMDAKTVTASIKPKCGRMISFSSGGENPHGVKAVTKGKRCAVALWFTLDPLYRELERIQADEVIAILDQEQQGKHELNINPKDEL

SEQ ID NO: 9910 - protein, 708 aa, Homo Sapiens
MRERIWAPPLLLLLPLLLPPPLWGGPPDSPRRELELEPGPLQPFDLLYASGAAAYYSGDYERAVRDLEAALRSHRRLREIRTRCARHCAARHPLPPPPPGEGPGAELPLFRSLLGRARCYRSCETQRLGGPASRHRVSEDVRSDFQRRVPYNYLQRAYIKLNQLEKAVEAAHTFFVANPEHMEMQQNIENYRATAGVEALQLVDREAKPHMESYNAGVKHYEADDFEMAIRHFEQALREYFVEDTECRTLCEGPQRFEEYEYLGYKAGLYEAIADHYMQVLVCQHECVRELATRPGRLSPIENFLPLHYDYLQFAYYRVGEYVKALECAKAYLLCHPDDEDVLDNVDYYESLLDDSIDPASIEAREDLTMFVKRHKLESELIKSAAEGLGFSYTEPNYWIRYGGRQDENRVPSGVNVEGAEVHGFSMGKKLSPKIDRDLREGGPLLYENITFVYNSEQLNGTQRVLLDNVLSEEQCRELHSVASGIMLVGDGYRGKTSPHTPNEKFEGATVLKALKSGYEGRVPLKSARLFYDISEKARRIVESYFMLNSTLYFSYTHMVCRTALSGQQDRRNDLSHPIHADNCLLDPEANECWKEPPAYTFRDYSALLYMNDDFEGGEFIFTEMDAKTVTASIKPKCGRMISFSSGGENPHGVKAVTKGKRCAVALWFTLDPLYRELERIQADEVIAILDQEQQGKHELNINPKDEL

SEQ ID NO: 9911 - protein, 736 aa, Homo Sapiens
MLRLLRPLLLLLLLPPPGSPEPPGLTQLSPGAPPQAPDLLYADGLRAYAAGAWAPAVALLREALRSQAALGRVRLDCGASCAADPGAALPAVLLGAPEPDSGPGPTQGSWERQLLRAALRRADCLTQCAARRLGPGGAARLRVGSALRDAFRRREPYNYLQRAYYQLKKLDLAAAAAHTFFVANPMHLQMREDMAKYRRMSGVRPQSFRDLETPPHWAAYDTGLELLGRQEAGLALPRLEEALQGSLAQMESCRADCEGPEEQQGAEEEEDGAASQGGLYEAIAGHWIQVLQCRQRCVGETATRPGRSFPVPDFLPNQLRRLHEAHAQVGNLSQAIENVLSVLLFYPEDEAAKRALNQYQAQLGEPRPGLGPREDIQRFILRSLGEKRQLYYAMEHLGTSFKDPDPWTPAALIPEALREKLREDQEKRPWDHEPVKPKPLTYWKDVLLLEGVTLTQDSRQLNGSERAVLDGLLTPAECGVLLQLAKDAAGAGARSGYRGRRSPHTPHERFEGLTVLKAAQLARAGTVGSQGAKLLLEVSERVRTLTQAYFSPERPLHLSFTHLVCRSAIEGEQEQRMDLSHPVHADNCVLDPDTGECWREPPAYTYRDYSGLLYLNDDFQGGDLFFTEPNALTVTARVRPRCGRLVAFSSGVENPHGVWAVTRGRRCALALWHTWAPEHREQEWIEAKELLQESQEEEEEEEEEMPSKDPSPEPPSRRHQRVQDKTGRAPRVREEL

SEQ ID NO: 9912 - protein, 85 aa, Homo Sapiens
MARVAWGLLWLLLGSAGAQYEKYSFRGFPPEDLMPLAAAYGHALEQYEGESWRESARYLEAALRLHRLLRDSEAFCHANCSGPAP

SEQ ID NO: 9913 - protein, 437 aa, Homo Sapiens
MARVAWGLLWLLLGSAGAQYEKYSFRGFPPEDLMPLAAAYGHALEQYEGESWRESARYLEAALRLHRLLRDSEAFCHANCSGPAPAAKPDPDGGRADEWACELRLFGRVLERAACLRRCKRTLPAFQVPYPPRQLLRDFQSRLPYQYLHYALFKANRLEKAVAAAYTFLQRNPKHELTAKYLNYYQGMLDVADESLTDLEAQPYEAVFLRAVKLYNSGDFRSSTEDMERALSEYLAVFARCLAGCEGAHEQVDFKDFYPAIADLFAESLQCKVDCEANLTPNVGGYFVDKFVATMYHYLQFAYYKLNDVRQAARSAASYMLFDPKDSVMQQNLVYYRFHRARWGLEEEDFQPREEAMLYHNQTAELRELLEFTHMYLQSDDEMELEETEPPLEPEDALSDAEFEGEGDYEEGMYADWWQEPDAKGDEAEAEPEPELA

SEQ ID NO: 9914 - protein, 437 aa, Homo Sapiens; identical to SEQ ID NO: 9913

SEQ ID NO: 9915 - protein, 221 aa, Homo Sapiens
  misc_feature (1)..(1): Xaa can be any naturally occurring amino acid
XKRTLPAFQVPYPPRQLLRDFQSRLPYQYLHYALFKANRLEKAVAAAYTFLQRNPKHELTAKYLNYYQGMLDVADESLTDLEAQPYEAVFLRAVKLYNSGDFRSSTEDMERALSEYLAVFARCLAGCEGAHEQVDFKDFYPAIAVNDVRQAARSAASYMLFDPKDSVMQQNLVYYRFHRARWGLEEEDFQPREEAMLYHNQTAELRELLEFTHMYLQSDDE

SEQ ID NO: 9916 - protein, 73 aa, Homo Sapiens
  misc_feature (1)..(1): Xaa can be any naturally occurring amino acid
XLRELLEFTHMYLQSDDEMELEETEPPLEPEDALSDAEFEGEGDYEEGMYADWWQEPDAKGDEAEAEPEPELA

SEQ ID NO: 9917 - protein, 534 aa, Homo Sapiens
MIWYILIIGILLPQSLAHPGFFTSIGQMTDLIHTEKDLVTSLKDYIKAEEDKLEQIKKWAEKLDRLTSTATKDPEGFVGHPVNAFKLMKRLNTEWSELENLVLKDMSDGFISNLTIQRQYFPNDEDQVGAAKALLRLQDTYNLDTDTISKGNLPGVKHKSFLTAEDCFELGKVAYTEADYYHTELWMEQALRQLDEGEISTIDKVSVLDYLSYAVYQQGDLDKALLLTKKLLELDPEHQRANGNLKYFEYIMAKEKDVNKSASDDQSDQKTTPKKKGVAVDYLPERQKYEMLCRGEGIKMTPRRQKKLFCRYHDGNRNPKFILAPAKQEDEWDKPRIIRFHDIISDAEIEIVKDLAKPRLSRATVHDPETGKLTTAQYRVSKSAWLSGYENPVVSRINMRIQDLTGLDVSTAEELQVANYGVGGQYEPHFDFARKDEPDAFKELGTGNRIATWLFYMSDVSAGGATVFPEVGASVWPKKGTAVFWYNLFASGEGDYSTRHAACPVLVGNKWVSNKWLHERGQEFRRPCTLSELE

SEQ ID NO: 9918 - protein, 534 aa, Homo Sapiens
MIWYILIIGILLPQSLAHPGFFTSIGQMTDLIHTEKDLVTSLKDYIKAEEDKLEQIKKWAEKLDRLTSTATKDPEGFVGHPVNAFKLMKRLNTEWSELENLVLKDMSDGFISNLTIQRQYFPNDEDQVGAAKALLRLQDTYNLDTDTISKGNLPGVKHKSFLTAEDCFELGKVAYTEADYYHTELWMEQALRQLDEGEISTIDKVSVLDYLSYAVYQQGDLDKALLLTKKLLELDPEHQRANGNLKYFEYIMAKEKDVNKSASDDQSDQKTTPKKKGVAVDYLPERQKYEMLCRGEGIKMTPRRQKKLFCRYHDGNRNPKFILAPAKQEDEWDKPRIIRFHDIISDAEIEIVKDLAKPRLRRATISNPITGDLETVHYRISKSAWLSGYENPVVSRINMRIQDLTGLDVSTAEELQVANYGVGGQYEPHFDFARKDEPDAFKELGTGNRIATWLFYMSDVSAGGATVFPEVGASVWPKKGTAVFWYNLFASGEGDYSTRHAACPVLVGNKWVSNKWLHERGQEFRRPCTLSELE

SEQ ID NO: 9919 - protein, 534 aa, Homo Sapiens; identical to SEQ ID NO: 9917

SEQ ID NO: 9920 - protein, 516 aa, Homo Sapiens
MIWYILIIGILLPQSLAHPGFFTSIGQMTDLIHTEKDLVTSLKDYIKAEEDKLEQIKKWAEKLDRLTSTATKDPEGFVGHPVNAFKLMKRLNTEWSELENLVLKDMSDGFISNLTIQRQYFPNDEDQVGAAKALLRLQDTYNLDTDTISKGNLPGVKHKSFLTAEDCFELGKVAYTEADYYHTELWMEQALRQLDEGEISTIDKVSVLDYLSYAVYQQGDLDKALLLTKKLLELDPEHQRANGNLKYFEYIMAKEKDVNKSASDDQSDQKTTPKKKGVAVDYLPERQKYEMLCRGEGIKMTPRRQKKLFCRYHDGNRNPKFILAPAKQEDEWDKPRIIRFHDIISDAEIEIVKDLAKPRLSRATVHDPETGKLTTAQYRVSKSAWLSGYENPVVSRINMRIQDLTGLDVSTAEELQKDEPDAFKELGTGNRIATWLFYMSDVSAGGATVFPEVGASVWPKKGTAVFWYNLFASGEGDYSTRHAACPVLVGNKWVSNKWLHERGQEFRRPCTLSELE

SEQ ID NO: 9921 - protein, 534 aa, Homo Sapiens; identical to SEQ ID NO: 9918

SEQ ID NO: 9922 - protein, 50 aa, Homo Sapiens
MKLWVSALLMAWFGVLSCVQAEFFTSIGHMTDLIYAEKELVQSLKEYILV

SEQ ID NO: 9923 - protein, 101 aa, Homo Sapiens
MKLWVSALLMAWFGVLSCVQAEFFTSIGHMTDLIYAEKELVQSLKEYILVEEAKLSKIKSWANKMEALTSKSAADAEGYLAHPVNAYKLVKRLNTDWPALE

SEQ ID NO: 9924 - protein, 114 aa, Homo Sapiens
MKLWVSALLMAWFGVLSCVQAEFFTSIGHMTDLIYAEKELVQSLKEYILVEEAKLSKIKSWANKMEALTSKSAADAEGYLAHPVNAYKLVKRLNTDWPALEDLVLQDSAAGFIA

SEQ ID NO: 9925 - protein, 147 aa, Homo Sapiens
MKLWVSALLMAWFGVLSCVQAEFFTSIGHMTDLIYAEKELVQSLKEYILVEEAKLSKIKSWANKMEALTSKSAADAEGYLAHPVNAYKLVKRLNTDWPALEDLVLQDSAAGFIANLSVQRQFFPTDEDEIGAAKALMRLQDTYRLDP

SEQ ID NO: 9926 - protein, 153 aa, Homo Sapiens
MKLWVSALLMAWFGVLSCVQAEFFTSIGHMTDLIYAEKELVQSLKEYILVEEAKLSKIKSWANKMEALTSKSAADAEGYLAHPVNAYKLVKRLNTDWPALEDLVLQDSAAGFIANLSVQRQFFPTDEDEIGAAKALMRLQDTYRLDPGTISRG

SEQ ID NO: 9927 - protein, 167 aa, Homo Sapiens
MKLWVSALLMAWFGVLSCVQAEFFTSIGHMTDLIYAEKELVQSLKEYILVEEAKLSKIKSWANKMEALTSKSAADAEGYLAHPVNAYKLVKRLNTDWPALEDLVLQDSAAGFIANLSVQRQFFPTDEDEIGAAKALMRLQDTYRLDPGTISRGELPGTKYQAMLSVD

SEQ ID NO: 9928 - protein, 184 aa, Homo Sapiens
MKLWVSALLMAWFGVLSCVQAEFFTSIGHMTDLIYAEKELVQSLKEYILVEEAKLSKIKSWANKMEALTSKSAADAEGYLAHPVNAYKLVKRLNTDWPALEDLVLQDSAAGFIANLSVQRQFFPTDEDEIGAAKALMRLQDTYRLDPGTISRGELPGTKYQAMLSVDDCFGMGRSAYNEGDYYH

SEQ ID NO: 9929 - protein, 204 aa, Homo Sapiens
MKLWVSALLMAWFGVLSCVQAEFFTSIGHMTDLIYAEKELVQSLKEYILVEEAKLSKIKSWANKMEALTSKSAADAEGYLAHPVNAYKLVKRLNTDWPALEDLVLQDSAAGFIANLSVQRQFFPTDEDEIGAAKALMRLQDTYRLDPGTISRGELPGTKYQAMLSVDDCFGMGRSAYNEGDYYHTVLWMEQVLKQLDAGEEATT

SEQ ID NO: 9930 - protein, 535 aa, Homo Sapiens
MKLWVSALLMAWFGVLSCVQAEFFTSIGHMTDLIYAEKELVQSLKEYILVEEAKLSKIKSWANKMEALTSKSAADAEGYLAHPVNAYKLVKRLNTDWPALEDLVLQDSAAGFIANLSVQRQFFPTDEDEIGAAKALMRLQDTYRLDPGTISRGELPGTKYQAMLSVDDCFGMGRSAYNEGDYYHTVLWMEQVLKQLDAGEEATTTKSQVLDYLSYAVFQLGDLHRALELTRRLLSLDPSHERAGGNLRYFEQLLEEEREKTLTNQTEAELATPEGIYERPVDYLPERDVYESLCRGEGVKLTPRRQKRLFCRYHHGNRAPQLLIAPFKEEDEWDSPHIVRYYDVMSDEEIERIKEIAKPKLARATVRDPKTGVLTVASYRVSKSSWLEEDDDPVVARVNRRMQHITGLTVKTAELLQVANYGVGGQYEPHFDFSRNDERDTFKHLGTGNRVATFLNYMSDVEAGGATVFPDLGAAIWPKKGTAVFWYNLLRSGEGDYRTRHAACPVLVGCKWVSNKWFHERGQEFLRPCGSTEVD

SEQ ID NO: 9931 - protein, 533 aa, Homo Sapiens
MKLWVSALLMAWFGVLSCVQAEFFTSIGHMTDLIYAEKELVQSLKEYILVEEAKLSKIKSWANKMEALTSKSAADAEGYLAHPVNAYKLVKRLNTDWPALEDLVLQDSAAGFIANLSVQRQFFPTDEDEIGAAKALMRLQDTYRLDPGTISRGELPGTKYQAMLSVDDCFGMGRSAYNEGDYYHTVLWMEQVLKQLDAGEEATTTKSQVLDYLSYAVFQLGDLHRALELTRRLLSLDPSHERAGGNLRYFEQLLEEEREKTLTNQTEAELATPEGIYERPVDYLPERDVYESLCRGEGVKLTPRRQKRLFCRYHHGNRAPQLLIAPFKEEDEWDSPHIVRYYDVMSDEEIERIKEIAKPKLARATVRDPKTGVLTVASYRVSKSSWLEEDDDPVVARVNRRMQHITGLTVKTAELLQVANYGVGGQYEPHFDFSRRPFDSGLKTEGNRLATFLNYMSDVEAGGATVFPDLGAAIWPKKGTAVFWYNLLRSGEGDYRTRHAACPVLVGCKWVSNKWFHERGQEFLRPCGSTEVD

SEQ ID NO: 9932 - protein, 533 aa, Homo Sapiens; identical to SEQ ID NO: 9931

SEQ ID NO: 9933 - protein, 533 aa, Homo Sapiens; identical to SEQ ID NO: 9931

SEQ ID NO: 9934 - protein, 535 aa, Homo Sapiens; identical to SEQ ID NO: 9930

SEQ ID NO: 9935 - protein, 535 aa, Homo Sapiens; identical to SEQ ID NO: 9930

SEQ ID NO: 9936 - protein, 236 aa, Homo Sapiens
MKRQLVTNSFLHHLLIGQKRPRNAPRTLPSVTMKLWVSALLMAWFGVLSCVQAEFFTSIGHMTDLIYAEKELVQSLKEYILVEEAKLSKIKSWANKMEALTSKSAADAEGYLAHPVNAYKLVKRLNTDWPALEDLVLQDSAAGFIANLSVQRQFFPTDEDEIGAAKALMRLQDTYRLDPGTISRGELPGTKYQAMLSVDDCFGMGRSAYNEGDYYHTVLWMEQVLKQLDAGEEATT

SEQ ID NO: 9937 - protein, 104 aa, Homo Sapiens
MGPGARLAALLAVLALGTGDPERAAARGDTFSALTSVARALAPERRLLGLLRRYLRGEEARLRDLTRFYDKVLSLHEDSTTPVANPLLAFTLIKRLQSDWRNVL

SEQ ID NO: 9938 - protein, 544 aa, Homo Sapiens
MGPGARLAALLAVLALGTGDPERAAARGDTFSALTSVARALAPERRLLGLLRRYLRGEEARLRDLTRFYDKVLSLHEDSTTPVANPLLAFTLIKRLQSDWRNVVHSLEASENIRALKDGYEKVEQDLPAFEDLEGAARALMRLQDVYMLNVKGLARGVFQRVTGSAITDLYSPKRLFSLTGDDCFQVGKVAYDMGDYYHAIPWLEEAVSLFRGSYGEWKTEDEASLEDALDHLAFAYFRAGNVSCALSLSREFLLYSPDNKRMARNVLKYERLLAESPNHVVAEAVIQRPNIPHLQTRDTYEGLCQTLGSQPTLYQIPSLYCSYETNSNAYLLLQPIRKEVIHLEPYIALYHDFVSDSEAQKIRELAEPWLQRSVVASGEKQLQVEYRISKSAWLKDTVDPKLVTLNHRIAALTGLDVRPPYAEYLQVVNYGIGGHYEPHFDHATSPSSPLYRMKSGNRVATFMIYLSSVEAGGATAFIYANLSVPVVRNAALFWWNLHRSGEGDSDTLHAGCPVLVGDKWVANKWIHEYGQEFRRPCSSSPED

SEQ ID NO: 9939 - protein, 604 aa, Homo Sapiens
MGPGARLAALLAVLALGTGDPERAAARGDTFSALTSVARALAPERRLLGLLRRYLRGEEARLRDLTRFYDKVLSLHEDSTTPVANPLLAFTLIKRLQSDWRNVVHSLEASENIRALKDGYEKVEQDLPAFEDLEGAARALMRLQDVYMLNVKGLARGVFQRVTGSAITDLYSPKRLFSLTGDDCFQVGKVAYDMGDYYHAIPWLEEAVSLFRGSYGEWKTEDEASLEDALDHLAFAYFRAGNVSCALSLSREFLLYSPDNKRMARNVLKYERLLAESPNHVVAEAVIQRPNIPHLQTRDTYEGLCQTLGSQPTLYQIPSLYCSYETNSNAYLLLQPIRKEVIHLEPYIALYHDFVSDSEAQKIRELAEPWLQRSVVASGEKQLQVEYRISKSAWLKDTVDPKLVTLNHRIAALTGLDVRPPYAEYLQVVNYGIGGHYEPHFDHATSPSSPLYRMKSGNRVATFMIYLSSVEAGGATAFIYANLSVPVVRHCFGGTCTGVVKGTVTHFMLAVLSWWEISGWPTSGYMSMDRNSADPAAPALKTELLAERSWWSPVAFQRSQEPKAGVGEEKAEQPPGRRPCQLCLCLANQRQGRGCYQGTLRMYI

SEQ ID NO: 9940 - protein, 257 aa, Homo Sapiens
MGPGARLAALLAVLALGTGDPERAAARGDTFSALTSVARALAPERRLLGLLRRYLRGEEARLRDLTRFYDKVLSLHEDSTTPVANPLLAFTLIKRLQSDWRNVVHSLEASENIRALKDGYEKVEQDLPAFEDLEGAARALMRLQDVYMLNVKGLARGVFQRVTGSAITDLYSPKRLFSLTGDDCFQVGKVAYDMGDYYHAIPWLEEAVSLFRGSYGEWKTEDEASLEDALDHLAFAYFRAGNVSCALSLSREFLLYR

SEQ ID NO: 9941 - protein, 61 aa, Homo Sapiens
SVPVVRNAALFWWNLHRSGEGDSDTLHAGCPVLVGDKWVANKWIHEYGQEFRRPCSSSPED

SEQ ID NO: 9942 - protein, 200 aa, Homo Sapiens
METRLPPRNIQDVESDSAKQFLQAAEAIDDIPFGITSNSDVFSKYQLDKDGVVLFKKFDEGRNNFEGEVTKENLLDFIKHNQLPLVIEFTEQTAPKIFGGEIKTHILLFLPKSVSDYDGKLSNFKTAAESFKGKILFIFIDSDHTDNQRILEFFGLKKEECPAVRLITLEEEMTKYKPESEELTAERITEFCHRFLEGKI

SEQ ID NO: 9943 - protein, 117 aa, Homo Sapiens
METRLPPRNIQFDEGRNNFEGEVTKENLLDFIKHNQLPLVIEFTEQTAPKIFGGEIKTHILLFLPKSVSDYDGKLSNFKTAAESFKGKILFIFIDSDHTDNQRILEFFGLKKEECPA

SEQ ID NO: 9944 - protein, 54 aa, Homo Sapiens
MLRRALLCLAVAALVRADAPEEEDHVLVLRKSNFAEALAAHKCPLVWPLQGSGP

SEQ ID NO: 9945 - protein, 156 aa, Homo Sapiens
MLRRALLCLAVAALVRADAPEEEDHVLVLRKSNFAEALAAHKYLLVDATEESDLAQQYGVRGYPTIKFFRNGDTASPKEYTAGREADDIVNWLKKRTGPAATTLPDGAAAESLVESSEVAVIGFFKDVESDSAKQFLQAAEAIDDIPFGITSNSDV

SEQ ID NO: 9946 - protein, 208 aa, Homo Sapiens
MLRRALLCLAVAALVRADAPEEEDHVLVLRKSNFAEALAAHKYLLVEFSGREADDIVNWLKKRTGPAATTLPDGAAAESLVESSEVAVIGFFKDVESDSAKQFLQAAEAIDDIPFGITSNSDVFSKYQLDKDGVVLFKKFDEGRNNFEGEVTKENLLDFIKHNQLPLVIEFTEQTAPKIFGGEIKTHILLFLPKSVSDYDGKLSNFKT

SEQ ID NO: 9947 - protein, 148 aa, Homo Sapiens
MLRRALLCLAVAALVRADAPEEEDHVLVLRKSNFAEALAAHKYLLVEFYAPWCGHCKALAPEYAKAAGKLKAEGSEIRLAKMDSTANEVEAVKVHSFPTLKFFPASADRTVIDYNGERTLDGFKKFLESGGQDGAGDDDDLEDLEEAE

SEQ ID NO: 9948 - protein, 188 aa, Homo Sapiens
MLRRALLCLAVAALVRADAPEEEDHVLVLRKSNFAEALAAHKYLLVEFYAPWCGHCKALAPEYAKAAGKLKAEGSEIRLAKVDATEESDLAQQYGVRGYPTIKFFRNGDTASPKEYTAAESLVESSEVAVIGFFKDVESDSAKQFLQAAEAIDDIPFGITSNSDVFSKYQLDKDGVVLFKKFDEGRNN

SEQ ID NO: 9949 - protein, 508 aa, Homo Sapiens
MLRRALLCLAVAALVRADAPEEEDHVLVLRKSNFAEALAAHKYLLVEFYAPWCGHCKALAPEYAKAAGKLKAEGSEIRLAKVDATEESDLAQQYGVRGYPTIKFFRNGDTASPKEYTAGREADDIVNWLKKRTGPAATTLPDGAAAESLVESSEVAVIGFFKDVESDSAKQFLQAAEAIDDIPFGITSNSDVFSKYQLDKDGVVLFKKFDEGRNNFEGEVTKENLLDFIKHNQLPLVIEFTEQTAPKIFGGEIKTHILLFLPKSVSDYDGKLSNFKTAAESFKGKILFIFIDSDHTDNQRILEFFGLKKEECPAVRLITLEEEMTKYKPESEELTAERITEFCHRFLEGKIKPHLMSQELPEDWDKQPVKVLVGKNFEDVAFDEKKNVFVEFYAPWCGHCKQLAPIWDKLGETYKDHENIVIAKMDSTANEVEAVKVHSFPTLKFFPASADRTVIDYNGERTLDGFKKFLESGGQDGAGDDDDLEDLEEAEEPDMEEDDDQKAVKDEL

SEQ ID NO: 9950 - protein, 464 aa, Homo Sapiens
MLRRALLCLAVAALVRADAPEEEDHVLVLRKSNFAEALAAHKYLLVEFYAPWCGHCKALAPEYAKAAGKLKAEGSEIRLAKVDATEESDLAQQYGVRGYPTIKFFRNGDTASPKEYTGDVESDSAKQFLQAAEAIDDIPFGITSNSDVFSKYQLDKDGVVLFKKFDEGRNNFEGEVTKENLLDFIKHNQLPLVIEFTEQTAPKIFGGEIKTHILLFLPKSVSDYDGKLSNFKTAAESFKGKILFIFIDSDHTDNQRILEFFGLKKEECPAVRLITLEEEMTKYKPESEELTAERITEFCHRFLEGKIKPHLMSQELPEDWDKQPVKVLVGKNFEDVAFDEKKNVFVEFYAPWCGHCKQLAPIWDKLGETYKDHENIVIAKMDSTANEVEAVKVHSFPTLKFFPASADRTVIDYNGERTLDGFKKFLESGGQDGAGDDDDLEDLEEAEEPDMEEDDDQKAVKDEL

SEQ ID NO: 9951 - protein, 166 aa, Homo Sapiens
MLRRALLCLAVAALVRADAPEEEDHVLVLRKSNFAEALAAHKYLLVEFYAPWCGHCKALAPEYAKAAGKLKAEGSEIRLAKVDATEESDLAQQYGVRGYPTIKFFRNGDTASPKEYTGFDEGRNNFEGEVTKENLLDFIKHNQLPLVIEFTEQTAPKIFGGEIKTH

SEQ ID NO: 9952 - protein, 106 aa, Homo Sapiens
MLRRALLCLAVAALVRADAPEEEDHVLVLRKSNFAEALAAHKYLLVEFYAPWCGHCKALAPEYAKAAGKLKAEGSEIRPPRRSLSPVWEGRSRTGHGHSVPPAVSP

SEQ ID NO: 9953 - protein, 274 aa, Homo Sapiens
  misc_feature (1)..(1): Xaa can be any naturally occurring amino acid
XFEGEVTKENLLDFIKHNQLPLVIEFTEQSVSDYDGKLSNFKTAAESFKGKILFIFIDSDHTDNQRILEFFGLKKEECPAVRLITLEEEMTKYKPESEELTAERITEFCHRFLEGKIKPHLMSQELPEDWDKQPVKVLVGKNFEDVAFDEKKNVFVEFYAPWCGHCKQLAPIWDKLGETYKDHENIVIAKMDSTANEVEAVKVHSFPTLKFFPASADRTVIDYNGERTLDGFKKFLESGGQDGAGDDDDLEDLEEAEEPDMEEDDDQKAVKDEL

SEQ ID NO: 9954 - protein, 132 aa, Homo Sapiens
LMATLKAPLRVHITSLLPTPEDNLEIVLHRWENNSCVEKKVLGEKTENPKKFKINYTVANEATLLDTDYDNFLFLCLQDTTTPIQSMMCQYLARVLVEDDEIMQGFIRAFRPLPRHLWYLLDLKQMEEPCRF

SEQ ID NO: 9955 - protein, 143 aa, Homo Sapiens
MLCLLLTLGVALVCGVPAMDIPQTKQDLELPKLAGTWHSMAMATNNISLMATLKAPLRVHITSLLPTPEDNLEIVLHRWENNSCVEKKVLGEKTENPKKFKINSRVLVEDDEIMQGFIRAFRPLPRHLWYLLDLKQMEEPCRF

SEQ ID NO: 9956 - protein, 180 aa, Homo Sapiens
MLCLLLTLGVALVCGVPAMDIPQTKQDLELPKLAGTWHSMAMATNNISLMATLKAPLRVHITSLLPTPEDNLEIVLHRWENNSCVEKKVLGEKTENPKKFKINYTVANEATLLDTDYDNFLFLCLQDTTTPIQSMMCQYLARVLVEDDEIMQGFIRAFRPLPRHLWYLLDLKQMEEPCRF

SEQ ID NO: 9957 - protein, 180 aa, Homo Sapiens; identical to SEQ ID NO: 9956

SEQ ID NO: 9958 - protein, 180 aa, Homo Sapiens; identical to SEQ ID NO: 9956

SEQ ID NO: 9959 - protein, 169 aa, Homo Sapiens
MLCLLLTLGVALVCGVPAMDIPQTKQDLELPKLAGTWHSMAMATNNISLMATLKAPLRVHITSLLPTPEDNLEIVLHRWENNSCVEKKVLGEKTENPKKFKINYTVANEATLLDTDYDNFLFLCLQDTTTPIQSMMCQYLESWWRTMRSCRDSSGLSGPCPGTYGTCWT

SEQ ID NO: 9960 - protein, 33 aa, Homo Sapiens
  misc_feature (1)..(1): Xaa can be any naturally occurring amino acid
XEIMQGFIRAFRPLPRHLWYLLDLKQMEEPCRF

SEQ ID NO: 9961 - protein, 126 aa, Homo Sapiens
  misc_feature (1)..(1): Xaa can be any naturally occurring amino acid
XPLRVHITSLLPTPEDNLEIVLHRWENNSCVEKKVLGEKTENPKKFKINYTVANEATLLDTDYDNFLFLCLQDTTTPIQSMMCQYLARVLVEDDEIMQGFIRAFRPLPRHLWYLLDLKQMEEPCRF

SEQ ID NO: 9962 - protein, 131 aa, Homo Sapiens
  misc_feature (1)..(1): Xaa can be any naturally occurring amino acid
XVPAMDIPQTKQDLELPKAPLRVHITSLLPTPEDNLEIVLHRWENNSCVEKKVLGEKTENPKKFKINCKASGAPQLSWKPQGPRTDPASSTARVLVEDDEIMQGFIRAFRPLPRHLWYLLDLKQMEEPCRF

SEQ ID NO: 9963 - protein, 25 aa, Homo Sapiens
MAGRVPSLLVLLVFPSSCLAFRSPL

SEQ ID NO: 9964 - protein, 28 aa, Homo Sapiens
MAGRVPSLLVLLVFPSSCLAFRSPLSVF

SEQ ID NO: 9965 - protein, 29 aa, Homo Sapiens
MAGRVPSLLVLLVFPSSCLAFRSPLSVFK

SEQ ID NO: 9966 - protein, 42 aa, Homo Sapiens
MAGRVPSLLVLLVFPSSCLAFRSPLSVFKRFKETTRPFSNEC

SEQ ID NO: 9967 - protein, 53 aa, Homo Sapiens
MAGRVPSLLVLLVFPSSCLAFRSPLSVFKRFKETTRPFSNECLGTTRPVVPID

SEQ ID NO: 9968 - protein, 68 aa, Homo Sapiens
MAGRVPSLLVLLVFPSSCLAFRSPLSVFKRFKETTRPFSNECLGTTRPVVPIDSSDFALDIRMPGVTP

SEQ ID NO: 9969 - protein, 175 aa, Homo Sapiens
MAGRVPSLLVLLVFPSSCLAFRSPLSVFKRFKETTRPFSNECLGTTRPVVPIDSSDFALDIRMPGVTPKQLTSSLEPAWILSITCYFLDAICLHPLEVTGFVMKEPVQIKPIFCMPGREMLPLPGSPKVLDSELEERLEVNTLYYRYTMGILVLLEIITRTVLVCPYTSHVCHSL

SEQ ID NO: 9970 - protein, 974 aa, Homo Sapiens
MAGRVPSLLVLLVFPSSCLAFRSPLSVFKRFKETTRPFSNECLGTTRPVVPIDSSDFALDIRMPGVTPKQSDTYFCMSMRIPVDEEAFVIDFKPRASMDTVHHMLLFGCNMPSSTGSYWFCDEGTCTDKANILYAWARNAPPTRLPKGVGFRVGGETGSKYFVLQVHYGDISAFRDNNKDCSGVSLHLTRLPQPLIAGMYLMMSVDTVIPAGEKVVNSDISCHYKNYPMHVFAYRVHTHHLGKVVSGYRVRNGQWTLIGRQSPQLPQAFYPVGHPVDVSFGDLLAARCVFTGEGRTEATHIGGTSSDEMCNLYIMYYMEAKHAVSFMTCTQNVAPDMFRTIPPEANIPIPVKSDMVMMHEHHKETEYKDKIPLLQQPKREEEEVLDQGDFYSLLSKLLGEREDVVHVHKYNPTEKAESESDLVAEIANVVQKKDLGRSDAREGAEHERGNAILVRDRIHKFHRLVSTLRPPESRVFSLQQPPPGEGTWEPEHTGDFHMEEALDWPGVYLLPGQVSGVALDPKNNLVIFHRGDHVWDGNSFDSKFVYQQIGLGPIEEDTILVIDPNNAAVLQSSGKNLFYLPHGLSIDKDGNYWVTDVALHQVFKLDPNNKEGPVLILGRSMQPGSDQNHFCQPTDVAVDPGTGAIYVSDGYCNSRIVQFSPSGKFITQWGEESSGSSPLPGQFTVPHSLALVPLLGQLCVADRENGRIQCFKTDTKEFVREIKHSSFGRNVFAISYIPGLLFAVNGKPHFGDQEPVQGFVMNFSNGEIIDIFKPVRKHFDMPHDIVASEDGTVYIGDAHTNTVWKFTLTEKLEHRSVKKAGIEVQEIKEAEAVVETKMENKPTSSELQKMQEKQKLIKEPGSGVPVVLITTLLVIPVVVLLAIAIFIRWKKSRAFGADSEHKLETSSGRVLGRFRGKGSGGLNLGNFFASRKGYSRKGFDRLSTEGSDQEKEDDGSESEEEYSAPLPALAPSSS

SEQ ID NO: 9971 - protein, 887 aa, Homo Sapiens
MAGRVPSLLVLLVFPSSCLAFRSPLSVFKRFKETTRPFSNECLGTTRPVVPIDSSDFALDIRMPGVTPKQSDTYFCMSMRIPVDEEAFVIDFKPRASMDTVHHMLLFGCNMPSSTGSYWFCDEGTCTDKANILYAWARNAPPTRLPKGVGFRVGGETGSKYFVLQVHYGDISAFRDNNKDCSGVSLHLTRLPQPLIAGMYLMMSVDTVIPAGEKVVNSDISCHYKNYPMHVFAYRVHTHHLGKVVSGYRVRNGQWTLIGRQSPQLPQAFYPVGHPVDVSFGDLLAARCVFTGEGRTEATHIGGTSSDEMCNLYIMYYMEAKHAVSFMTCTQNVAPDMFRTIPPEANIPIPVKSDMVMMHEHHKETEYKDKIPLLQQPKREEEEVLDQGDFYSLLSKLLGEREDVVHVHKYNPTEKAESESDLVAEIANVVQKKDLGRSDAREGAEHERGNAILVRDRIHKFHRLVSTLRPPESRVFSLQQPPPGEGTWEPEHTGDFHMEEALDWPGVYLLPGQVSGVALDPKNNLVIFHRGDHVWDGNSFDSKFVYQQIGLGPIEEDTILVIDPNNAAVLQSSGKNLFYLPHGLSIDKDGNYWVTDVALHQVFKLDPNNKEGPVLILGRSMQPGSDQNHFCQPTDVAVDPGTGAIYVSDGYCNSRIVQFSPSGKFITQWGEESSGSSPLPGQFTVPHSLALVPLLGQLCVADRENGRIQCFKTDTKEFVREIKHSSFGRNVFAISYIPGLLFAVNGKPHFGDQEPVQGFVMNFSNGEIIDIFKPVRKHFDMPHDIVASEDGTVYIGDAHTNTVWKFTLTEKLEHRSVKKAGIEVQEIKGKGSGGLNLGNFFASRKGYSRKGFDRLSTEGSDQEKEDDGSESEEEYSAPLPALAPSSS

SEQ ID NO: 9972 - protein, 866 aa, Homo Sapiens
MAGRVPSLLVLLVFPSSCLAFRSPLSVFKRFKETTRPFSNECLGTTRPVVPIDSSDFALDIRMPGVTPKQSDTYFCMSMRIPVDEEAFVIDFKPRASMDTVHHMLLFGCNMPSSTGSYWFCDEGTCTDKANILYAWARNAPPTRLPKGVGFRVGGETGSKYFVLQVHYGDISAFRDNNKDCSGVSLHLTRLPQPLIAGMYLMMSVDTVIPAGEKVVNSDISCHYKNYPMHVFAYRVHTHHLGKVVSGYRVRNGQWTLIGRQSPQLPQAFYPVGHPVDVSFGDLLAARCVFTGEGRTEATHIGGTSSDEMCNLYIMYYMEAKHAVSFMTCTQNVAPDMFRTIPPEANIPIPVKSDMVMMHEHHKETEYKDKIPLLQQPKREEEEVLDQDFHMEEALDWPGVYLLPGQVSGVALDPKNNLVIFHRGDHVWDGNSFDSKFVYQQIGLGPIEEDTILVIDPNNAAVLQSSGKNLFYLPHGLSIDKDGNYWVTDVALHQVFKLDPNNKEGPVLILGRSMQPGSDQNHFCQPTDVAVDPGTGAIYVSDGYCNSRIVQFSPSGKFITQWGEESSGSSPLPGQFTVPHSLALVPLLGQLCVADRENGRIQCFKTDTKEFVREIKHSSFGRNVFAISYIPGLLFAVNGKPHFGDQEPVQGFVMNFSNGEIIDIFKPVRKHFDMPHDIVASEDGTVYIGDAHTNTVWKFTLTEKLEHRSVKKAGIEVQEIKEAEAVVETKMENKPTSSELQKMQEKQKLIKEPGSGVPVVLITTLLVIPVVVLLAIAIFIRWKKSRAFGDSEHKLETSSGRVLGRFRGKGSGGLNLGNFFASRKGYSRKGFDRLSTEGSDQEKEDDGSESEEEYSAPLPALAPSSS

SEQ ID NO: 9973 - protein, 905 aa, Homo Sapiens
MAGRVPSLLVLLVFPSSCLAFRSPLSVFKRFKETTRPFSNECLGTTRPVVPIDSSDFALDIRMPGVTPKQSDTYFCMSMRIPVDEEAFVIDFKPRASMDTVHHMLLFGCNMPSSTGSYWFCDEGTCTDKANILYAWARNAPPTRLPKGVGFRVGGETGSKYFVLQVHYGDISAFRDNNKDCSGVSLHLTRLPQPLIAGMYLMMSVDTVIPAGEKVVNSDISCHYKNYPMHVFAYRVHTHHLGKVVSGYRVRNGQWTLIGRQSPQLPQAFYPVGHPVDVSFGDLLAARCVFTGEGRTEATHIGGTSSDEMCNLYIMYYMEAKHAVSFMTCTQNVAPDMFRTIPPEANIPIPVKSDMVMMHEHHKETEYKDKIPLLQQPKREEEEVLDQGDFYSLLSKLLGEREDVVHVHKYNPTEKAESESDLVAEIANVVQKKDLGRSDAREGAEHERGNAILVRDRIHKFHRLVSTLRPPESRVFSLQQPPPGEGTWEPEHTGDFHMEEALDWPGVYLLPGQVSGVALDPKNNLVIFHRGDHVWDGNSFDSKFVYQQIGLGPIEEDTILVIDPNNAAVLQSSGKNLFYLPHGLSIDKDGNYWVTDVALHQVFKLDPNNKEGPVLILGRSMQPGSDQNHFCQPTDVAVDPGTGAIYVSDGYCNSRIVQFSPSGKFITQWGEESSGSSPLPGQFTVPHSLALVPLLGQLCVADRENGRIQCFKTDTKEFVREIKHSSFGRNVFAISYIPGLLFAVNGKPHFGDQEPVQGFVMNFSNGEIIDIFKPVRKHFDMPHDIVASEDGTVYIGDAHTNTVWKFTLTEKLEHRSVKKAGIEVQEIKDSEHKLETSSGRVLGRFRGKGSGGLNLGNFFASRKGYSRKGFDRLSTEGSDQEKEDDGSESEEEYSAPLPALAPSSS

SEQ ID NO: 9974 - protein, 973 aa, Homo Sapiens [sequence omitted]

SEQ ID NO: 9975 - protein, 679 aa, Homo Sapiens
  misc_feature (1)..(1): Xaa can be any naturally occurring amino acid
XMHVFAYRVHTHHLGKVVSGYRVRNGQWTLIGRQSPQLPQAFYPVGHPVDVSFGDLLAARCVFTGEGRTEATHIGGTSSDEMCNLYIMYYMEAKHAVSFMTCTQNVAPDMFRTIPPEANIPIPVKSDMVMMHEHHKETEYKDKIPLLQQPKREEEEVLDQGDFYSLLSKLLGEREDVVHVHKYNPTEKAESESDLVAEIANVVQKKDLGRSDAREGAEHERGNAILVRDRIHKFHRLVSTLRPPESRVFSLQQPPPGEGTWEPEHTGDFHMEEALDWPGVYLLPGQVSGVALDPKNNLVIFHRGDHVWDGNSFDSKFVYQQIGLGPIEEDTILVIDPNNAAVLQSSGKNLFYLPHGLSIDKDGNYWVTDVALHQVFKLDPNNKEGPVLILGRSMQPGSDQNHFCQPTDVAVDPGTGAIYVSDGYCNSRIVQFSPSGKFITQWGEESSGSSPLPGQFTVPHSLALVPLLGQLCVADRENGRIQCFKTDTKEFVREIKHSSFGRNVFAISYIPGLLFAVNGKPHFGDQEPVQGFVMNFSNGEIIDIFKPVRKHFDMPHDIVASEDGTVYIGDAHTNTVWKFTLTEKLEHRSVKKAGIEVQEIKADSEHKLETSSGRVLGRFRGKGSGGLNLGNFFASRKGYSRKGFDRLSTEGSDQEKEDDGSESEEEYSAPLPALAPSSS

SEQ ID NO: 9976 - protein, 250 aa, Homo Sapiens
  misc_feature (1)..(1): Xaa can be any naturally occurring amino acid
XRIQCFKTDTKEFVREIKHSSFGRNVFAISYIPGLLFAVNGKPHFGDQEPVQGFVMNFSNGEIIDIFKPVRKHFDMPHDIVASEDGTVYIGDAHTNTVWKFTLTEKLEHRSVKKAGIEVQEIKEAEAVVETKMENKPTSSELQKMQEKQKLIKEPGSGVPVVLITTLLVIPVVVLLAIAIFIRWKKSRAFGGKGSGGLNLGNFFASRKGYSRKGFDRLSTEGSDQEKEDDGSESEEEYSAPLPALAPSSS

SEQ ID NO: 9977 - protein, 675 aa, Homo Sapiens
MCRECCEYDQIECVCPGKREVVGYTIPCCRNEENECDSCLIHPGCTIFENCKSCRNGSWGGTLDDFYVKGFYCAECRAGWYGGDCMRCGQVLRAPKGQILLESYPLNAHCEWTIHAKPGFVIQLRFVMLSLEFDYMCQYDYVEVRDGDNRDGQIIKRVCGNERPAPIQSIGSSLHVLFHSDGSKNFDGFHAIYEEITACSSSPCFHDGTCVLDKAGSYKCACLAGYTGQRCENLLEAGKSKIKASEDSLSVLEERNCSDPGGPVNGYQKITGGPGLINGRHAKIGTVVSFFCNNSYVLSGNEKRTCQQNGEWSGKQPICIKACREPKISDLVRRRVLPMQVQSRETPLHQLYSAAFSKQKLQSAPTKKPALPFGDLPMGYQHLHTQLQYECISPFYRRLGSSRRTCLRTGKWSGRAPSCIPICGKIENITAPKTQGLRWPWQAAIYRRTSGVHDGSLHKGAWFLVCSGALVNERTVVVAAHCVTDLGKVTMIKTADLKVVLGKFYRDDDRDEKTIQSLQISAIILHPNYDPILLDADIAILKLLDKARISTRVQPICLAASRDLSTSFQESHITVAGWNVLADVRSPGFKNDTLRSGVVSVVDSLLCEEQHEDHGIPVSVTDNMFCASWEPTAPSDICTAETGGIAAVSFPGRASPEPRWHLMGLVSWSYDKTCS

SEQ ID NO: 9978 - protein, 680 aa, Homo Sapiens
MCRECCEYDQIECVCPGKREVVGYTIPCCRNEENECDSCLIHPGCTIFENCKSCRNGSWGGTLDDFYVKGFYCAECRAGWYGGDCMRCGQVLRAPKGQILLESYPLNAHCEWTIHAKPGFVIQLRFVMLSLEFDYMCQYDYVEVRDGDNRDGQIIKRVCGNERPAPIQSIGSSLHVLFHSDGSKNFDGFHAIYEEITACSSSPCFHDGTCVLDKAGSYKCACLAGYTGQRCENLLEERNCSDPGGPVNGYQKITGGPGLINGRHAKIGTVVSFFCNNSYVLSGNEKRTCQQNGEWSGKQPICIKACREPKISDLVRRRVLPMQVQSRETPLHQLYSAAFSKQKLQSAPTKKPALPFGDLPMGYQHLHTQLQYECISPFYRRLGSSRRTCLRTGKWSGRAPSCIPICGKIENITAPKTQGLRWPWQAAIYRRTSGVHDGSLHKGAWFLVCSGALVNERTVVVAAHCVTDLGKVTMIKTADLKVVLGKFYRDDDRDEKTIQSLQISAIILHPNYDPILLDADIAILKLLDKARISTRVQPICLAASRDLSTSFQESHITVAGWNVLADVRSPGFKNDTLRSGVVSVVDSLLCEEQHEDHGIPVSVTDNMFCASWEPTAPSDICTAETGGIAAVSFPGRASPEPRWHLMGLVSWSYDKTCSHRLSTAFTKVLPFKDWIERNMK

SEQ ID NO: 9979 - protein, 178 aa, Homo Sapiens
MELGCWTQLGLTFLQLLLISSLPREYTVINEACPGAEWNIMCRECCEYDQIECVCPGKREVVGYTIPCCRNEENECDSCLIHPGCTIFENCKSCRNGSWGGTLDDFYVKGFYCAECRAGWYGGDCMPCSSSPCFHDGTCVLDKAGSYKCACLAGYTGQRCENLLEERNCSDPGGPVNG

SEQ ID NO: 9980 - protein, 609 aa, Homo Sapiens
MELGCWTQLGLTFLQLLLISSLPREYTVINEACPGAEWNIMCRECCEYDQIECVCPGKREVVGYTIPCCRNEENECDSCLIHPGCTIFENCKSCRNGSWGGTLDDFYVKGFYCAECRAGWYGGDCMPCSSSPCFHDGTCVLDKAGSYKCACLAGYTGQRCENLLEERNCSDPGGPVNGYQKITGGPGLINGRHAKIGTVVSFFCNNSYVLSGNEKRTCQQNGEWSGKQPICIKACREPKISDLVRRRVLPMQVQSRETPLHQLYSAAFSKQKLQSAPTKKPALPFGDLPMGYQHLHTQLQYECISPFYRRLGSSRRTCLRTGKWSGRAPSCIPICGKIENITAPKTQGLRWPWQAAIYRRTSGVHDGSLHKGAWFLVCSGALVNERTVVVAAHCVTDLGKVTMIKTADLKVVLGKFYRDDDRDEKTIQSLQISAIILHPNYDPILLDADIAILKLLDKARISTRVQPICLAASRDLSTSFQESHITVAGWNVLADVRSPGFKNDTLRSGVVSVVDSLLCEEQHEDHGIPVSVTDNMFCASWEPTAPSDICTAETGGIAAVSFPGRASPEPRWHLMGLVSWSYDKTCSHRLSTAFTKVLPFKDWIERNMK

SEQ ID NO: 9981 - protein, 737 aa, Homo Sapiens
MELGCWTQLGLTFLQLLLISSLPREYTVINEACPGAEWNIMCRECCEYDQIECVCPGKREVVGYTIPCCRNEENECDSCLIHPGCTIFENCKSCRNGSWGGTLDDFYVKGFYCAECRAGWYGGDCMRCGQVLRAPKGQILLESYPLNAHCEWTIHAKPGFVIQLRFVMLSLEFDYMCQYDYVEVRDGDNRDGQIIKRVCGNERPAPIQSIGSSLHVLFHSDGSKNFDGFHAIYEEITACSSSPCFHDGTCVLDKAGSYKCACLAGYTGQRCENLLEAGKSKIKASEDSLSVLEERNCSDPGGPVNGYQKITGGPGLINGRHAKIGTVVSFFCNNSYVLSGNEKRTCQQNGEWSGKQPICIKACREPKISDLVRRRVLPMQVQSRETPLHQLYSAAFSKQKLQSAPTKKPALPFGDLPMGYQHLHTQLQYECISPFYRRLGSSRRTCLRTGKWSGRAPSCIPICGKIENITAPKTQGLRWPWQAAIYRRTSGVHDGSLHKGAWFLVCSGALVNERTVVVAAHCVTDLGKVTMIKTADLKVVLGKFYRDDDRDEKTIQSLQISAIILHPNYDPILLDADIAILKLLDKARISTRVQPICLAASRDLSTSFQESHITVAGWNVLADVRSPGFKNDTLRSGVVSVVDSLLCEEQHEDHGIPVSVTDNMFCASWEPTAPSDICTAETGGIAAVSFPGRASPEPRWHLMGLVSWSYDKTCSHRLSTAFTKVLPFKDWIERNMK
